United States Patent 8,344,211 (PLANT NUCLEOTIDE SEQUENCES AND CORRESPONDING POLYPEPTIDES) - sequence listing, part 25

SEQ ID NO: 93096 - DNA, 819 bp, Zea mays
  misc_feature: Ceres CLONE 1582192
  misc_feature: Encodes the peptide sequence at SEQ ID NO. 93097
  misc_feature (696)..(696): n is a, c, t, g, unknown, or other
  misc_feature (790)..(790): n is a, c, t, g, unknown, or other
ctggagctccccgcggtggcggccgctctagaactagtggatcccccgggctgcaggaattcgtctcacccctagaaaaactccccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctgttcagattactcgtggtatcgagaaacagcgaaagcactagttgaagaactacggaaagtgtctaanggagtcgaagatagtgagcttgcagatgttgctgctgttagtgcgggcaacactacgaaattggtaatatgatagcagaggcatgagcaagtcngtcggaagggtgtggttacctcgaagaag

SEQ ID NO: 93097 - protein, 160 aa, Zea mays
  misc_feature: Ceres CLONE 1582192
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKQRKH

SEQ ID NO: 93098 - DNA, 785 bp, Zea mays
  misc_feature: Ceres CLONE 1582195
  misc_feature: Translation starting site: 155
  misc_feature: SWISSPROT Homolog: EC 4.1.1.31 Phosphoenolpyruvate carboxylase
  misc_feature (529)..(529): n is a, c, t, g, unknown, or other
  misc_feature (594)..(594): n is a, c, t, g, unknown, or other
  misc_feature (692)..(692): n is a, c, t, g, unknown, or other
  misc_feature (750)..(750): n is a, c, t, g, unknown, or other
ctccccgcggtggcggccgctctagaactagtggatcccccgggctgcaggaattcgtctcacccctagaaaaaacaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccgccgccgcaacacaacnccaagaaaaggtggcttcgccgacgaaggctccgccaccaccgagtccgacatcgaggagacgcntcagcgccctcgtgtccgaagtcggcaagtccccccgaggaggtgttcgaggcgctcaagaaacagaccgtcgacctcgtcttcaccgcgcatcccangcagtccgcccgccgctcgctcctgcagaaaaaccgaggatcccgaattgtctgaccnagctgaaatgccaggacatcactgacgacgacagc

SEQ ID NO: 93099 - DNA, 924 bp, Zea mays
  misc_feature: Ceres CLONE 1582197
  misc_feature: Encodes the peptide sequence at SEQ ID NO. 93100
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
nnnnaaaatttcacacttatatttaaacaactatcaaaaggcgacttcgctcggccccaannnntngggccacttcccgtgaaaaactggtactccccgcggtggcggccgctctagactagtggatcccccgggctgtttcgattcgtctcacccctagaaaaaaccaatcgcatcgcagcagcacgagcagtacgccgtgccgctccaaccatctcgcttccgtgcttagcttcccgccgcgccatggcgtcaaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccgccgccgcaacagcaaactcaagaaaggtgggcttcgcccgacgaaggctccgccacccaccgtagtcccgacatcgaaggagaacgctcatagcgccctcgtgttccgagggtcgggcaagttccccccgaagggaagtgtttcgaaaggcgcctcaagaaaccagaaccggtcggaccttcgtccttcgcccggcgcaatccccaccgcaatgtccgggcccggccggcttcgacttccttgaaagtaaaaaacgcccgagggattccgggaaattgtggcctgaaaccccaaccttaaaaggcccaaagggacaatt

SEQ ID NO: 93100 - protein, 200 aa, Zea mays
  misc_feature: Ceres CLONE 1582197
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRRNSKLKKGGLRPTKAPPPTVVPTSKENAHSALVFRGSGKFPPKGSVSKGASRNQNRSDLRPSPGAIPTAMSGPGRLRLP

SEQ ID NO: 93101 - DNA, 855 bp, Zea mays
  misc_feature: Ceres CLONE 1582198
  misc_feature: Encodes the peptide sequence at SEQ ID NO. 93102
  misc_feature (842)..(842): n is a, c, t, g, unknown, or other
ggagctccccgcggtggcggccgctctagaactagtggatcccccgggctgcaggaattcgtctcacccctagaaaaagtcctcacctttcactaccactcaccactgcctcggatccataccagctgcatgaatactgtgcgcgagctagatgcagtctgccccatacatcgatatatctctcagacatcatggtcctggaggagaaaggacagctgtcgacggacatcatgaacctcggcatgaagtcctcgggcctggacgcctggtcgcctgacttatccgagatcgtgcgccaccacctgccggactttctgcagtcggtgaatctcaagtacatgcacttcgagaagcactacctcaacacccacggcaagtacctggccatgaaccccatcatcatgctcgtgtacggcaaccagctcgtcagcctcagcttctatgagctgtcgctccagatggtacggcgaggtcacctattacaatgtgatcgtgctctcctgccacgacgtcatgatctgtgtgatcttcatgtacgacgagaaacagttcacggccgagtacatcatctacttgatctgcaacaagatgaacgacaaggtcgaggtttacctacgccgacttcatcaacaatgctgtgcacatcgtgccagttctacttaggacactctgaccttccagtcacgactgacggccgagtcatgtctcggctacgagtcatacatgtcatcgatgagtgtaccaagcgcagcgcatgctataccggctttgaaagaaagtcgacgccgagagcgtccagcaacatgttctcatgctctgagatcagctggtcgtaccatttnacgtgtcgcgtcc

SEQ ID NO: 93102 - protein, 221 aa, Zea mays
  misc_feature: Ceres CLONE 1582198
  misc_feature: SWISSPROT Homolog: EC 2.3.1.119 Icosanoyl-CoA synthase
  misc_feature (217)..(217): Xaa is any aa, unknown, or other
MVLEEKGQLSTDIMNLGMKSSGLDAWSPDLSEIVRHHLPDFLQSVNLKYMHFEKHYLNTHGKYLAMNPIIMLVYGNQLVSLSFYELSLQMVRRGHLLQCDRALLPRRHDLCDLHVRRETVHGRVHHLLDLQQDERQGRGLPTPTSSTMLCTSCQFYLGHSDLPVTTDGRVMSRLRVIHVIDECTKRSACYTGFERKSTPRASSNMFSCSEISWSYHXTCRV

SEQ ID NO: 93103 - DNA, 859 bp, Zea mays
  misc_feature: Ceres CLONE 1582199
  misc_feature: Encodes the peptide sequence at SEQ ID NO. 93104
tccccgcggtggcggccgctctagaactagtggatcccccgggctgcaggaattcgtctcacccctagaaaaaagccgcctctcctcctcctcctcctccttcttcttccccctctcaaggctctcctcctccacagcctgcagtccagctcaccaggaccaggaggagaagaagttgcatagccgcgcatctgcatccacatccacactctgaacaataaactaagcagggcgctgcacgaggatggggtgcggggcgtcgagccagaaggacgccggggcgccgcggaggcggccggtgagcgtcggcgacgtggtcgtcttcctcccgggcctccgcgtgccgagggccgtcgacctggccccaggcgctcgggcggctgcctggcccaggagcgccggggaccggctgtcgggctctgcgaatcgccgggttcgtccaaaatggcaaatgccaaaaattcgggcggccgggggcttaaaggccccagccgggaagggggggcggggcacggggaaagggggtttttagtaaaaagggccaaatttttttaaagggccccctcaaaaaaaatatttttccggggtttttgcttgggaatggggaaaaaaaaaagggaggctcttttttggggaaaaaaaaggggccccttccccccgggggaaaaaccccggagggggaataattttttaagagaaaaaagggcttttttccaaaaaacccctgggtataaaaagggaggggtgtcccccagggggggacacttctaaaaaggggcccgtgtgtttctcttctctttttattagagacaaaaaaccccccgctgttttttttcccccggagggaaaaaaaaaagag

SEQ ID NO: 93104 - protein, 95 aa, Zea mays
  misc_feature: Ceres CLONE 1582199
MGCGASSQKDAGAPRRRPVSVGDVVVFLPGLRVPRAVDLAPGARAAAWPRSAGDRLSGSANRRVRPKWQMPKIRAAGGLKAPAGKGGRGTGKGGF

SEQ ID NO: 93105 - DNA, 1212 bp, Zea mays
  misc_feature: Ceres CLONE 1582200
  misc_feature: Encodes the peptide sequence at SEQ ID NO. 93106
  misc_feature (716)..(716): n is a, c, t, g, unknown, or other
  misc_feature (1144)..(1144): n is a, c, t, g, unknown, or other
gtggtgcggttttgcgggagagcgggacggttcgggccctcacttttattacaacaaccacgtaaaaatttctcgctggagctccccgcggtggcggccgctctagactagtggatcccccgggctgcaggaattcgtctcacccctagaaaaagtccacccattcctcgttcttccttaattcctcatttcctccacgtacgcgtgcatactctgcgagtccaggaggtattttcccccttcttcacgatactctcgacgagagcgtctccatggccggaaaaggagacgggccggcgatcggcatcgacctcggtacgacctactcgtgcgtcggggtgtggcagcctgaccgagtcgagatcatcgccaacgaccaggccaacgtaacaacgccgtcttatgtcgcgttcccccattcgagaaggctcgttggcgactcccccaagaaccgggtcgcaatgaaacccccatcaaacacctctttttaagccaaagggggttcatcgggccggcggcttttcttctgaaccctccggggtgtaaaaatgaaccccaaatctaatgggccctttcaaggggggaaacccccgggggcttccgggggcgaaaaaaaaccccccagtaaatcgggggggtgcccaaattttccagggggggcccaaaggaaaaaaaacactttgttattcttggtacccaagagaaaaaaaaatacncagcctcccccccaggaagaaccccccctgtggacccccccatgtatattttatatgggggagaaaatacgggcgcgcccctagaagaggggatatttataaaccctctcggagggggagccctcccgctccactcttttaaaagaaaaaaaccaccttttgtttttagataccaacccggtctgatccgccggggttcctatattattcttataaaaagaacaatactcccccatcctggttctcctacggggctccacacccccatggaggagacccccccccgaggaattttaatatttcagtgcggggggcctcccaaaaaaggacagaagggggggcacgatctcatttaatgaaaaaagggcctcctccgctgcgggcgggggggggaatactctattaaattagaggggggccctcacaancaaaaaaatcagcctaatatacatacaactggggaataaataaaaaactccccccctccaatcttccg

SEQ ID NO: 93106 - protein, 72 aa, Zea mays
  misc_feature: Ceres CLONE 1582200
MAGKGDGPAIGIDLGTTYSCVGVWQPDRVEIIANDQANVTTPSYVAFPHSRRLVGDSPKNRVAMKPPSNTSF

SEQ ID NO: 93107 - DNA, 1168 bp, Zea mays
  misc_feature: Ceres CLONE 1582201
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (18)..(18): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (82)..(82): n is a, c, t, g, unknown, or other
  misc_feature (867)..(867): n is a, c, t, g, unknown, or other
  misc_feature (1168)..(1168): n is a, c, t, g, unknown, or other
ngtggtggtggnnnangngcacaaaaccaataataataaaaaacacaaagtgaagtataagaaaccaccccannnttttaanttttggagctccccgcggtggcggccgctctagaatagtggatcccccgggctgcaggaattcgtctcacccctagaaaaaccccgcgtcgccctccgtcgtctcagcgtatgttgtgcatgtgaagagagagaggaagagggtgacgagcgagaaaaaagctagtagagtgatagcttgacaagacgcattgaagcgaaggccacgcataccaaagcaacctcaccatcgctcgcaagctactcgatcaaggacatttattgtcgcaacgagctagcaagaataatcccgcgtagtttcgcgaagcggtggtacatatggctcgcatcctcgtgctggctctgctcaccatcaggagcctcccccctgcccccgggtcgttcggagccaactggggggggggccaaactgccaagtaccaaaaagacctcccgggcccccggtaaaaggcacccccggggggggtggggggaaaaaacccctgtttgaacccagggcccgccccccggggaaaatttgtttttcccatttcaaaagggggcgccttcgaaaccccccgtgcccgaggggggggaaaacacccggggtggacgggttaattgtttggagaaaaaattaaagagcccggggggaccgttttaaaataaaaaaaaaaggagggggagtatggggccccccgtctctctaaaaaaaacctctaatcagatgtaactcttttcccaaaaggggggcaccggggggggccacaccacattttatattggggtggtgtgcgaaaattaggnacaaaaccaagggaggtgctaccaaaaaaagacggagagtccacaccaacaaggagggagagaggcgttctcccgccccaatcaaaaaataacgccggcccctctacgaagaacacccccgcccggcccgataattatttttttctcctacgccttaataaaaaaaatccccctcctcgggagagggggagaaacacctgtttttttctcacacataatcaaccacactattgtgggggggggcggagaaaacaaatataagagtgccatccagaggggggaacataaaaagaaagacaan

SEQ ID NO: 93108 - DNA, 783 bp, Zea mays
  misc_feature: Ceres CLONE 1582202
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (179)..(179): n is a, c, t, g, unknown, or other
  misc_feature (254)..(254): n is a, c, t, g, unknown, or other
  misc_feature (337)..(337): n is a, c, t, g, unknown, or other
  misc_feature (338)..(338): n is a, c, t, g, unknown, or other
  misc_feature (349)..(349): n is a, c, t, g, unknown, or other
  misc_feature (361)..(361): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagaactagtggatcccccgggctgcaggaattcgtctcacccctangaaaaaaagaagagtacgcccactcctccggctcttcttctccaccggcaccagtccaccaccctcctgccaccngcgcggccccaaccaaccacaccgcagcgcagcaatggcgggcaacggcgcccatcgtgggagagcgaccccctaaactgggnncgcgcgccgcngaactggccggnagccacctggacgaagtgaagcgcatgggtgggcgcaggcccccgcagcccgttggtcaagaatcgaggggctccacccctccgcggttgggccaagtggggcccgcccgttcccccttccgccaaaggaacccggttccgggggtttccccgttcaaacttaaaaaaaggaaaggccccccccccccgcgtttaaagggcccaaaacccaagggggggattcctggaaagggggatttgccccaaggggggggggaaacattttataggggggttcccccccccggggttttgggggggggcccttttccaaaagggggggaaaaaaaaaaagaaaggggggcccccccccctccccaagggggggaagatttttttttggggggatttttttaacaaccccgggaaaaaatttttcgggg

SEQ ID NO: 93109 - DNA, 841 bp, Zea mays
  misc_feature: Ceres CLONE 1582204
  misc_feature: Translation starting site: 154
  misc_feature: SWISSPROT Homolog: EC 1.4.1.2 Glutamate dehydrogenase
  misc_feature (398)..(398): n is a, c, t, g, unknown, or other
ctccccgcggtggcggccgctctagaactagtggatcccccgggctgcaggaattcgtctcacccctagaaaaagaaaccctagtcccctgctccattctcagccgccgccgatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccgcgccctcgtacgtcgccttcaccgactccgagcgcctcatcggagatgcggacaagaaccaggtcgccatgaaccccatcaacaccgtctttgatgccaagcgtctcatcggcaggaggttcantgatgcgtctgtccagagtgatatcaagttgtggcccttcaaggtcatttctgggcctggtgagaagccaatcgatgttgtccagcacaacggtgaggagaagcagtttgcagctgaagagatctcctctatggttcttatcaagatgcgtgagattgctgaagcttaccttggtagcacgatcaagaatgctgtggtcacagtccctgcctacgtcaatgactcacagaggcagggcacaaaggatgctggggctgaatgctgggccttaaatgttgctgcgtatctatcaacgaggccaacgcctgccagctattcacctattgtgtcttgaacaagaaaggcctacccagtgttccggtgaaagaggaatgtccctccactcttttgaattcttgggagggggggaaaccctttgaaaggtttcccctttccttcaagca

SEQ ID NO: 93110 - DNA, 799 bp, Zea mays
  misc_feature: Ceres CLONE 1582205
  misc_feature: Translation starting site: 577
  misc_feature (143)..(143): n is a, c, t, g, unknown, or other
  misc_feature (320)..(320): n is a, c, t, g, unknown, or other
  misc_feature (489)..(489): n is a, c, t, g, unknown, or other
ctccccgcggtggcggccgctctagaactagtggatcccccgggctgcaggaattcgtctcacccctagaaaaaaaaaattcctctccttcgaacagatccttttgcccccggacccctttcctacgcttgcccaaacccacnaaaccctcgccgtcgcgccgcgcgattgcctctccggccgccgcgagcccgcgacactagtaacggtctacaccactagaatgactgaagaattgaattccagcaaattcaagcttttgttttagccaagatttgagattcgatttgaagtgtggaagtccttacaatttgccaatncctatatttgatctctgcctgtgctgcgttaaatccctaaacttcacagcgcggcgccggcccagccacgccggaagaagtcgccgcgtgaggtcagtgtccccgttgctgccgcctctaacccgaagcctaggccgctgccggtgcataacaaggagaatcaggcggnaggggaaagtagcagaggagggggcagcaactgaggaggggggagaagtaccgggcggaaccggaaatcttgccgctgccgccggccatggcgaagctgggcccggggcaggggctcgggtgcgaggcggcggaggggtcgctcgtgcccagcggaagcgggagtacaagccctgcggcagcacactgaggggaagcgcccgctatatgctatcgggttcaacttcatggacgcgcgctactacgacgtcttcgccacccgtcgcggcaacccgcgtgacacttacgctgcctttgagatggtagtttcg

SEQ ID NO: 93111 - DNA, 802 bp, Zea mays
  misc_feature: Ceres CLONE 1582206
  misc_feature: Encodes the peptide sequence at SEQ ID NO. 93112
ctccccgcggtggcggccgctctagaactagtggatcccccgggctgcaggaattcgtctcacccctagaaaaaacacgcctcttctccccccccaaaaaatccagcagcagcagcaagccccacgcaacattagcagcaggagaccaccccaatcccccacggacattcgtcgcgaacccttatctgcacgccgcgccatggccgcagccgccgcggtcgcccacctctccatccacggccgcctccgccgctcaccggagcatcggccgtccatcaccaccaccaccacctcctcctcttcctcgtccgctcaccgcccgtccctcctgcggtgccgcgcgttcaagcaggaggccggcgacggcgacccggctgaggccgacgcgcggaagcgcaggaagggcccgctgtacaagctcaaggcggcgatccagggcctcgcgggatcccgctccgccgccgccgaggtgtacggtgggagagtaccagtaccagcgcgccgtcgagaaggcggaggagatcttcttctcggttgctactcagctaggcagatatgttatcactatgatgagcagcggtgttgtacttgggggttggattccagctgtcaggcggagacagccaaatgaacgaactaatttggtatagctggcttgggtgggggtgaatatcgggcacaatggataggtggcaaacagtggtcttagagggaacactggcaaagcttggaccctccccaatggtcgttcattaaccggggaagccacaaaggaggggttaaggaaaaaaagcgcccttgg

SEQ ID NO: 93112 - protein, 143 aa, Zea mays
  misc_feature: Ceres CLONE 1582206
MAAAAAVAHLSIHGRLRRSPEHRPSITTTTTSSSSSSAHRPSLLRCRAFKQEAGDGDPAEADARKRRKGPLYKLKAAIQGLAGSRSAAAEVYGGRVPVPARRREGGGDLLLGCYSARQICYHYDEQRCCTWGLDSSCQAETAK

SEQ ID NO: 93113 - DNA, 855 bp, Zea mays
  misc_feature: Ceres CLONE 1582207
  misc_feature: Encodes the peptide sequence at SEQ ID NO. 93114
gagctccccgcggtggcggccgctctagaactagtggatcccccgggctgcaggaattcgtctcacccctagaaaaaatcaggttcccctccccatcccggagagcaaaagcgcttctctcgctagcgagttcggcagtagaaaccctaaaaaaaaaagacaccgccctctccttcgctagcggaaccgccctcccctcgccggggtaggggtttcgggggtagacgcccgccatggacgcgttccggaaacagctggacgtgctcatgggcgccaaccgcaacggcgacgtcgaggaggtgagccgcaactactacgaccgcgacgtctgccgcctcttcctcgccggtctctgcccacacgacctctttcagctcacgaaaatggatctcggtccttgttctaagattcattctcttcaactgcggaaagattatgaagaagcgaaagcaaaaggaacagaaaattttgatagagaactcgaggatatgatagaaaggctcattgtggagtgtgacaggaaaattcagagggccctaaaacggcttgcagatgatgatgccaatgctgctattgcgatatcggtctctgaggttactctgacggatgacatactgcagctgtcaaaacagataaaggagaaaatggcagaagttgatgccttttgattttgaggggagaactgatgacaaaataagggcccagaaagtagtgaaggagctaagagctaaaaaagctgatatgcaggctacccctcttgcctgatgctttttaacagggaccgaagctccattaactcagccttgctccacttcaagtgggcagcggtttcccccaccagctccaccctgaggg

SEQ ID NO: 93114 - protein, 144 aa, Zea mays
  misc_feature: Ceres CLONE 1582207
  misc_feature (1)..(145): Pfam Name: LUC7 Pfam Description: LUC7 N_terminus
MDAFRKQLDVLMGANRNGDVEEVSRNYYDRDVCRLFLAGLCPHDLFQLTKMDLGPCSKIHSLQLRKDYEEAKAKGTENFDRELEDMIERLIVECDRKIQRALKRLADDDANAAIAISVSEVTLTDDILQLSKQIKEKMAEVDAF

SEQ ID NO: 93115 - DNA, 819 bp, Zea mays
  misc_feature: Ceres CLONE 1582208
  misc_feature: Translation starting site: 487
  misc_feature: SWISSPROT Homolog: EC 2.7.11.24 Mitogen-activated protein kinase
  misc_feature (703)..(703): n is a, c, t, g, unknown, or other
tggagctcaccgcggtggcggccgctctagaactagtggatcccccgggctgcaggaattcgtctcacccctagaaaaaaccaccacccgtcctcggccctcctctctctctctattcccccctccccggaggccggagcgctcgtgcggaccacgaggaggaggagagagagaggcagggagccctagccctgccctgcgcgccggcgtcgccagggttagggtctccccggggcccccgccttccttgccaatccctccgccgtcttctcgctctggccgatccccccgcccgacgcgcggggggcgcctagcggcgtgtctgcgttcggcctcgacggcgcggcgcgagccaatgctgtgtgcctgaccgtcgctttgggattgattccactcggaggtggccagctagccacccgagctcgctgtccttgccggtacggcgtttcctgaggaggttccgtgcgagatccgaaggccggcgtgatgcagcacgatcagcgcaagaagggttccgtggaggcagagtttttcacagagtatggggatgcaagtcgatacaagattcaggaagtcattggtaaaggaagctacggggtggtctgctccgctgtagatgtccacactggagagaaagtagcgatcaagaagatacatgacatctttgagcacatatctgatgctgcccggattctccgtgagnatcagcttctgagactcctagacatccagatattggtgagatcaaacatattatgttgcctccatcaagacgggaatcaaagatattttatgttgttttgaacttatggagtctga

SEQ ID NO: 93116 - DNA, 801 bp, Zea mays
  misc_feature: Ceres CLONE 1582215
  misc_feature: Translation starting site: 192
  misc_feature: SWISSPROT Homolog: EC 1.4.1.2 Glutamate dehydrogenase
ggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctgggggtgattgctggcctcaatgtgctgcgtatcatcaatgagccaaccgctgctgctattgcctatggtcttgacaagaaggcaaccagcgtcggtgagaaagatgtcctcatc

SEQ ID NO: 93117 - DNA, 845 bp, Zea mays
  misc_feature: Ceres CLONE 1582219
  misc_feature: Encodes the peptide sequence at SEQ ID NO. 93118
  misc_feature (793)..(793): n is a, c, t, g, unknown, or other
aagctggagctccccgcggtggcggccgctctagaactagtggatcccccgggctgcaggaattcgtctcacccctagaaaaacgcttcaagtccgacgattttctcctttctctctctctctatttttcactctagaccgaaatcggagcgcccgataccataccaatagcagcagagcagtagcagcacagctccctcccccgtcctctccaaatctcgccggattccgtccaccgccaagccctcgcatctgccgcaggttcgcgtctgtgcccgagcgtgttgcactgccggtggtgttggtggtggtttggcggagttgccgccgagggtcggtcatggactacgggccctctgacagcagcggaactgatgatgatcttccacaacttccacataggagtatcagaggcagcggacgtgttagtggtaatgggagaactattgttcctgccggttcatatgctagagcaccaactgacatggaagcacaaattcaacaacttgagcaagaagcatattgttcagtccttcgtgcattcaaagcccagtctgatgccattacatgggagaaggaaggtctcatgactgaacttaggaaggaactaagagtatctgacaaagcacacagggagctgttaaataaagtcaaccacgataatattatatgtagcataagggaaatggagatcaaacaggagggcttcaagcaagcatgtccaataaaccaacaaccgattcatgaccctggtccaaggtcctaccaccctctgggccggaagaagcaaaangacatctcaattctggttcctgcttttaccggcaccttcctgccaaggcatt

SEQ ID NO: 93118 - protein, 168 aa, Zea mays
  misc_feature: Ceres CLONE 1582219
  misc_feature (49)..(122): Pfam Name: ENT Pfam Description: ENT domain
  misc_feature (151)..(151): Xaa is any aa, unknown, or other
MDYGPSDSSGTDDDLPQLPHRSIRGSGRVSGNGRTIVPAGSYARAPTDMEAQIQQLEQEAYCSVLRAFKAQSDAITWEKEGLMTELRKELRVSDKAHRELLNKVNHDNIICSIREMEIKQEGFKQACPINQQPIHDPGPRSYHPLGRKKQXDISILVPAFTGTFLPRH

SEQ ID NO: 93119 - DNA, 1129 bp, Zea mays
  misc_feature: Ceres CLONE 1582221
  misc_feature: Encodes the peptide sequence at SEQ ID NO. 93120
  misc_feature (19)..(19): n is a, c, t, g, unknown, or other
  misc_feature (48)..(48): n is a, c, t, g, unknown, or other
  misc_feature (52)..(52): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (78)..(78): n is a, c, t, g, unknown, or other
tttgttgtttttttttttngggcggggggcgtcggggggggggtttcnttcncttctttggggggnnnnnggcctttntttaaaaactggagctccccgcggtggcggccgctctagaactagtggatcccccgggctgcaggaattcgtctcacccctagaaaaaacgcaagtacacaacacagtacttcagaaacaggacgcgggctcgacgacacaccgatcaggcgcgccgaagcagcgtccgcagccgacggtcatctcccggcgccggtcgcggccatgtcgaagaagaaggcggtcacgacgatgacgctcaaagacttccacggcggctccatcccctccgagctcccgctcccctccgcccccggcgtcaccccgcgccccgcggatcgcaccgtcgcctccgcatcccccgtcgcagccgcggtcgcacggccacgcgtaccggtcgcttcgcctgccgccgctgcggcggcagccgcgatgccttccttcctcacaaacccgttcccgaaatcggccgttcacttcgaacgagggaggagcggcaccccccttcgagcccacccacggccacggccgttccctgcggcccgtcccccaaacggtccattcggcaaccccgccttccccggtgggtgggccgcccccaacccaataattcaatggcccccggggggaaaacctcacatggggggggccccgctaaaaagataagaggtaagggtcccttctcttttctgtgctggcccccttttcccgccccgttggtgggagtggttcaaatggtgctattcactggtggccgttctcccggccgccggggccgaagaaccaaagaaaaatccagggggtgccccgggcggaacaacaaggcctattgtcgccacccacataagacagctaatgcgaccccaatatgtgcgaataaaaaagggttttaaatatattacctggggagaaagaaaattgtgggtcctcccgctcccggcctaaaagtccacctgctcgaatgtgtacgtgcaaccacggaagtgcgccagagatggagttgaaagtctatctcgcggggtggtttatttgaggaaaaaagctcacctccccagggggggctctcgctccc

SEQ ID NO: 93120 - protein, 146 aa, Zea mays
  misc_feature: Ceres CLONE 1582221
MSKKKAVTTMTLKDFHGGSIPSELPLPSAPGVTPRPADRTVASASPVAAAVARPRVPVASPAAAAAAAAMPSFLTNPFPKSAVHFERGRSGTPLRAHPRPRPFPAARPPNGPFGNPAFPGGWAAPNPIIQWPPGGKPHMGGAPLKR

SEQ ID NO: 93121 - DNA, 1142 bp, Zea mays
  misc_feature: Ceres CLONE 1582223
  misc_feature: Encodes the peptide sequence at SEQ ID NO. 93122
  misc_feature (8)..(8): n is a, c, t, g, unknown, or other
  misc_feature (10)..(10): n is a, c, t, g, unknown, or other
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (489)..(489): n is a, c, t, g, unknown, or other
  misc_feature (704)..(704): n is a, c, t, g, unknown, or other
  misc_feature (791)..(791): n is a, c, t, g, unknown, or other
  misc_feature (796)..(796): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (836)..(836): n is a, c, t, g, unknown, or other
  misc_feature (838)..(838): n is a, c, t, g, unknown, or other
  misc_feature (875)..(875): n is a, c, t, g, unknown, or other
  misc_feature (876)..(876): n is a, c, t, g, unknown, or other
  misc_feature (903)..(903): n is a, c, t, g, unknown, or other
  misc_feature (907)..(907): n is a, c, t, g, unknown, or other
  misc_feature (938)..(938): n is a, c, t, g, unknown, or other
  misc_feature (943)..(943): n is a, c, t, g, unknown, or other
  misc_feature (944)..(944): n is a, c, t, g, unknown, or other
  misc_feature (970)..(970): n is a, c, t, g, unknown, or other
  misc_feature (997)..(997): n is a, c, t, g, unknown, or other
  misc_feature (999)..(999): n is a, c, t, g, unknown, or other
  misc_feature (1000)..(1000): n is a, c, t, g, unknown, or other
  misc_feature (1086)..(1086): n is a, c, t, g, unknown, or other
  misc_feature (1114)..(1114): n is a, c, t, g, unknown, or other
  misc_feature (1119)..(1119): n is a, c, t, g, unknown, or other
tttttttncnncnnttccttatcactcgctgggtcgagtatacgagggtaggggggggggnnnngggcgnnnnnnaaggctgggactccccgcggtggcggccgctctagaatagtggatcccccgggctgcaggaattcgtctcacccctagaaaaaacgcaagtacacaacacagtacttcagaaacaggacgcgggctcgacgacacaccgatcaggcgcgccgaagcagcgtccgcagccgacggtcatctcccggcgccggtcgcggccatgtcgaagaagaaggcggtcacgacgatgacgctcaaagacttccacggcggctccatcccctccgagctcccgctcccctccgcccccggggtcaccccgcgccccgcggatcgcaccgtcgcctccgcatcccccgtcgaggccgcggtggggtggtcacgcgttttgggttgcttcgaccggccgcccgctgcggggggtatccttccaancctttcttttcctcacaaacccgaacccgaaatcgagccgggactttcaaacaaagaacgaagcccccacccccattggaggcccacccacgccccgccgcagtatcccgacgccgcgtccccgatagggtccaggttcgcaactcccgcctcacctgatggaaggagtaccctcaacccagacatcagcgggctccccggggggaacaaccaanaggagatgtgccccccgtaaaataacaagggaaggggtatataagtaaatagagggagcggcgcccaatttactcacacagatggtnggggngtgcatgggcgtcacgcggtgacgagcgttagcggnnngngnggagtgtacatcattgtcttctttgtagtggctttgnntgatatagctaccgatgaactaactcncaangacggaacggccgatatgaatgaagcacagngcctnngtcgctcccgagcgagaaaaaagggnggagacgagaacaagatgacaacgaangnngagtggccatgtccgggaagtggcggtacgcaacagattacggcgagtggcggggggagagagcccgcccgcgcggacccgcaacnttagaatatcaagaatgagcagagaggnctacnttcttgataatcatcaatacatt

SEQ ID NO: 93122 - protein, 149 aa, Zea mays
  misc_feature: Ceres CLONE 1582223
  misc_feature (72)..(72): Xaa is any aa, unknown, or other
  misc_feature (144)..(144): Xaa is any aa, unknown, or other
MSKKKAVTTMTLKDFHGGSIPSELPLPSAPGVTPRPADRTVASASPVEAAVGWSRVLGCFDRPPAAGGILPXLSFPHKPEPEIEPGLSNKERSPHPHWRPTHAPPQYPDAASPIGSRFATPASPDGRSTLNPDISGLPGGNNQXEMCPP

SEQ ID NO: 93123 - DNA, 2986 bp, Zea mays
  misc_feature: Ceres CLONE 1582230
  misc_feature: Encodes the peptide sequence at SEQ ID NO. 93124
aaggcgacgacacacacacagagagaggcaagggacggagagggcgaggacgccagccgcagtgggcgcgccacaagcggagcggggggcgcacgcacgcacgcgactctcccgagatccaagacccgcgagatccgcttgccctcgtcgccagccagagcccggagcggatacgtgtccatggcggccggagaggagcaagaagagttctttgactccagggaggtgctgtcgccggcgtccgtctcgtcgtcgccgtcgagttccggtcgccacgacgacggcgggtggctcttcgcccagcagctgctcgaggtctgggtccgggacccgggcagcgtccacgagcgccgccagaggttcgtcaagtccctgggcctcatggatccgagcccccacggcgcgcggcccggcgaggagacgtgctcgaggcctgaggccagagaagaaatcctaccggcaagccccagcaccgagctgttctcggccgtccctacctttgcgagcatgggaggggagccgacagcctccggcggcgacggcgctggcacggaagaggagccggagtgcgtgttcaagaacctggacgatggcacagtgttcgtggtcgacgagatgggaaaggacgggagcttccggagcctcagggagaggctctccaaccggacagtaacagctgcagaattcgagcaggcctttggctcatcacctttcatccgtgagctgatgaggagggtggacgattccgacgaaccctccaccccggagaagactgtgctgaggagaaggaggcggcggcggattgggtggctacgaaggctgggcatcggtgtctgtgttgtcgacgccgacgcagaggaggaagacgatgaggtcaattcgacatcatccacttcttcccggggttgctctaggaaggttgatagggtcaaggtgagaccttacaagaagcggtcaaaggaattatctgcagtgtacaagggccaagtcatcaaggcacatgaaggtgctattgtgaccatgaagttcagctccgatggccagttgctggctactggaggtgaggatggggttgtccgcgtttggcgggtggtggaaggcaagaggcctgatgaccgtcattttgttgacgatgatccttcatgtgtgttcttcactgtcaatgaaaattctgaattggctcccatcaattcctgcgaagggggtaagggcaagcacaataacagctcaaaggtggctactgatccagcttgtgttgtgattcctcaccagacctttgcgctatccgaggaccctgtgcatgaattccgtgggcaccatgatgccatcttggatctttcatggtcaaaaaatagggaattgctttctgcgtccaaggacaaaactgttcgattatggaaagttgggtgcgatagctgcctgaaggttttctcccataataactatgtgacatgtgtacagtttaaacctaccaatgacaattatttcatcagtggttgtattgacgggatggtacgtatttgggatgttcctagatgcctagttgtggactgggctgacagcaaagagataattacagcagtttgttaccgtcctgatggaaagggtgcagtggttgggacaataacaggaaactgccattgctatgaagcatcagaaaaccatctagcactggagtcacaagtccccctgtatggcagaaagaaatctccacttaaaagaatagttggattccagtattgcccatctgatccaaagaaactgatggtgacatctggtgactcacaagttcgcattctcgatggggctcatgtcgtttccagctacaaaggattacgaagtccaagtcaagtccctgcagcatttacaccagatggagatcacattattgctgctagcgatgactctagtatctatatgtggaattatgcaaaccaacttgccccagtcacgagccgtgtgaaagccgtatggtcatatgagcacttcttctgcaatgacgtgtccgttgcaataccatggaacgccttgcctgcaaggagttctatttctcttgcttgcaacatccccctttcacggcaagaggtctctgaggagctccacaactcgcaagagtctgtgtcatgctgcagtgctgaaggctcacctaaagctgatagctcgtgccggctgccatccggcaatttcactcttagcaatgcattctccgcggagttggcaccaagggggaaagcaacatggccagaagagcagctgccatcatctgattcagtgacaccgtcgtcgtcgtctgctttgcgtaaatctcagtataagttcctgaagacttcttgccagagtgccgccacgcatgcctggggccaggtcatagtcactgcaggttgggatggaaacatcaggtcgttccagaactatggtttacctatgcaagtgtgacacatggtacaagacatgcatctctttgctaattgcttggtcagtggggtatcccaggaatggcagacgagaagtcgcttgcggaacttttacgcctccaggaacttggtttgctgaagggcgacgccccgtccagattatggttacagtacaaagagtttacatgggtgtgtggctgtgctgtgttgctcgtggaccagaagttgtatgtagtccagtggtcctgcgagatctcggcggcacattgcgagagaagggccggggaagatggatcccctcgcagacccaactaactttgcgcgaagagtggttgtatggctgcaatttcattgcattgctgtttgctgcttttctttgttttggcctccctttggggggatctgcagtaaatatatatagagtggatggatgaacatattttgtttgctcgattgagttcccctcgccctgatgcaaggcgagcgggggaggtagttgagatcactgttggatagggatgcacatactggattcatttcatttttcatcacatcaaaaaaaaaaaaaaaaa

SEQ ID NO: 93124 - protein, 751 aa, Zea mays
  misc_feature: Ceres CLONE 1582230
  misc_feature (411)..(449): Pfam Name: WD40 Pfam Description: WD domain, G-beta repeat
  misc_feature (370)..(407): Pfam Name: WD40 Pfam Description: WD domain, G-beta repeat
  misc_feature (265)..(303): Pfam Name: WD40 Pfam Description: WD domain, G-beta repeat
  misc_feature: SWISSPROT Homolog: EC 2.3.1.48 Histone acetyltransferase
MAAGEEQEEFFDSREVLSPASVSSSPSSSGRHDDGGWLFAQQLLEVWVRDPGSVHERRQRFVKSLGLMDPSPHGARPGEETCSRPEAREEILPASPSTELFSAVPTFASMGGEPTASGGDGAGTEEEPECVFKNLDDGTVFVVDEMGKDGSFRSLRERLSNRTVTAAEFEQAFGSSPFIRELMRRVDDSDEPSTPEKTVLRRRRRRRIGWLRRLGIGVCVVDADAEEEDDEVNSTSSTSSRGCSRKVDRVKVRPYKKRSKELSAVYKGQVIKAHEGAIVTMKFSSDGQLLATGGEDGVVRVWRVVEGKRPDDRHFVDDDPSCVFFTVNENSELAPINSCEGGKGKHNNSSKVATDPACVVIPHQTFALSEDPVHEFRGHHDAILDLSWSKNRELLSASKDKTVRLWKVGCDSCLKVFSHNNYVTCVQFKPTNDNYFISGCIDGMVRIWDVPRCLVVDWADSKEIITAVCYRPDGKGAVVGTITGNCHCYEASENHLALESQVPLYGRKKSPLKRIVGFQYCPSDPKKLMVTSGDSQVRILDGAHVVSSYKGLRSPSQVPAAFTPDGDHIIAASDDSSIYMWNYANQLAPVTSRVKAVWSYEHFFCNDVSVAIPWNALPARSSISLACNIPLSRQEVSEELHNSQESVSCCSAEGSPKADSSCRLPSGNFTLSNAFSAELAPRGKATWPEEQLPSSDSVTPSSSSALRKSQYKFLKTSCQSAATHAWGQVIVTAGWDGNIRSFQNYGLPMQV

SEQ ID NO: 93125 - DNA, 1136 bp, Zea mays
  misc_feature: Ceres CLONE 1582231
  misc_feature: Translation starting site: 301
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
gtttatttggggccgcggtctctactctacaggttaaaggaggggtgggagtttgaagttaacccgnnnnnnnntttaaaactggaactcaccgcggtggcggccgctctagaactagtggatcccccgggctgcaggaattcgtctcacccctagaaaaaaccgcatcgaccggacgggctctctctcgtctctcccgacgcgcctccactgccggacccgccccgggtcgctagcctcctcccactcccagtaccagcccccgcccctccagcaccaccagcagctcgccttctgaccatgagacgggtcggaggagacctgcaaggcgacggcacgacacctcggtccgcggcggcggggcaggccatgatggagcttcaggccaacgggtcggccgccgtcgggggcgccatggtggtggggctcagcccgctcagcgagggcctgtggcgggacagctagtcgctcccgccaggggcccggccccgccgcgctcttcgggggacctgtccgcccggtctcaccttggaatggacctcttgcgtcaccgtgagtctcgggggtccccggacaaaaacgcataaccggggctgcgacgaaacctcccccggggtaacccccggaagccccgggggccggttgaaccggcggcctcagtgggggggccccttccggggggttccggggctaaggtccccaacccccgtggtttgggaaggacccccttccttccggggccctggccctgcggacctgttccaaaaggggccctttttccctactttcccggggggcaaaggaggggggcttcccttcccaaaagtggtgccccgccaaaaggggcccacaaaaccctccttccccctttcccggggggccccgcaagagtcgtttaaacgggggaacccccccgggcgatcgggaactaactcgtggtattcccgggggaagcgcctttaacacaggggggcgcgctaaaataaccaattccgggggtttaccttcccgggggcggctagacctacccgagttttggccccgagaacaaaaaaacgccccccgctgggtaagagaacaaaggggggcgccccctttggtgtggaaaggggggccaccatttcggtgggaaaaga

SEQ ID NO: 93126 - DNA, 1216 bp, Zea mays
  misc_feature: Ceres CLONE 1582232
  misc_feature: Encodes the peptide sequence at SEQ ID NO. 93127
  misc_feature (769)..(769): n is a, c, t, g, unknown, or other
  misc_feature (953)..(953): n is a, c, t, g, unknown, or other
  misc_feature (1146)..(1146): n is a, c, t, g, unknown, or other
tattatttttatttttctaccatattcccactatctatattttgttttgtcttgggagaactttttacttaaataaataaatgggactccccgcggtggcggccgctctagaatagtggatcccccgggctgcaggaattcgtctcacccctagaaaaatcgccagggcgtcggatcggagcgagctcattctcaactcgactcaagagctctgcctcctccatctccccttctctggcctccggagccacgctgagagatggaggcgaatcccaagaacaccttcacgatcaaagtggaggacgggaagcccgggaaggacggcctggctggcggtcggaccggtgttccggagcgttctggccaaggatgggttcccgcagcttgagcctgacatgaagacatcatgggacgtgttcaggggtagcagcaagtcaaagtaatgccccgaacaaccccggaatgcctcgggatgggcgtcccgttccaaaaaatgggaagtggcccagggggcccccttactttttgggggggaaaaaaatcctttcttccaccgggggggggagttcttttttcctatacacaaaaaagggagcgtatccttataaaaaaaaagggtttttttttctttttttttaaaaaaaaaagacgggggggggaggagagaccccccaaaggctctctcctcctcgggggtggggtgggggggttttcttctctaaaaggggagagagaaaaaaaagacgacctcctcccccccccccttctnggtgagaaaaaggagtgggagaggatgaagattatcacccacgcattcgggtggcttgtcctctttggggcaccggcttactcttatctattacactcactttctcattttccacctggtgtctggcctccgcccccctctcaccatggttctagaaacaaaaaaaataatttttcataatttngggcgggggggggagcggcgtaatgtttggggcctgttcatgtcatcccatggagagcacagttctgccctatagttccacaatacgacagagagagacacagaggaaccggggttggtattgtgtcctctctccattcgggggcgccgccgacggccgttgtgtcggctaagagatagtggaactggtggtngtgttgtgtctgcagcgttctgccctagagcgacaaagcgacagagagtcccgacctcagataataaggg

SEQ ID NO: 93127 - protein, 42 aa, Zea mays
  misc_feature: Ceres CLONE 1582232
MEANPKNTFTIKVEDGKPGKDGLAGGRTGVPERSGQGWVPAA

SEQ ID NO: 93128 - DNA, 874 bp, Zea mays
  misc_feature: Ceres CLONE 1582234
ctggagctccccgcggtggcggccgctctagaactagtggatcccccgggctgcaggaattcgtctcacccctagaaaaagaagtctgaaaccaccgcccagcgctcgcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatcgccatcggcctcgccgtgcggttcctcgcgccgcggcccgtcgaggttagcccgcaggcgtggcagctcctctccatcttcctctccacaatcgcggggctggtgcttggccctctccctgtcggcgcatgggccttcctcgggctcacagccgccgtcgccactcgcacgctccccttcaccgccgccttctccgcctttcacaacgaggtcatctggctcatcgtcatttccttcttcttcgcgcgcggggttcgtcaagacgggcctcggggaccgaatcggcaccctacttcgtcaagtgggctcggggagcagcacgcctagggcttttcctaacggccttacccctcaacgaagggcctgcaattcgggcccgggccatggcccaagcaaccaccggctaaggggccccggaaggccgggtttccctaacccaaattaatctaagttcgccctcctcgc

SEQ ID NO: 93129 - DNA, 1333 bp, Zea mays
  misc_feature: Ceres CLONE 1582239
  misc_feature: Encodes the peptide sequence at SEQ ID NO. 93130
  misc_feature (768)..(768): n is a, c, t, g, unknown, or other
  misc_feature (906)..(906): n is a, c, t, g, unknown, or other
  misc_feature (1031)..(1031): n is a, c, t, g, unknown, or other
tggataggaaataaaagaaagagaaggtgaaaaacggaaaaaaaaaaaactcattaaattgccccacccgcaaaaactggggctccccgcggtggcggccgctctagaactagtggatcccccgggctgcaggaattcgtctcacccctagaaaaaaaaaaagtttaatttctcctcgcgttacagctgcagcgctcgacgacggggagaatagcgtggcgtgggcggcgccatgaagtacagcaaggaagataagcccgagagggcgggcggcgccggcgcagggtccagggcggtgccggtggcgctcgacgacgtcatgctcagcgccttcaccttctacctgggcggcatctacagcacgggacggagccctgctggactccatccagacggcgccgacagctctcctcgacctcagcgccgatacgacgacccgccgtccctccgaacgacggccaggctccggacggcactgggcgtccacgggccgccgtgggcgatttccccgaggtgtccccgcactaaaaaccaaagacttacaaccccccctggcacacgactccccaaaaccgccctgggcgggaagggcacaggtaaaacattaaccggccctcgaaatattttaaatgggaagagcggggacaccactgaaccacctgtcctagcacgggcccccggagaccgggggaaaaacacggtcggacacctatggggatggacgtgaacccggcatctcccaaagagggggggatactatcacaaagncgctctgaggacaccacacataatatcgggagagaggtgggcgcactctcaccaaaatatatataaaacaataagaacggggaaaacccaacagatatgatggaggctggctgggggggataaacaccaccccccggnagcataaaaaacacctgagggatttccaccccacctaactaaataaccaagagaaaaatctcggcggggggaatattttcaaagaaatgaacacgaggagacttctgactgaaggaaaaaagtanttttaacctctaaagaatcacccgccgggcgatatatcatctcggatgggagcttccctctctcctctctaaaaaatagacagagaggtggtggtctacatataacaacgagggcctgatactccctgggagtgggtattttacccatcgcgcgaggcgaggtgatagtgggtacacccccgccgaggagagcttttcccccgcgccggaaaagacggggggttatgaggagaggacctcactcgcatttaaccaagagcggtgcacactctctgagaaaagactgcaagagagcgacactg

SEQ ID NO: 93130 - protein, 164 aa, Zea mays
  misc_feature: Ceres CLONE 1582239
MKYSKEDKPERAGGAGAGSRAVPVALDDVMLSAFTFYLGGIYSTGRSPAGLHPDGADSSPRPQRRYDDPPSLRTTARLRTALGVHGPPWAISPRCPRTKNQRLTTPPGTRLPKTALGGKGTGKTLTGPRNILNGKSGDTTEPPVLARAPGDRGKNTVGHLWGWT

SEQ ID NO: 93131 - DNA, 871 bp, Zea mays
  misc_feature: Ceres CLONE 1582240
  misc_feature: Encodes the peptide sequence at SEQ ID NO. 93132
  misc_feature (687)..(687): n is a, c, t, g, unknown, or other
  misc_feature (794)..(794): n is a, c, t, g, unknown, or other
ctccccgcggtggcggccgctctagaactagtggatcccccgggctgcaggaattcgtctcacccctagaaaaaccagatctcggcgcgagttcagcctgcagattgactctacaatacatcggcgaggaagaagagctgcggttcggaagagtaaactctacccgccgtctcgcgccggttgaccggcgcgtaggcgagatccgggcggagatccagggcgcggcgccggccatggcgagctccggactcgcctaccccgaccgcttctacgccgccgcggcctacgctgggttcggagtcggcgaggccacctcctccgcagctatctcccgcttccagaacgacgtcgccctcctcctctacggcttgcatcagcaggccactgttgggccatgcaatgtgcccaagcctagagcgtggaaccccgtggagcagagcatatggacgagctggcatgggcttggaagcatgccttctgcggaggcgatgcgtgcttttgtcaaaatcttagaggaagaagatcctggatggtactctagggcccctgagttcaagcctgaggctgttgtacatggtcagatgcattaaacagagacgagccacatagtgtaccgggttcaagaaatggaagctcaactccagaaccaaacagttctgaatattggaagttctgtgggatgctcangatcaaagacgtttattctgggaaggccttagcactgggtagttgctcatgaagcgtggcacctccctttacctgatcagatggtccttccctccggaagccctcgnttatgagccatggtagcaactgtggctgcccaaacaaagaagggatagtattgcggtggggaaaccatgtacgggaa

SEQ ID NO: 93132 - protein, 118 aa, Zea mays
  misc_feature: Ceres CLONE 1582240
  misc_feature (8)..(97): Pfam Name: ACBP Pfam Description: Acyl CoA binding protein
  misc_feature: SWISSPROT Homolog: EC 5.3.3.8 Dodecenoyl-CoA isomerase
MASSGLAYPDRFYAAAAYAGFGVGEATSSAAISRFQNDVALLLYGLHQQATVGPCNVPKPRAWNPVEQSIWTSWHGLGSMPSAEAMRAFVKILEEEDPGWYSRAPEFKPEAVVHGQMH

SEQ ID NO: 93133 - DNA, 866 bp, Zea mays
  misc_feature: Ceres CLONE 1582246
  misc_feature (509)..(509): n is a, c, t, g, unknown, or other
gcggtggcggccgctctagaactagtggatcccccgggctgcaggaattcgtctcacccctagaaaaaagccagcgccgcttcatccttcgaaccccacgctaccgctcgtttatacggcagcgacgcctcccccgctcgcctcctctctcctcctcaaggctcaagcgaaggcgagcgcgatagaaagctcaagccacttcccaacccgctccccccctcgccgcgatttcctcacatggcagcgctgcgcctccgcgagtcactcgagaggaacagcccctgctcctgcttctccgacccctgtccctgcgccgccaacacgcgccgcccccgtcccgatctcgccgcccccgccgccgggcccttctcgtccctccgcgtccatcgcccctgctcctgatccggctctcttcttcctcccttctcgcgccgtagattgcagccgcggctctgattctgctccccgccgtttgtctcgcggtcgcgggttcctgggagcttctgggntctggctccgtcccctaacggtgttgccatggggaagagcaagaagagcaaggcccgcggcggcggggaacacctgatcgacagcagcgacgcccacagcgttcggctcgtcgttcacccgcgctgtccggatctctccatctcctaagcccaccaagacacgtcacttcgccaggagtttcttcctccaaaaagttaaattcgaccccgcttctagaagaaaaaaggggaatcttacaagaagagggccggcatttggggtaaaaacctccgtggaaagccctcccaaaaagatttttaaggctccccaaaggggccttggtggggaagaaaaagggtataggcctcatcttttcg

SEQ ID NO: 93134 - DNA, 826 bp, Zea mays
  misc_feature: Ceres CLONE 1582253
  misc_feature: Translation starting site: 231
  misc_feature (691)..(691): n is a, c, t, g, unknown, or other
  misc_feature (696)..(696): n is a, c, t, g, unknown, or other
ctccccgcggtggcggccgctctagaactagtggatcccccgggctgcaggaattcgtctcacccctagaaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaccatccccaactccagtttgaggctgcatgggcactcaccaacattgcatcaggcacatcagagacactaangtggntgtttgaagagtggtgctgtgcccatctttgtcaagctactcaactccttcagcgaagatgttcgtgaaacagctgtatgggctttaggtaatgttgctggtgactccccaaagtgccgtgatctggtaa

SEQ ID NO: 93135 - DNA, 1095 bp, Zea mays
  misc_feature: Ceres CLONE 1582254
  misc_feature: Encodes the peptide sequence at SEQ ID NO. 93136
  misc_feature (8)..(8): n is a, c, t, g, unknown, or other
  misc_feature (9)..(9): n is a, c, t, g, unknown, or other
  misc_feature (19)..(19): n is a, c, t, g, unknown, or other
  misc_feature (34)..(34): n is a, c, t, g, unknown, or other
  misc_feature (72)..(72): n is a, c, t, g, unknown, or other
tttttttnntttttaattntttgttcacctttantcctaccttcttttcttcctcgtactacgggcgcatanaaattacacactggaactccccccggtggcggccgctctagactagtggatcccccgggctgcaggaattcgtctcacccctagaaaaggccctcctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgacccctgtattgagaaaaagaaagcctcctttcaggttgaaattggggaccttggaatttctttggaaaacattttttgaccgagtattccaagccgagcctcctaaaaaaacccatccccttattttaagttccagggaagaattgttggtaattattttcccctccggggggtgtgtttttacaagattatccctaggcaccccttttgagaaacacaaagaaaatgggctaaatcttgggtggggcggaaaaaatttttgtcatgtccccatatggcataaagcgcctatgggtctggtctttgcggaagaaattgtttccacttctcaccaggggttggggagagaattctctatattaccgccctaactctgggttctttttggaagaaaaacaaacaatttggaacggccaacaccaacccattgttttggcagtctgttccccccccggggcgtttcctaaggtggcggagaaaaaactaaaggtttaaacattgggaagccaaatctggggcacggataaccaaccctgccacgggacacaccgggggcttagaagatttggaacattctcggtggccaaata

SEQ ID NO: 93136 - protein, 103 aa, Zea mays
  misc_feature: Ceres CLONE 1582254
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MAYGDRVTTFEDSEKESEYGYVRKVSGPVVVADGMGGAAMYELVRVGHDNLIGEIIRLEGDSATIQVYEETAGLMVNDPCIEKKKASFQVEIGDLGISLENIF

SEQ ID NO: 93137 - DNA, 1122 bp, Zea mays
  misc_feature: Ceres CLONE 1582256
  misc_feature (12)..(12): n is a, c, t, g, unknown, or other
  misc_feature (39)..(39): n is a, c, t, g, unknown, or other
  misc_feature (62)..(62): n is a, c, t, g, unknown, or other
  misc_feature (72)..(72): n is a, c, t, g, unknown, or other
  misc_feature (78)..(78): n is a, c, t, g, unknown, or other
tttttttttttnttttttttggtggggtggggggtgttntctttttttttgtgggtggtggnaaacaaaaanaggaanggtgggagctcaccgcggtggcggccgctctagaactagtggatcccccgggctgcaggaattcgtctcacccctagaaaaatcaggcccacgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaaaggaatctaaggggggcaagaaatcttagcagtagtcgttccaggatgtatgaaacccccccttggctaccgcaattgaggaacgttccaccttccccggaggggccgaaaaaatttcccaggctggcgggcttaacctccaaacgcggccaaaaaaaacccatccctgaaaattcccctttttggggatttcccccgggtccaaaataaaggtttcaaagaaaatttccttttttttgaaaaacccttgtaaagatttcttataaacccaaaatccctcccctcgggggcccggtggtgggctttttgccccggggaaaacaaactcggacccacaaggtgtgcccccacaaatttgttttggggcttcccccctgtgagaaagacccccctcccccccgcgcccccaaaatttttccaaaggatggttgtgtgtttcttgaaaaaacacacgccggggaaaccacaaaggaggggggtgtcttctttctccgccccagaagggtggggggacccccccgcgggccaacaaaaaaatataatggggtgtttttaaggggcgtttataaaaaacagcgcccctgggagaaacaacaatttcctctcaaggagccaccggcttttttttgtggccccccccctgtgtgggaaggggttttggctgccccccccccgcggagccccaaaatataaattctgttt

SEQ ID NO: 93138 - DNA, 1067 bp, Zea mays
  misc_feature: Ceres CLONE 1582257
  misc_feature: Encodes the peptide sequence at SEQ ID NO. 93139
  misc_feature (13)..(13): n is a, c, t, g, unknown, or other
  misc_feature (21)..(21): n is a, c, t, g, unknown, or other
ttccttttttttntttttttnttttttttttcgtgcgttcctgtgtttttttgtgtttttttttttcttctctattatttagcggccgagttaataatatgacaaactggagctccccacggtggcggccgctctagaatagtggatcccccgggctgcaggaattcgtctcacccctagaaaaaccccactcgccgtctccgctcgcctcccaaaccctaccaacaccacccgcctcatcttcgccggcctacctgcctcctccccggtccgcgccttctgccccagggcgcgcccctccccctccacttgcgccgccttctcctccaccatggccgcctccgacaaccccctcctcgtcgccgacttcgacttcccgcccttcgaccgcgtcgagcccagccacgtccgccccggcatccacgaactgctaacacgactcgagggcgagcttgaagagctcgagaagggcatcgagcccacgtgggcgaagctggtcgagccgctagaacgcatcaccgacaggctcgaggtgatctggggcatggtcgatcacctcaagtccgtcaaggactccgctgatctccgcgccggcgttaaaggaagtgcagcccgtaaaaagtcagtttcccaactaaggctaagaaaagaggcaagccctatctaatgaaagctttcaaaggcccattcagggaaactctttctaattttggggaccaagtcctccagccgaatggcttcggccaaagcgttaattagtttggaaaggcttcaaaaataaaaagggaaaggcttggtttcctccaaggtgggaaagttgtgcaccctttggagggaatgaaaaccaaagggggaaagaaaaatttttaaacccaaatttcgaaacaaaaaaaacctgggaaaaaaaacgggaccccacaaaagtttttgagtggaaaaaaggttggcctgggaaggcccaacaaaggaaaatttccgaagaaagtttaaattttcccggaataaaaaaaaaaaaatttgagggggttttaacccggcttaaaagcccctttggggtttaaccaacg

SEQ ID NO: 93139 - protein, 111 aa, Zea mays
  misc_feature: Ceres CLONE 1582257
  misc_feature: SWISSPROT Homolog: EC 3.4.24.70 Oligopeptidase A
MAASDNPLLVADFDFPPFDRVEPSHVRPGIHELLTRLEGELEELEKGIEPTWAKLVEPLERITDRLEVIWGMVDHLKSVKDSADLRAGVKGSAARKKSVSQLRLRKEASPI

SEQ ID NO: 93140 - DNA, 893 bp, Zea mays
  misc_feature: Ceres CLONE 1582258
  misc_feature: Encodes the peptide sequence at SEQ ID NO. 93141
  misc_feature (402)..(402): n is a, c, t, g, unknown, or other
aaagctggagctccccgcggtggcggccgctctagaactagtggatcccccgggctgcaggaattcgtctcacccctagaaaaaacctgccccggtttttctcctcccgcccccgttccccgtcccgactcccgaccgacccaacccatatcagagattccttccttggtggcgctggcgttcccgtgaggcggcccgcgcgcgaaggcggccgtgaccgaccgtccggagcttcatgcgccaggggcggcggctccaccccgtcgtttgatgggcaacgcatgcggcggcgcccttagatccaagtaccagcacagcttcaagcacgccgcgtcgtcgcagcgccacgcctcctccgagtacagcgccagcgccgtggccgacgactcgcccaggaagccnccacaggcgcccgccaccacggacgcccacgcgccgccgcccgccaccgccaccgccaccgccgccatgaggcgcggcggggccggcgcgccgccggacctggggtccgtgctcggccaccccacccccaacctccgcgacctctacgcgctcggcaggaagctcgggcaggggcagttcggcaccaccttcctctgcaccgagctcgccacgggggtcgactacgcctgcaagtccatcttcaagcgcaagctcatcaccaggggaggacgtcgacgacgtgcgccgcgagaatccagatcatgcaaccacttcttcgggccacacaacgttgtcgccatcaaggggggccctcgaggaacaggctcttcgttcaacattgtcatgggagctcttgcccccgggggggagcttcttcaacgggataataaaaggggggccctaaagcgagaccccaggcccgccaagcttcccagggaattatggtcgga

SEQ ID NO: 93141 - protein, 207 aa, Zea mays
  misc_feature: Ceres CLONE 1582258
  misc_feature: SWISSPROT Homolog: EC 2.7.11.1 Non-specific serine/threonine protein kinase
MGNACGGALRSKYQHSFKHAASSQRHASSEYSASAVADDSPRKPPQAPATTDAHAPPPATATATAAMRRGGAGAPPDLGSVLGHPTPNLRDLYALGRKLGQGQFGTTFLCTELATGVDYACKSIFKRKLITRGGRRRRAPRESRSCNHFFGPHNVVAIKGGPRGTGSSFNIVMGALAPGGELLQRDNKRGALKRDPRPAKLPRELWS

SEQ ID NO: 93142 - DNA, 834 bp, Zea mays
  misc_feature: Ceres CLONE 1582260
  misc_feature (646)..(646): n is a, c, t, g, unknown, or other
  misc_feature (653)..(653): n is a, c, t, g, unknown, or other
agctccccgcggtggcggccgctctagaactagtggatcccccgggctgcaggaattcgtctcacccctagaaaaacgttcaaggagtgcttgcgcccgctgttggacgcggtcgtcgcggcgcccaacgcaacaggctggccctcgtcggccatagccatggtggggttcccgtgcaaggtcaccgccgccactgtgtttgtggacgccgcgttgccgtgggtcggcaagcacataggcatctccactatgggggcaagaggctctagcggatgctggacaccgacgccatcctcttccctaccattaacatcaactactctgtcaccaagagcaaggtgaagagaatgttatttattcctcctaggacaccccaccaattccgataatttatgctgcaaagcttgtgggtctacccctaaccatcgattctagcctggctgctcgctcgacacctgccctacagtttgcttctaggaagcttagggtctcctgatgtgctcatacatggggcagcaagaacatggggtgtctgatggcttgtacacttacaggcatcacatgagggtggagctgatatccataccatctttatgaagaagagcaaatttaggattctgatgtcatgttctcgaaggttgctgcnattgcgntgggtggaatgggcggtttgatgggcaatcctcgactgagttaatcttgatcacaggattcaaggatattttatagatcacgaaggcaacactctatatgggagcaagacttagagcaatgctctgtgaccagggccattgtgcctagcaatattatcagaaataaatcccacatacagaa

SEQ ID NO: 93143 - DNA, 1135 bp, Zea mays
  misc_feature: Ceres CLONE 1582262
  misc_feature: Encodes the peptide sequence at SEQ ID NO. 93144
  misc_feature (51)..(51): n is a, c, t, g, unknown, or other
  misc_feature (58)..(58): n is a, c, t, g, unknown, or other
tttgtggaagtttgtgttttttgtgtgtctttgttttccctctcccccctntttaaanatctgtatctttttattaaaaaaagtgagtgagactccccgcggtggcggccgctctagaatagtggatcccccgggctgcaggaattcgtctcacccctagaaaaaatgcacggagtgcttgcgctctttgttgccatgcttgctctgcgttcctccattcctctcgattgtccttctcagcaatacgcgtcgcgcggctcccgaacgaagggaaaaacatcgctgggtgtgaacgaggacgcgtgccgcagcgtcggcgagggtgtcgcgctctacgatatgcatggtgacgcctctgctcgacgatctgaaccaattccctctggtttactactactgaaatgaccgactgtgtctcgaccacccaggtcgaagagaatgttattcatgaaaaactcagatggcccggcaattccccatcattctgtggtgctcaaggtagtgggttctagcccccttgccaaacttttcgagcctgggagggatggaaaatcaaaatctgcttccaaacaggtttactttcctacggaaggcttggagggacccttccttgagggaggaccccccccgctttgggggtgagacctagcaaacaaaggggggggggaggctttaaaaggccttttgtttccccccattgggcttggtccccctcttcgatttttcaccgcgttagaggaatttcctccgaatttgtttcccaaaagaaacctatttctattatggaaaccccatgagataagccacgccctttattttctttaggggagtattctctttgtgaaaaaactctcccggttttctctctctacaaaaaggggtttggctcctagccccaaaattggcctttccctcgcgcggggggtaaaacccgcgccccaatttttgtgattgggaggcgaaaaattcccctcaaaaatttgggaagtcttttggggcccattggtcctcacacccagttttttttcctcgggggaatttttttttaaacttttcaatacacgcggaactgtcaaaagggacccctttttttgttgttgggggaaattcacaggtgactttctctaggaaaaat

SEQ ID NO: 93144 - protein, 79 aa, Zea mays
  misc_feature: Ceres CLONE 1582262
MHGVLALFVAMLALRSSIPLDCPSQQYASRGSRTKGKTSLGVNEDACRSVGEGVALYDMHGDASARRSEPIPSGLLLLK

SEQ ID NO: 93145 - DNA, 1212 bp, Zea mays
  misc_feature: Ceres CLONE 1582266
aatattaaagtatataattaatccttatagaacagaccctccttcccccctccaaaacacaataaataaatattaaaactgggactcaccgcggtggcggccgctctagaactagtggatcccccgggctgcaggaattcgtctcacccctagaaaaagaaaggtgtatgaccctgatagtcatgatccaacatatacttcacaatacaaggcaaggaattcctattcaaataaccggtattatttcttaaggaagagaacagttgtacctacaacgtacacagatcctcaacagcatgtgaaagttcagacatttggtgccaggtttggtcgcaagatttacaaggctgtgacctatcgggttaagccagcgactgcaacaacagaggtgctagatacttttaagagtacagagcagatgagtggtaaagcagaatcacacgtagcaaactcacaagcacacaatcctacctcaacagatcacaaaggaagtgagtcacatggaaacttttatttgcaaggtagtggaaaaatgctccctcatacaaaagaagttggcacttaacaccgggcctgggaaacaaattgcccaagaacttccaaaaaacccggaaaccctttgaaagaaccgaattttacccccccagaaaacccaaacccattctccctttgggggtccaaaatttatatttgccacccaaggaaaacaatgtaaaaaagaaattttcctcttttcggggttggaatattctccaccctccccacaagaggtggggaaaaaaaacaaggggggaaacccctctgttgttccctctctttcggcaaaaagtatatacccccacatataaaaattttccctaaaaaaagaaaataagagaaagacccccatcttgggtgtggccttttttggagaaaaaaaaacctctccccctcaaaaaatttttgttataaagagaaaacaccaaatattttctctttcctcacaaagaggggggaaaaaactctgaaaaaaatattgagagaaaaaactttggtgtcaccaaagaaaacaggggggacacacaaaaaatttttgcccacaaaaaccccaaaagggctctaaagaaaaaactcttggaaataatggaaaaatacagaaccccttgtaaatatatacaaaaaaaaaaatccctcaaatggttttaataaaaaccacactgtctacaaaatatt

SEQ ID NO: 93146 - DNA, 1286 bp, Zea mays
  misc_feature: Ceres CLONE 1582268
  misc_feature (39)..(39): n is a, c, t, g, unknown, or other
  misc_feature (48)..(48): n is a, c, t, g, unknown, or other
  misc_feature (58)..(58): n is a, c, t, g, unknown, or other
  misc_feature (60)..(60): n is a, c, t, g, unknown, or other
  misc_feature (771)..(771): n is a, c, t, g, unknown, or other
  misc_feature (865)..(865): n is a, c, t, g, unknown, or other
  misc_feature (1203)..(1203): n is a, c, t, g, unknown, or other
ttacgctatatatccttcctacacgttatcttcaacaanaaaaacggnagagagttantnttatccctatttatgaaagctggagctccccgcggtggcggccgctctagactagtggatcccccgggctgcaggaattcgtctcacccctagaaaaaacccgttgtcgccttccctcgcctcccgcacgccagtccctgctgccctgccctcttccgccgcgtcgtcccctcctacgttcccctctccctcggtccgcctagatctcgccagggtttgccgcgtctcgtcttgatttttgctccggaaccagggctccatcggggcagagaggcaggaggggtaggccatcccggaaagtggcggatctgggtgttatcggaggaagagcatcgtgtagcgtttctgtcggtggcaggcatcgacgaggtgtgatttagaaggcatttgtgagtacgggatggactggtgtcggaaccccccccaacagcctccggaacccgatgaatggattttccacaattcttttcagaaacctcccaaaggcatgaaaagggaagggggaaccccttcacctgggtaataggaaaaaaaaaaaacgggttgagtgcgtttcctacttgtttaaaacttaagaggttttcaatcctttcctaagaacagaatagggtggaaaaacaccccaaaactgaccttctggccccctttggagatcccacgaaggaggcacgtcattttgtggtctcacacagttcccttcttctctagagngcttccctatctacaaccgaggggggtcagccacacaaatacctcccgaacacgagtgccgtccacttaatcccacccgcctggtgtggggcgnaatacatagataccctaacgacgtgcccccctctctctatgttttacccgcagtgaggggcgctctattttcccgcgatatagatgagagacgccacccccctcaaaaggatttgtatcgctatccaccctccagccttggaaaagtacacatcctgccaggggagaagattgtttgttctgtctacacttcaaataaccaagcgtcttaataacatgtgcgctgcaggtaacaagtcatatatatacatagatccactaccacataacaatatatattacacgcatacacacaccgagtgcaaaaatagaactccccacccccccctgggtgtgggntgtgagacactttctgtctgtaactatatgtttatctacttgtgtaaaacagataacctcactggcgactgtgtcatctaccc

SEQ ID NO: 93147 - DNA, 814 bp, Zea mays
  misc_feature: Ceres CLONE 1582272
  misc_feature: Encodes the peptide sequence at SEQ ID NO. 93148
  misc_feature (545)..(545): n is a, c, t, g, unknown, or other
ccccgcggtggcggccgctctagaactagtggatcccccgggctgcaggaattcgtctcacccctagaaaaaaagcccacccagagctctgtagaagagaggggagaggaaggaccgaggaccaaccggagccccactcggccgccgcctctcacctccaccgactgcctgcgtcccaccgctcctgctgccgcccgttgctctcgtcattgaagccctcaccgcctccgcccgcttgcccgccctcccgtcggctgccttccggatgagaagcggcgcaacctgggcggtggaagcgtggtcggcctgagccttcgtgggggttagcgccgagaaggatcctggagattaagcgcatgggttccttggatgcccggtacaggccggccggggcagctgaggacacagctaagagaaggacccagaaaagcaaaagtttcaaagaggttgagaaatttgatgtttttgtgctggagaaaagttctggttgcaaattccggtcgttgcaacttttgctcttcgctatcatgtctgctgcgtttctnacactcctatacacaccatctgtgtatgaacatcagttgcagtcaagctctcggcttgtcaatgggtggattatggaataagaagaagttctgattcccgatatgtatcttctgccagcattcaaaggggaggaggtatataaaagtatccaaaatctgaatgttgggtgaacaaaagctcagtgttggactcttgaaatttaacaggactgaatttggtggcttgaacccttagcctcccagaaagtgattttccagccataagggca

SEQ ID NO: 93148 - protein, 89 aa, Zea mays
  misc_feature: Ceres CLONE 1582272
MGSLDARYRPAGAAEDTAKRRTQKSKSFKEVEKFDVFVLEKSSGCKFRSLQLLLFAIMSAAFLTLLYTPSVYEHQLQSSSRLVNGWIME

SEQ ID NO: 93149 - DNA, 819 bp, Zea mays
  misc_feature: Ceres CLONE 1582278
  misc_feature: Encodes the peptide sequence at SEQ ID NO. 93150
ccgcggtggcggccgctctagaactagtggatcccccgggctgcaggaattcgtctcacccctagaaaaaaagcgtagtggaggaagagagggaagaagacgaagcgaagccaaagcaaggtctgagccgtagagcggtagaggtaggtgtccgggtgggaaacctctctcgcgcgtcaggcgtcacgtgagaactcccgatccaccgggacgacggattcccgccgctcccccgcgcgcggcttcttccggtgcggtccggcagccgacggcggaagctactggcccaagcaaagtgagtgaattgcgagtccaggcggcgatggcggggcgctgcgattgacgtgcgacgactatgggcatccaagggaacaaggcggcgacgcacgagcacgacttcctctcgttgtacgccgccgccgccgccgccgccaaggacgctcctctcctgctccacgactccaagacgccgcctccttctcaaggtaattttctcttgaagacgcacgacttcctgcagccgttcgatcagaagccaggagcgccgccggagccgtcgccgctgcccgctccagccgcggagatcaggcaccggcagcaggtggcggtcgccaagcagcgcgcgctgccccttcccctgcccggcggcgtcggcaccttcagcatcagccccgcgcccgtgtcggtcgcgctgccgtcggccgtcgtcaagtcggtagcgccggccttcgtgctctgtgagctaactgcaacgacgctgcagccgggcgcgcgaaggcaccagcagcattgggcgctccccttcgccagctccttgga

SEQ ID NO: 93150 - protein, 154 aa, Zea mays
  misc_feature: Ceres CLONE 1582278
MGIQGNKAATHEHDFLSLYAAAAAAAKDAPLLLHDSKTPPPSQGNFLLKTHDFLQPFDQKPGAPPEPSPLPAPAAEIRHRQQVAVAKQRALPLPLPGGVGTFSISPAPVSVALPSAVVKSVAPAFVLCELTATTLQPGARRHQQHWALPFASSL

SEQ ID NO: 93151 - DNA, 581 bp, Zea mays
  misc_feature: Ceres CLONE 1582280
tcaccgcggtggcggccgctctagaactagtggatcccccgggctgcaggaattcgtctcacccctagaaaaagcctttcctcgccggcgaaggagaagccgcagcgctgctcccacgccccctaggagcgcgtgcctccattccatgtgcgcccgcccaccggaggataacctttgatcatttcgtttgctggacattggatcaactggtgctgttatacatagaaaggatttcattttaaattctcatctatatttggtggtgccataatcatttttccactagcgtttggcaataatgtcggagagcgagttagcagtaataaaaccagaggtgttgaagacatatatctggctttcagtgctttggatgggttccattacacaaagtggaaggaggagggttgcaatggttcctgccccatggaaatgggtagggaaaattgtggaaaaaaatggggcccaaggggtcctttcaaaaaaaaaaccgggggcttttttggccccccccccccgggaaaaaaaaaattttttttttccccccccccccccaaatttttttgaaaagattttttaaaaat

SEQ ID NO: 93152 - DNA, 1198 bp, Zea mays
  misc_feature: Ceres CLONE 1582281
  misc_feature (9)..(9): n is a, c, t, g, unknown, or other
  misc_feature (10)..(10): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (29)..(29): n is a, c, t, g, unknown, or other
  misc_feature (69)..(69): n is a, c, t, g, unknown, or other
  misc_feature (74)..(74): n is a, c, t, g, unknown, or other
  misc_feature (76)..(76): n is a, c, t, g, unknown, or other
  misc_feature (77)..(77): n is a, c, t, g, unknown, or other
  misc_feature (980)..(980): n is a, c, t, g, unknown, or other
  misc_feature (1160)..(1160): n is a, c, t, g, unknown, or other
  misc_feature (1198)..(1198): n is a, c, t, g, unknown, or other
tggggtttnnggtnnnccctctctccccntctaggggtatcactttttctttcttttcttttggggaanagttntnnttttttaagctggagctcaccgcggtggcggccgctctagactagtggatcccccgggctgcaggaattcgtctcacccctagaaaaagcgcctttgcctgcatcactcgctcattcggagcccctctcttcgccggcgtcgtaagaagaaatggcagagcgttttatccgtatcgccttcctcttgtccgagtaatgcccctccagaaaacggcctatccaacgtaacaacagatgtcccggactactccctgtggagaggcttctcctccggtactagtccgagtagccgaatagttatactactgtaccctacaaactgaatgaatgacggaggctagattccatggctgggggccgatgatattcgtaacaccactaccggctatccatacggaacattgtatacatatgcagccgccccccaccccccaaacagttatacaaccgtctcgcctgccaaccaccggcacaaagtgagaatacacgtatccaatgctccatcttactacaaagacggccgccctccctatgttacttcgggaaaactttctcctccttggaaaaaacgacgtataagttcaaatcgacacttccctcttcgtattattctaactctcggaggaagtctaccacttcaccggaaaaaagtattaataagttgctatcacccgacgtcctcttagctctgttggtgtcattgctgttttagtgtcataccccgttccctagaattcaggttatgttataactattgaaagccctaaatcccgttgcgggactagctacttgggtccgccctattacctaccgctagtatctctctagtaacaataaggttatcgagcctacactctgtgtcagtattactatctatgaacccgctaggtttacgcccgattntatatggaacgtgctcgtctatgttattggccaaatttgtaggttcacaccaccgagtactataactaccttgtatatgaaatgcgactctaccacggaatcactctgatctattcttcgagtgtgtcccaatcacaacgaggggcacgcgtacactcatattgagaatcccctgtgacncgttcgcgggaaatagtaactacactccatcatatgtn

SEQ ID NO: 93153 - DNA, 1070 bp, Zea mays
  misc_feature: Ceres CLONE 1582298
  misc_feature: Translation starting site: 894
  misc_feature (17)..(17): n is a, c, t, g, unknown, or other
  misc_feature (60)..(60): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
gtattcgaagagaaaangtaggaaaataaagggcaagcaatgccataattcctttttttnaatatatnnnntaaaaactggagctccccgcggtggcggccgctctagaatagtggatcccccgggctgcaggaattcgtctcacccctagaaaaagtcgttgctctccgccgccaccagtgcccgtagcgctcgccgccgccgccgccgccgccaccaatggagagcctccggctcgccgtcacccaccgaccggctctccctctcccgacctcccatagccacctccgccgccgccatctgcacctccacctccactcttaccccaatcccctctccctctcaccccccatcgcctcccacctctcacctatccctcgccgccacctgcccccgctcctcgcctccgcatcggcctctcaagcgagctctaagccggcggcgtcggcggcatctggcggtgctaaaccgctgcccctctttctctcgcttgccgccggcctcgccgtccgcttcctcgtgccgcggccggccgaggtaaccccagaggcctggcagctcctctccatcttcctctccaccatcgcgggggctcgtcctcggcccgctcccccgtcgggtgcgtggggcgttttccttgggccttcacagcccaccggttcgcccaccccgcaacggcttccccctttcaaccggcccgccgtttccggggggcggttttcactttaaccgaaaagttcaattcttggggcctcacattcgggtcaaataatcccaattctataaattcccggcggcgccggggcttttgtggttcaaaaaaaccggaaatttccggtcgaaaccggcacgtttcgccccaccgtgtaactttttttttaacaaaaagggctatggggggcagccaaacaacctttatggggggcccttatccctatatggggggctttggccaatttcaagtaagaggggtcttcaaattcttcccccctgggcccttgggcccccaggaaacccactgtattcaagggctcatggaagaggggttatttcccctttctccacaccgg

SEQ ID NO: 93154 - DNA, 822 bp, Zea mays
  misc_feature: Ceres CLONE 1582300
  misc_feature: Translation starting site: 233
  misc_feature (467)..(467): n is a, c, t, g, unknown, or other
  misc_feature (568)..(568): n is a, c, t, g, unknown, or other
  misc_feature (569)..(569): n is a, c, t, g, unknown, or other
  misc_feature (713)..(713): n is a, c, t, g, unknown, or other
ctccccgcggtggcggccgctctagaactagtggatcccccgggctgcaggaattcgtctcacccctagaaaaaattctgcagcgccagctcgctcctcgccccgcccccttctctcagcggcgacgcctcgggcgttcctaccctgccccctctccggacccccacgccgtcggcgaagcagccgggcaagagcccgatccagaccccgcgagcaatccttgatatacctgatggctatgattgatgagcctctgtacccaattgctgtactgattgatgagcttaagaatgaggacatccagttgcgtctaaactccattagaagactttcgacaattgcacgggctcttggagaagaaagaaccaggaaggagctgattccctttcttagtgaaaacaatgacgatgaagatgaggtgcttcttgcaatggctgaggaattgggtgtgttcattccttatgttngggggtgtagaacatgctcatgttttgcttccccctttggaaacattgtgtacagtagaagaaacttgtgtccgtgataaggcagttgaatctctgtgccnntattggtgcacaaatgaaggaaactgacatagtcgactggttcattccagtagtaaagaggctagcagctgggtgagtggtttacagctcgtgtatcatcctgtggtcttttcacatagcctatccaagtgcattggacaattngaaacagaattaggactatctatggtcagttatgtcaggatgacatgcctatggtcaagagagctgctgcatcaaatcttggaaagtttgcagccacgttggacagaat

SEQ ID NO: 93155 - DNA, 814 bp, Zea mays
  misc_feature: Ceres CLONE 1582307
  misc_feature: Encodes the peptide sequence at SEQ ID NO. 93156
  misc_feature (1)..(1): n is a, c, t, g, unknown, or other
  misc_feature (358)..(358): n is a, c, t, g, unknown, or other
ncggtggcggccgctctagaactagtggatcccccgggctgcaggaattcgtctcacccctagaaaaaaagttaacctctcgtgctcgggcactttctttttccttcccccctgtgcgctcggccgcctccgccgctgcctcgctccctccgcgcccaccacggaggcgcacgcgcgggcgcagcgtccctcgcgtgcctcgccttccgcactgctctgtccgcccgcctggctcctgcctcctcctcctcctcctcctctagggttagggcacgcgtcgcgggggcccgtggcgcccggcgcaatgcggaggccgtcgggggccggcgtgccgagccgccgccgccgcgcgatccangtgctcgtggcggtctccctcgcctacgcggtcgccgtgctgctcctcgagtcgcccctcgtgtccacgtcgctgcccggggcggggggcgtccgccgcggcgtcgcggaagctccacctcaaacgcgcgtgggaaggcgcgggacgagcagcggcggcgcgccccgcgaaagcaccgcacagggagaacctctcggcggacccggggcggggacgggcgcgcccgttggcggggatcctctcggggctcgaggctcgccacctaaattccacccgctccggctcgcttccaaagtcgccgcgaagggcgccaagtcaggggccccggtggtctccgaccggagggtctagcgaacgccttggattttttcgggggaattcgttcgggggaggagggggaaaaaaaaaggtgccccgcacctgagttggccctcaggggggaaacaaatttccgga

SEQ ID NO: 93156 - protein, 134 aa, Zea mays
  misc_feature: Ceres CLONE 1582307
  misc_feature (18)..(18): Xaa is any aa, unknown, or other
MRRPSGAGVPSRRRRAIXVLVAVSLAYAVAVLLLESPLVSTSLPGAGGVRRGVAEAPPQTRVGRRGTSSGGAPRESTAQGEPLGGPGAGTGAPVGGDPLGARGSPPKFHPLRLASKVAAKGAKSGAPVVSDRRV

SEQ ID NO: 93157 - DNA, 800 bp, Zea mays
  misc_feature: Ceres CLONE 1582309
  misc_feature: Encodes the peptide sequence at SEQ ID NO. 93158
ctcaccgcggtggcggccgctctagaactagtggatcccccgggctgcaggaattcgtctcacccctagaaaaagcccaaaccacaccaactcacccaaatcatcctactcctactactattcgagcagctagcccagccaatcactctgctgaaaattacttcgagaccttggcgcacaagaaaccgtgaacgattgatcatccctgcgatagcaagcgcagcaatggcggcgaagcgtctgtacaacgggtacgagcaggacggggaccagcccaatgacaagcgcatgcgccggctgccgtccttctcgacggtgatccgggaggccatgatgcagaagcacatgcagagcctgttcaggtgtctggagcctctcctccgccgagtggtgaaagaggagctccatgcagggctgacgctgatgcagagcccgcgctacatcgagaggctgccggcggagcgggcggcgtggaggctggcgttccggaccccgccgcagctgcccatcttcacgggcagcaagatcgaggacgaggccgggaacccgctggaggtgatcctggtggacgcggacacgggctcgccggccgcgctcccgcaagcgctgcgcgtcgagctgggtcccggtgtacggcgacttcccgcaggacgggcgcgaggactggtccgacgacgagttccagaagaacgtcctgaaagagcgcgcggggaaagcgcccgctcctgaccggcgaacgtgaagccgggccctgaagggacgggcgcccccacggtggggccaagctccgtttccgggac

SEQ ID NO: 93158 - protein, 167 aa, Zea mays
  misc_feature: Ceres CLONE 1582309
MAAKRLYNGYEQDGDQPNDKRMRRLPSFSTVIREAMMQKHMQSLFRCLEPLLRRVVKEELHAGLTLMQSPRYIERLPAERAAWRLAFRTPPQLPIFTGSKIEDEAGNPLEVILVDADTGSPAALPQALRVELGPGVRRLPAGRARGLVRRRVPEERPERARGESARS

SEQ ID NO: 93159 - DNA, 1216 bp, Zea mays
  misc_feature: Ceres CLONE 1582313
  misc_feature (55)..(55): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
taagcgttttgggatagggtgtaatattccgccagttactttcaggctaatcccnccccnnnntttttaaaactggactccccgcggtggcggccgctctagaactagtggatcccccgggctgcaggaattcgtctcacccctagaaaaagcgtcccgttcccgcacttctcttccttctcgtttcgtcctgcacagcgcacgcaactgccaccggccaccgcgcaaactccattgcgcgcagatcaagaccgccacacccaccaccagcgcttcagcgggagacgtgacgactgacgagacgaaggctcttcccacggggccctccccccttcacatgggcctggggctcggccttgccttcccgcgtcccgtttggggccccgcgggctcccgccggccgggcgaattcgaaaaaccccttaaaaaccgggttccgccttctgcctttggttccccccctaacaaaaaggaagggcacccgggggggcaatttgtgggggccacccctttcgggggggtttttcttttttgtttttccggggacccggtttttgtttgaaacccccgcccctcccaaaattaaaacgcgcggggggtggttcttggtgccccccctctggccccccgggggccccgccgtggagggggggtttttttggaaaagggcggcctttaacccccgggggcaaggggaaaacaaccctgggggggagaggggccctgaaaaacatggtaggggaattatttcctacccgcggggcgacaaaaagtgggggggaaaaggggagtcccctccctcaaggaggggagaggcttctattttgtgccgctggggggtatctagcccccccccgcggggtgggtggccccccccccctcggaaaggaaaattttctctctggccgctctcttctcgtttggcagcgaagatcgtaggtggggggcagagagatagaagactctttattgttagagaaggagacacagagacggtgttttctctccttcgggggggggaacgagtgtcaaccgccagagagcagtggcgctatctggtctgcgctctgggcgggcgcgcaccaactaatgattgaagaggggtgtgtgtggcgaaaaattactatttgttctctcaacaaaaaaagtgttcttgctgtcgtggtggggaaaacgcccccacaagaagaatatttttttgtctttctccgagaaa

SEQ ID NO: 93160 - DNA, 1107 bp, Zea mays
  misc_feature: Ceres CLONE 1582315
  misc_feature: Encodes the peptide sequence at SEQ ID NO. 93161
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (9)..(9): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
nnntttttnttnnnttttatcttcccccccttttctccccacgtatggttattaaaaaaggggaaannnnnaaaaatgggactccccgcggtggcggccgctctagaactagtggatcccccgggctgcaggaattcgtctcacccctagaaaaccctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtcttttgatgtcaagcgtctcattggcaggaggtttaagtgatgcctcccgtccagaatggatattaagcttgtggcccttccaaggtcatttccctgggcccgggggagaaaccaaatgaatagttggtcccaccccaaagggggaaaggataaaaacacgtttgcccaccctaaaaaaaaatcccccttccccggggtttcccccatcctaaggatggcggtggcaaaaatctgccttgaaaagccttttctcctcttgggacccagtcctcggagattcaaagacaaatggtcctcgttttggtctgcacctcgtttccaccctggacccataaccttttgagaccgaagattgtactcgagaaagcgctcggggccctccctttaagcggtactgcctcggggggggtggaattatgtcgtggtcacaaaccatgtgtccgagcctgcgttgatcacccccacatggggtcccacaccctcgggtgtcagcattgagttcgcccctataggatttcgtcgacccaaagaagagtcgcactccatcgccttttatgggaagaaggaactatgcgttaccgcgcttttggaccctctcggtagaggggcagcttcctctaaaatgtta

SEQ ID NO: 93161 - protein, 71 aa, Zea mays
  misc_feature: Ceres CLONE 1582315
MAGKGDGPAIGIDLGTTYSCVGVWQHDRVEIIANDQGNRTTPSYVAFTDSERLIGDAAKNQVAMNPINTVF

SEQ ID NO: 93162 - DNA, 840 bp, Zea mays
  misc_feature: Ceres CLONE 1582318
  misc_feature: Encodes the peptide sequence at SEQ ID NO. 93163
tccccgcggtggcggccgctctagaactagtggatcccccgggctgcaggaattcgtctcacccctagaaaaaaagaggcctcaaaagaaccactgctcttcctccgcatagctcgtcgccctctctctcctatcagtcctcccagctccagctaccacagcagccctctcgcttaaaggaggagggagaagggggcgaggcgagcaatgtctgagcagcagcagccattgccgcagcctcggagcagcatgcgggaggcgctggagaaggaggacaaggagaaggcggctgcggcggcggcggccaaggagaaggcggcagtccccaagaacggcaacggcaacggcggcaagaatggcggcggcgccggcagcggcaacggcggagcgcccccgcagtccggggaggagacggcccgcgagatcccaggtggtcagggaggcgtaccgccgcgagacggccgcgccgggctacgtcatacccgaggagccgccgggcggtggtcgagctcgtcggctggtacatctacgggcttctgctcctacttaatcacccaacctggctggtgccgggtcttctttcccggccattattcccgaagggtgcccttccccaaatccgaattttacgccccgaaccccaagtaacacccctaaagggggttaccctggttcccgtccacaaaaaggccctgggtcccaaagggtttacccaagcaccccccttgggaaaccaagggatccccggaagtcccccctttggggtctggaaagggaaaattttggggggaaaatggggaatcccttcttgtgggggggccctcccctcccccaaaaaac

SEQ ID NO: 93163 - protein, 146 aa, Zea mays
  misc_feature: Ceres CLONE 1582318
MSEQQQPLPQPRSSMREALEKEDKEKAAAAAAAKEKAAVPKNGNGNGGKNGGGAGSGNGGAPPQSGEETAREIPGGQGGVPPRDGRAGLRHTRGAAGRWSSSSAGTSTGFCSYLITQPGWCRVFFPGHYSRRVPFPKSEFYAPNPK

SEQ ID NO: 93164 - DNA, 859 bp, Zea mays
  misc_feature: Ceres CLONE 1582320
  misc_feature: Encodes the peptide sequence at SEQ ID NO. 93165
gagctccccgcggtggcggccgctctagaactagtggatcccccgggctgcaggaattcgtctcacccctagaaaaactcacatcgcctgaccgacgcgcccgttttctcctgaaaacagaaggctccggcctccggcatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccacatgcaggtgtaccgccccaacccggcccgcgaccgcgacctctgccggcttcacgccgacgactacatcaactttctgcgctccgtcacgccggagacgcagcaggaccagatccgcctgctcaagcgcttcaacgttggcgaggactgccccgtcttcgacggcctctacagcttctgccagaactatgcgggtgccccccgtcggcggggccgtctagctcaaccacgggcacaaaatcgcaatcaactgggtcgggggggccggcaccaccccaaaaaaatgcgaaggcgtccgggtttctggctaaggtaaaaaaaaattgtggcttcgccataactcaaagctggctcaagcatctccaaaaaaaagttctgttatggtccaaaaaccaatatcccccccctggcccaatgggaaattgggaagaaagggtttttttaccacaaaacaaaaaag

SEQ ID NO: 93165 - protein, 168 aa, Zea mays
  misc_feature: Ceres CLONE 1582320
  misc_feature (24)..(168): Pfam Name: Hist_deacetyl Pfam Description: Histone deacetylase domain
MDPSSAGSGGNSLPSVGPDGQKRRVCYFYDPDVGNYYYGQGHPMKPHRIRMTHSLLARYGLLNHMQVYRPNPARDRDLCRLHADDYINFLRSVTPETQQDQIRLLKRFNVGEDCPVFDGLYSFCQNYAGAPRRRGRLAQPRAQNRNQLGRGGRHHPKKMRRRPGFWLR

SEQ ID NO: 93166 - DNA, 871 bp, Zea mays
  misc_feature: Ceres CLONE 1582328
  misc_feature: Encodes the peptide sequence at SEQ ID NO. 93167
  misc_feature (366)..(366): n is a, c, t, g, unknown, or other
  misc_feature (710)..(710): n is a, c, t, g, unknown, or other
ctccccgcggtggcggccgctctagaactagtggatcccccgggctgcaggaattcgtctcacccctagaaaaatcgtgtccgatggctcgcccccgccgcctcctctgacgacggtctgactgacccccgcctccccggagagcggctccgctgtctcgccggatatggcgccgcctcgtccccctcctaacccggcgggggagcagcagccgcagctccacggggtggtcatcatcacgctccctcccgcggaccagccctccaagggcaagaccgtcaccgccttcgcctacaccaacgaccccccgccccctcgctcgcccccggatccggttatggggtacccggcggcgacggaggctangcggcggccgaggcgggcgctctcgacgcggcgggtggggaccgcggcgctcgtgctgggcgcgctcgcggtcgccgccctactattgcttctactccggaccgggcccgtgcagttcccggggggatgggagcgggggggggaagcctgagggaacctggaccctgttctttcctggctcgccgtttcttcccccaaagggggcgtaaaggggccccgcggcattgtcaccgaatttcgggggaacatttaaagctgtcgcgccctgggaggggtccggacaccagggcggaagaagaagggcttgggaacaggagagggaaggagtgtggaaaagggcgggntcgggggggggggactttttccccgccggagttgtcccaccaaaaaaaggggtaatagactttcggcgcgggtggacgaattattccacatctcctcttttggtatggggcgaggcccgtggagaaagaagatagtgttggagatagtcgaattctgctag

SEQ ID NO: 93167 - protein, 116 aa, Zea mays
  misc_feature: Ceres CLONE 1582328
  misc_feature (67)..(67): Xaa is any aa, unknown, or other
MAPPRPPPNPAGEQQPQLHGVVIITLPPADQPSKGKTVTAFAYTNDPPPPRSPPDPVMGYPAATEAXRRPRRALSTRRVGTAALVLGALAVAALLLLLLRTGPVQFPGGWERGGEA

SEQ ID NO: 93168 - DNA, 1274 bp, Zea mays
  misc_feature: Ceres CLONE 1582329
  misc_feature: Encodes the peptide sequence at SEQ ID NO. 93169
  misc_feature (13)..(13): n is a, c, t, g, unknown, or other
  misc_feature (1117)..(1117): n is a, c, t, g, unknown, or other
ttatctttttctncgttcctgatcctttattccctaccgccccggaagtagcaacaaacaaaaataaataaaaagctggaactccccgcggtggcggccgctctccaactagtggatcccccgggctgcaggtaattcgtctcacccctagaaaaaaacttaaaccacacccatcgcacccagccagccctcgccatccatggccgccaccgccgccatccacctgcgcccgctccgttccgtcgccgtctcctccgcgaggtcacgctcgctcctccacctcctcgcccggcccctctcctcttcccaatcgtcctacgcctaccgcccttcccctacagcgcccgccgcccccgcccccgcccccaaccatgtccaccaccctctccatcaccaccagtcggtgcctcccccaggaccccctccacaatggtccgcgcagggacatccacctccgccgccccgtggctatgggcctccaccgctgcaacaaccagcatgggccgccttccgccaacacgcggggtacggaacattcaacaacacggattactgaaccaaaagcagacggctcgcgccctcacacacgggccacaggaactttcggccgtgtataacgctacgtaaaacacgaggccaacagggtatttccctactcacgcggggctccaagcaacgaatccttgtcgcggacattcctgaaatatgcaaactaagggaccgacaccggaaaaaacattacacaagcaaacttatggggtcttcatcttgcgcctaatggggtactaacacacaactactagtagaacagggagagaacgaacgggggggggggagcggggtctgagacgcatatcttggtgggtgtcgaaaaagagcgactcgttccttattgttgataagaatgagctgttttgaggtcacgaacaacaatagacatcgggggcactagatagagggattattatctctcggaagcgaaagcaatgtgggagagtaacgaccgagactctcagtgcccgggagaccgctacggttatacagagacgacacgcaaaagacaggtgtgatatacacaaggaatgagacacagacagaaagtcccgctgcagatccnctatgtcagtagtgtcaaactaggaattgactcagtcatctattgttatacaccagagttatagaggagttgtacttcagggggagcggacgctcgacactaggcgatactgagtgtatatcaacacactcaggcgtgctcggagacgacaattaag

SEQ ID NO: 93169 - protein, 118 aa, Zea mays
  misc_feature: Ceres CLONE 1582329
MAATAAIHLRPLRSVAVSSARSRSLLHLLARPLSSSQSSYAYRPSPTAPAAPAPAPNHVHHPLHHHQSVPPPGPPPQWSAQGHPPPPPRGYGPPPLQQPAWAAFRQHAGYGTFNNTDY

SEQ ID NO: 93170 - DNA, 1095 bp, Zea mays
  misc_feature: Ceres CLONE 1582331
  misc_feature (996)..(996): n is a, c, t, g, unknown, or other
  misc_feature (1095)..(1095): n is a, c, t, g, unknown, or other
tgttaggtgttcttaatatagttttgtagtttctaatcccactctcccaccagacttaaaaaccttaccttcaaaactggggctccccgcggtggcggccgctctagaactagtggatcccccgggctgcaggaattcgtctcacccctagaaaaaatggagctgtgagctgagctgaggtgagctcaccaccaccacggacgggagatagctatcgctaccataatccgccagccagacatccacttagacccacctagctagccctgctgccctccatgcggactcctacggcgagcgccgcggcctcagggacacctccgccacggccaatgccatgcagctgcacggccaccggtgtctgggcccgctgcaggaccggctagaatacttctggacctgcagactacacgagttcttccggaagcgcgcggcagctcaccctaccaccgagttcaggaatgacaacccccccacctaccccttctgcaagggcgtggaccctcgcggtgggagtcatctgagacgccgcagacttcaccgcgctcatccacccagacgacggggacaactccgacatcctcatcgggacctataacccgggacgccctcttcgacgggcgggacgcgcgtccggacttgtaccttcgacaacggagagacgaaggaccacttgcgcgctttccaagcacccttgcgccggtggaaacactccttccatcctgcaaccgcctccggaacccgggggaccaggctcgaaattttcctttcaacggagccgaatctcggctcctcaatgccccggtaaccacccatgggaaccggcgtgaatttatcgcgccaagagaaaggaaagggggcgctctaacaagcgaggaccccgtcccgcgcgggctttaattttctttcccccccctggcaaccaagttggcaatccattcggcggggtcccttcttgggcagggcctaatttagtggtgtcggccaggaaacaanaaccgcctccaacgggtggaggctgggacataacttatggggtggtccacacctcccatggtaaccccttgaggaagggtgtctctggggaaatacgan

SEQ ID NO: 93171 - DNA, 1311 bp, Zea mays
  misc_feature: Ceres CLONE 1582336
  misc_feature: Encodes the peptide sequence at SEQ ID NO. 93172
  misc_feature (1)..(1): n is a, c, t, g, unknown, or other
  misc_feature (710)..(710): n is a, c, t, g, unknown, or other
  misc_feature (804)..(804): n is a, c, t, g, unknown, or other
  misc_feature (831)..(831): n is a, c, t, g, unknown, or other
  misc_feature (934)..(934): n is a, c, t, g, unknown, or other
  misc_feature (1000)..(1000): n is a, c, t, g, unknown, or other
  misc_feature (1017)..(1017): n is a, c, t, g, unknown, or other
  misc_feature (1103)..(1103): n is a, c, t, g, unknown, or other
  misc_feature (1205)..(1205): n is a, c, t, g, unknown, or other
nttccccttcctcccttcccatccctttttttactattacaaacctatccgaaaaaaaattaaagaataaaaaaactggagctccaccgcggtggcggccgctctataatagtggatcccccgggctgcatgtattcgtctcacccctagaaaaaacacaacacaacacagttctccctttccactccagtccaaccaaccgtccatgggtttcttcatcccgccgcccaaggtgtacaagccggcggcagaggtcgacctcgggccggacagcgacgagcactacatcagccccaacgtgaaagcgccccgcgtggccgggttcctggtgaagatgctggcctgggtgctggatacaccggtgcttggctggatcgtgctcagtgtcctcaagagggacaacctcgtctacaaagctagtctcgtacgctgagatcccggagccgccgctgttcacggccacccacccatgggaagcccaccccggaacacaacatgccacgtgacacagcccaacgctgtcaccctcgccaagcccccatgcaagaaagcccgtacgccttgacctccacaacctacccggccaaagacccaacactcccgaccccccgccccatcggaagccctcaacgcccccaccctacggacggcgtcgcaccctctcccgtcaccgtgctccctaccctgcgcctcgaaggaaccaaggagtncaacaccaccctcaacccaatcgcgacgtacaacaagcgccgaacgtcaaatcccaaccctaacagctatcatccacgctgcggaaccacactnaattcgcggtcgacatagcacgacgcncccgcgcgggacaacacccctctgaaatcccagaaaaaaggcggccgctactatacacacttaacaccattcatacaacctacggctacgcaaaatcgcgcancttaccgaagtgataacactgtccgggtaatgcttctcaggcccgcaggtacaagtaataccgcancagaccagtaacaatcncggcacctctgtcagacacactcgctgaacacacgtcttgagaatggattctgcacacgtacaccccccgcgacatctgctcacantcagtcggacccggccggctgacctccaccgtgctgacacgagcgacccatacaaccttcctcattacacgcctcgtgaccgccggtacacaccggaccatntcaccgcgccagtgctttcgaccgagctactgagcttctgcgtgcacgaggacatcatcctgtaccaatagatcgcggcgcagcactaaccaaacgcacgtactcc

SEQ ID NO: 93172 - protein, 75 aa, Zea mays
  misc_feature: Ceres CLONE 1582336
MGFFIPPPKVYKPAAEVDLGPDSDEHYISPNVKAPRVAGFLVKMLAWVLDTPVLGWIVLSVLKRDNLVYKASLVR

SEQ ID NO: 93173 - DNA, 1333 bp, Zea mays
  misc_feature: Ceres CLONE 1582349
  misc_feature: Encodes the peptide sequence at SEQ ID NO. 93174
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (929)..(929): n is a, c, t, g, unknown, or other
  misc_feature (980)..(980): n is a, c, t, g, unknown, or other
  misc_feature (1094)..(1094): n is a, c, t, g, unknown, or other
  misc_feature (1174)..(1174): n is a, c, t, g, unknown, or other
  misc_feature (1211)..(1211): n is a, c, t, g, unknown, or other
gtgggtgggtgaantttcnntcgcagggattatacatatatcattttagggaggaaaaacaaaaaaggaaannnnacaaagctggaactccccgcggtggcggccgctctttaactagtggatcccccgggctgcatgttttcgtctcacccctagaaaaaacaaacagagagctcaccaattcaactgaacagcaagcgcacctaccctacctgcaagcgcaccgcccgccgcccgccgtcgaaggcgaagacctagctcccggtccgtcgcgatggctgccgcggcccgccgcggccccggggcgcgcctccttgcggcgctcctcctgctggcgctggtcgtctccgggcactgcctggacgcgcaccaccgcgggctgaagcgccggcggcggaagcacgagatccattccccggtcaagacggtggtggtggtggtgatctataaattaagatcccgaacactagatcagctttaaagaacccccccactcgggttatgtcgctaccacaaatgaatgataaacgcgtctctacagttatctggcgtttggagagaggagcgggttgggtagactgagttcgaaccggcacaccataaactaaaataagataaaagagaggaaaacgggaagcataaagacgagggtccgatagctatattacagttataagcactaaaacaacaacgcgaaaaacagaagcgcgagaccaagaggcaatattaaaggagaaggcgcgctgcgaaatgtcgttggaagaacaaacgtagtaatgaatagataatatgttatacgcgacacgcgctttaatatatatccataccattcaatggtgtgtcgtacagatgacgccgcgctcggagcaaagacgccaaacataaacgagtacgaccatgcgtgattgggataagaagtggaagtattntcacttaactagtcggggagtgcgtggtaagagcgctttacgcattcttcncttatcgactaattaaataaagtctacagaaccgcgatgtaatgcacatcaataattgtccccgcaggcgtcgtgttgacgtgtgcacctgtatataatacatgcgagaattancagtaatcatacaccacacaaaaaagcagtagcgaaaagggtcgcgtgcgcacagcgcgaataacaggtgttatgacaantagaaggacgggtaagtgcgagtgctgtctcgtgagncgtcggcactctatatatataccaaagtcgagatatactatatcgcatctaagacgctgtggagtggagtataatgcatagtgcaagatatggatacgtcacagacaacatgtgtatagaag

SEQ ID NO: 93174 - protein, 68 aa, Zea mays
  misc_feature: Ceres CLONE 1582349
MAAAARRGPGARLLAALLLLALVVSGHCLDAHHRGLKRRRRKHEIHSPVKTVVVVVIYKLRSRTLDQL

SEQ ID NO: 93175 - DNA, 870 bp, Zea mays
  misc_feature: Ceres CLONE 1582352
  misc_feature: Translation starting site: 203
  misc_feature: Pfam Name: ARID Pfam Description: ARID/BRIGHT DNA binding domain
gcggtggcggccgctctagaactagtggatcccccgggctgcaggaattcgtctcaccccctagaaaaatgttgctcctgtcctgttcctccgcttcctctgtctctgtctcgtcgtctcccccatctggccatctccggctagggtttgccctcccaccacgtccgaggtctagctcgtctccgccactgccggaccaaggatgtcgcaagagcaaggtatggaggagccgccgccgcaggcggtaggcgaggcacaatcggccgccgatgtccccatgagcgaggccgcagcggtggaggatgaggatgaggaacccgtcatgggggaggggcagggcggtgaaagcggggccgccgatgccgttgattccgtcaaggcttcactgaagcccgaagcatagggcgcggaggaaggggacagagaggagcttaatggtggcccgacggcggatttgactgacgaggttgtgaaattggagaacggggatggccccgtgccggtgggtggctccgcggatgagtgcggagctggagatggcggtgttgataagggcctggttggtcagaatgagcctgttgtgaaccagcttgtgctggtgcaggctgaggaggagctggcattgtctaagatctcaaacagtttcctcatgttcgattacaccactggggggtgatgactctaggactgaggaagaacaagctgccttcatgaaggaactggagcgttttcccgggaagaaaatgtttgagttcaagccccttaagtttattggggaaaggattggaattgcctcaaattggggaaacaaattaactggaattgggggggcttatgataaggggaaaatcattccaagcttgtgggctt

SEQ ID NO: 93176 - DNA, 843 bp, Zea mays
  misc_feature: Ceres CLONE 1582356
  misc_feature: Encodes the peptide sequence at SEQ ID NO. 93177
  misc_feature (734)..(734): n is a, c, t, g, unknown, or other
ccgcggtggcggccgctctagaactagtggatcccccgggctgcaggaattcgtctcacccctagaaaaaagagaccgccaccgcgctgttccgagcccgctaaccgcgacggttaaaaacgcgtacggcatcgtcgcgttccctcctcccagtccccccatctctgtccctgtcccccctcctcctcgccttttaccccgcatcgcctcgccgcctcctgcccgtctcgctgaaaccctcttggtcaccgccgtggtcgatccgacccggcagtagccgcagcatcctacgagggccgttggcggggtcgtcgtcgtcgtcgtgttcggcggcgggaattggatgcgccacggagcgggcgaggggacctagttgagttgaatacggcagcgacgggaggacgtgatgccgggggtggcgtcagcagcgggatcggggatctggtcgcgccggcgggacgagatcacgttcgatcgccttcagaagttctgggatgacttgcctcctcaagcacggcaggaactcctcaaattggataagcaaactctcattgaactagcacgcaagaatttctactgctcaaagtgcaatgggttggcttctggaaagttttgcaaaaattgttatatatggggaagtcattgcagcaagaagcttcagatatttgtcgcctgaggacagctattggaatcaagagttacgcagggagagcaaagatggggctcaggacccnatcatttcatccctgggggaggccttttcaacacaaaagatggctttccctacaccttcttgactgctttataaagcagaaatcattatgggtgctttcaaaatgtatt

SEQ ID NO: 93177 - protein, 89 aa, Zea mays
  misc_feature: Ceres CLONE 1582356
MPGVASAAGSGIWSRRRDEITFDRLQKFWDDLPPQARQELLKLDKQTLIELARKNFYCSKCNGLASGKFCKNCYIWGSHCSKKLQIFVA

SEQ ID NO: 93178 - DNA, 898 bp, Zea mays
  misc_feature: Ceres CLONE 1582357
  misc_feature: Encodes the peptide sequence at SEQ ID NO. 93179
tccccgcggtggcggccgctctagaactagtggatcccccgggctgcaggaattcgtctcacccctagaaaaacgtggtgttctctgggaggcagtcgccgggagggcacaacgtcgtctggggcctccatgacgcacttaaagcctacaatcctcagagcttgctctacggattcgtcggtggcacggagggactgtttgcaaacaagacgttggagatcacagacgatgttcttgcttcctataagaaccaaggtggtttcgatttgctcggtaggagtatcgatcagatccgcactactaagcaagtgaatgctgcaatgacaacatgccacagtctgaacttggatgggttggtcatcattggaggtgtgacctccaattcacaccctgcacagcttgcggagacccttattcagaataactgtaagaccaaggttgttggtgtgccagtttcatttgaatggtgacctcaagaaccagtttgttgaaacaacagttggattttgatacagtatgtaaaggttaaatcacagcttgtaagccatgtttgtcttgatgcgatctcggctggaaagtactattatttttgttcgtctgaatgggacgaaaaagcatcccaggttggcctttaaatgtgcactttcaatcaaacccaaaaaagcttcatctttaggggaggagggagcatttgtcaaacttcccacttgagggaaattttaagccagaatttttgaagggagtacaagcaagggcaaaaattagggaaaataacatgggggggcctggttattcccgcaaggaactttttaaaaaactttccccaaaatgttatgctcttttttcgggaaaatcaaatttccttccaaacacttaagtttcctggtgggtagaaagt

SEQ ID NO: 93179 - protein, 49 aa, Zea mays
  misc_feature: Ceres CLONE 1582357
  misc_feature: SWISSPROT Homolog: EC 2.7.1.90 Diphosphate--fructose-6-phosphate 1-phosphotransferase
MTTCHSLNLDGLVIIGGVTSNSHPAQLAETLIQNNCKTKVVGVPVSFEW

SEQ ID NO: 93180 - DNA, 1113 bp, Zea mays
  misc_feature: Ceres CLONE 1582358
  misc_feature (58)..(58): n is a, c, t, g, unknown, or other
  misc_feature (71)..(71): n is a, c, t, g, unknown, or other
attataaaaatttttttttgatgcggggtgacggcctaccgttgcttgcctccgatancccccctccaaanaaaacggagctccccgcggtggcggccgctctagaactagtggatcccccgggctgcaggaattcgtctcacccctagaaaaaagaacaccggagaaggagactcatgagcttcctcttcctccgcccactggatgagcctcgtctggagcatctggctgctcaccgtccaccggcctaacgcggacttccccgtgctcctgtcctagctcacggagctgactcacatcattctggtgcagtttaactaactggcgttcgcatcggaggcgggcaacctctccgggaggatctccagggtggttacactgtacctgcccgcgtgtggttcttgggccttcctcggcgcccggccgtgaatctcatccgcctacggggtcgataaccgtgctttttggacagtttaagacccttccggtacttggacgcagttcactgccccagctttcctggccccggaaaaccgacatctggctgaattatttaccctggcgggtaacgtctttttggcgggcgccgaacttttaggtttccccgagcaccgttcttgggttcacccctccccccgcaggaaaacctcgggcgcactttggccgcacaaagctggttctccacccttggcccggccggaaaccccaaaaagttcccaggccttgggttgagactctacataaattgcccaggggtctcaagaaaataaacactttactacccaaaaaaaaccctacatcccatgtcccggaaaaatgaatattgttgaacgcctttatgcaggcgctggcaccctcttccctcttaccgggggttgggagtccaccccttcatcgcacatttggggccccgtatttcttatgatttggagtaaacgtattggttgtctcttatgatacttttttgttatctatcacctctttcacggtgaagaggtgcgattctcggccccacatatgataatagtgggatatatcctttggtcgctccagaatttattgtctttttccctgggaggtatattggatttcccgcgggttgagttactccct

SEQ ID NO: 93181 - DNA, 1266 bp, Zea mays
  misc_feature: Ceres CLONE 1582359
  misc_feature: Encodes the peptide sequence at SEQ ID NO. 93182
  misc_feature (1166)..(1166): n is a, c, t, g, unknown, or other
ataaaccaacaaaggcggtattattgtttataataagcacggaaacaaaaacacatttaaaaaaccatcacaaaactgggactccccgcggtggcggccgctctagaactagtggatcccccgggctgcaggaattcgtctcacccctagaaaaaacactccactccagcactgaacacttgattgattcagtgggtagctagctagctgaatcacaatggatcctaccaagttccgtccgtccagcagccacgacacgacggtgacgacgacgaacgcgggcgctcctgtgtggaaatacaacgaggcgctgactggggggcctcacggtcccatcctgctggaggactaccacctgatcgagaaggtggcgcacttcgcgcgcgagcgcatcccggagcgcgtggtgaatgcgcggtggggccttcgacaagggctttcttcgagtgcaaccaccaacatgaagacccacacggtgtgttgaattccttgccccccccccgggatggagaacccccggggaatttgtgcacctttttcaaaggcggatctatacaagcgggggttcctcccggaaaaaaaattccgctaaccccccaccgggggtttccccggtggaaagaatttcaccgccccccgcagggggaaaatatggcgaacacttgtttggggggcaaagcgatattctcccccgtttttttgactttagatcccaacagaagccgggcaatctaaaattattccaccctcgaaccatggatatcttatcaggccgtataataagagagcctctaacacctccccgtgggctcaatatcactgttgataggggggagaaacttactccgcatcgagagcaggctttatcgcgatagataactttgtgtggggaaagaaattgtgctcctacgtgaaataccgcggtctctaaccaaccatttttttctgttttcaccgactacgtaaaacaaacaaactttagtgagtgctagcctctaacatataaattattttccactaccaaatgattagactagttctttctctgctgtatgagaaaccaaagaaagcgtattatctcatatagaacacacaagttagctggacaatgaaagctcgcaaatagcacgaaaataatatcactatatgaacacaccgttacaaantagtgctctgacgcgtggatatgtacgcctctatagctgaagaacatcaacatagtgactcgcgtatgtcgttatcgtgtgatcgacagaatcacacaac

SEQ ID NO: 93182 - protein, 88 aa, Zea mays
  misc_feature: Ceres CLONE 1582359
  misc_feature: SWISSPROT Homolog: EC 1.11.1.6 Catalase
MDPTKFRPSSSHDTTVTTTNAGAPVWKYNEALTGGPHGPILLEDYHLIEKVAHFARERIPERVVNARWGLRQGLSSSATTNMKTHTVC

SEQ ID NO: 93183 - DNA, 823 bp, Zea mays
  misc_feature: Ceres CLONE 1582360
  misc_feature: Encodes the peptide sequence at SEQ ID NO. 93184
  misc_feature (724)..(724): n is a, c, t, g, unknown, or other
  misc_feature (767)..(767): n is a, c, t, g, unknown, or other
  misc_feature (774)..(774): n is a, c, t, g, unknown, or other
  misc_feature (814)..(814): n is a, c, t, g, unknown, or other
ctccccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatgggcgccgtcgaaggctaccgtattgccggcgagccgctcggcgaggtcgtcgaaccgctgtaccctggcggcagcttcgaacccctcggcctggncgacgtacccgaggccctcgccgagctcaaggtgatggagctncagaacngcccgcctcgccaatgttttccatgttcggcttcttcgtnccagccatc

SEQ ID NO: 93184 - protein, 229 aa, Zea mays
  misc_feature: Ceres CLONE 1582360
  misc_feature (61)..(214): Pfam Name: Chloroa_b-bind Pfam Description: Chlorophyll A-B binding protein
  misc_feature (197)..(197): Xaa is any aa, unknown, or other
  misc_feature (214)..(214): Xaa is any aa, unknown, or other
  misc_feature (227)..(227): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGEPLGEVVEPLYPGGSFEPLGLXDVPEALAELKVMELQNXPPRQCFPCSASSXQP

SEQ ID NO: 93185 - DNA, 1333 bp, Zea mays
  misc_feature: Ceres CLONE 1582361
  misc_feature: Encodes the peptide sequence at SEQ ID NO. 93186
  misc_feature (33)..(33): n is a, c, t, g, unknown, or other
  misc_feature (756)..(756): n is a, c, t, g, unknown, or other
aatttatctcgaggggcggggggcgggtcccantacctccacctctcccaggcgtagtctccccgttttaaataagatggagctcaccgcggcggcggccgctctacactagtggatcccccgggctgcaggaattcgtctcacccctagaaaaagcaccgcctcgcccgcgggcgtcagcatgaagctgccgcacagctaccccgcgaggcatggggatggacgtcggcggcgggaagatgccgtacagctaccccgcccaccaggactgcaagctggtgaagagcttcagcctcgtggaaccccgcaagttcgggctcggcctcttcacgggcttcctgctcttcacatgcgcggactgatacagcggagagttggaagccatttaagtcccaattgacacagccgtctccgagaaaggcggtttggtattcgcccgctcggtggggtgtggcaacgccctcacaatccccgacattatagcaggggcctgttacgttggtccgaacagcgttcctcgcaggtaagtagcttttgcggagtctcgaacggtgggaggtggggggaacctacgtgtataaataaacattttatcgagcccggggagcaaaagagggaagcgcgccctatcttttcgcctaacttgggtaacccccactccaagcggtgccgccaaatgtccgacaggcaatgggttcgcgcacgcgcatatgtcggggagactcatgaagcaaccccccgcccgtaccgagcagncgggggggagtgcgcgggaacaacccagtagctcagagaccacacgccgagcggatgaatccccgctcacgagtcctgagtcggacgtaggatgattgacgactgttgtactaccccacgcctctgctgctcgcgctcgatgacgctcgaccccatcttcccgtgtgactcaatcaagtgtaatgcttaattacaaatgtgaagtaacactgcagacgagaagagggtgtggtatcggtgcaggcgcagacagagtcgatagcgtattatcttaacactctggagaagagatcggctatatactactataataccccccacaccactcatgtacttctctcagcgccgcagcttggctacagttacacgagatagcgtaaatcggctctaggcgtattctgaccgcggtatcgagcagatatccgaacccgtgacgtactccacaaaattcgaagccctttcccaccctgcgacatgtttacgactcgactatgaaccgtaattcaatctgctagcctcttacagtaaaaaccgagtggaatagatacaagcagaactaacgggttcttgcgtatac

SEQ ID NO: 93186 - protein, 49 aa, Zea mays
  misc_feature: Ceres CLONE 1582361
MGMDVGGGKMPYSYPAHQDCKLVKSFSLVEPRKFGLGLFTGFLLFTCAD

SEQ ID NO: 93187 - DNA, 1299 bp, Zea mays
  misc_feature: Ceres CLONE 1582362
  misc_feature: Encodes the peptide sequence at SEQ ID NO. 93188
taaaactaaaaaatcgctgggtcgtggttatctaccaccgacacgtttgccaatctcatatcatacataaaaaagggactccccgcggaggcggccgctctagaacagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacttatatcttgaactgcggcgtggagccgtcgggcccagacgccagctcgccggccttctcggtgcgcgtgcgccgccgcctgccagacttcctgcagtcggtgaacctcaagtacatgcgcctcgggtaccactacctcatcggccacgacgtgtacctggccaccatctcggtgtcaacccccatgtgtggcgcccgagctgggcagtccacagccagcgacaagccgtttgcagcacgctgtgggggcggagggccaccttacgaccctactccactgtggctccgccattcctgggccgaaacatcgcctttacagcaattctcacgttctaatttcaaagtgacgagagcctccaagtgactcggggtgcactttcagtccaatcttatctgagattgctctcaccagatcacggtgccctgaaactaaaactatcccatagggttgggtaccaaagaggcgcttcgtaactattctgacctcacgtataaattataggcttgtactgaagcgaaggttttccgagcgcgcctctacgtcttttctctgtcacctcgataatagggatcccaggtcgcccctgtgggtatataagttttcgaagaacgagtcagagcacgtcgacaatgggactaagaggcgcactaagagagttaatcaggggcgcaattagcgcacgccgcagataagaaagttttctggttgtccatgagcacactacaccgttgctatagtcgagtgatatttcacgaaaagagacctcgaatagcctccagtatgctaggagagacccgcttgcctatcaacaagcgaggaggtgtgcccttacccacataagagggctcgatctagaacccgccagacgaggcttatctaaggaaatatccttggcacatgagaaagcatggaatgaccgataaaatacctatcatgacattcaccaccgcctctctagttgaatttctggggcatctaactctgcttgggattaacctgggcggacacaa

SEQ ID NO: 93188 - protein, 131 aa, Zea mays
  misc_feature: Ceres CLONE 1582362
  misc_feature: SWISSPROT Homolog: EC 2.3.1.119 Icosanoyl-CoA synthase
MAREEQALLSTYILNCGVEPSGPDASSPAFSVRVRRRLPDFLQSVNLKYMRLGYHYLIGHDVYLATISVSTPMCGARAGQSTASDKPFAARCGGGGPPYDPTPLWLRHSWAETSPLQQFSRSNFKVTRASK

SEQ ID NO: 93189 - DNA, 802 bp, Zea mays
  misc_feature: Ceres CLONE 1582368
  misc_feature: Encodes the peptide sequence at SEQ ID NO. 93190
  misc_feature (181)..(181): n is a, c, t, g, unknown, or other
  misc_feature (519)..(519): n is a, c, t, g, unknown, or other
  misc_feature (617)..(617): n is a, c, t, g, unknown, or other
ctccccgcggtggcggccgctctagaactagtggatcccccgggctgcaggaattcgtctcacccctagaaaaagcttctctcggttctcgcgactcccaaacggcaaaacgccaaaaccctagccgcggccattccggaattggccatggaggcgagggcgtcgccgcgtccgtcggtcntccatcggtggcggcggcggcttcggagctgggcggggtgacgacagcgccttctcgtttctctcaaaggggtggcgcgaggtgcgggattccgccaccgccgacctgcgcctcatgcgtgcgagggctgattccctccgcacgctcgcggaccgcgagctcgagcacatcctcgcgtccgcctccactgcgctgacctccgcgccgccgccgccgctcgccgcgggggcgcccatagccgagctcgagttcgtgcgcacacggatccagcccaagatctccgaactgcggcgccggtacgtgtcgcaggagcgggagctcggccgcaggtgctcganggggtgggcgccgcgcgggggcggggaaacccgcgcgcgcacgtgttgacctctctgggatcaccgccatccgcaacgccatcgtctctgaagtggantggcggggaagcgctggagcgcgtggtgtggaacggggaggcggaagagggaaaaaaaattggaaggtgctcaggatgatacgggacggcatcaaagagttcgagcgccggagccagaccaaagagattttttgagggattgcgcagtaccggcgagctcgtcgagaaaatccagtccagcctga

SEQ ID NO: 93190 - protein, 90 aa, Zea mays
  misc_feature: Ceres CLONE 1582368
  misc_feature (75)..(75): Xaa is any aa, unknown, or other
MRARADSLRTLADRELEHILASASTALTSAPPPPLAAGAPIAELEFVRTRIQPKISELRRRYVSQERELGRRCSXGWAPRGGGETRARTC

SEQ ID NO: 93191 - DNA, 817 bp, Zea mays
  misc_feature: Ceres CLONE 1582369
  misc_feature: Encodes the peptide sequence at SEQ ID NO. 93192
gagctccccgcggtggcggccgctctagaactagtggatcccccgggctgcaggaattcgtctcacccctagaaaaaatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgtcacgccggagacgcagcaggaccagatccgcctgctcaagcgcttcaacgttggcgaggactgccccgtcttcgacggcctctacagcttctgccagacctatgcgggtgcctccgtcggcggggccgtcaagctcaaccacggccacgacatcgcaatcaactggtcggggggcctgcaccacgccaagaagtgcgaggcgtcgggcttctgctacgtcaacgacatcgtgctcgccatactcgagctgctcagcatcacgagagagttctgtatgtcgatatcgatatccacatggcgatgggagtggaagaagctttctacacaacagacagggttatgactgtctcgttccacaagttttggtgattatttccaagaacaggggatat

SEQ ID NO: 93192 - protein, 206 aa, Zea mays
  misc_feature: Ceres CLONE 1582369
  misc_feature (24)..(201): Pfam Name: Hist_deacetyl Pfam Description: Histone deacetylase domain
MDPSSAGSGGNSLPSVGPDGQKRRVCYFYDPDVGNYYYGQGHPMKPHRIRMTHSLLARYGLLNQMQVYRPNPARDRDLCRFHADDYINFLRSVTPETQQDQIRLLKRFNVGEDCPVFDGLYSFCQTYAGASVGGAVKLNHGHDIAINWSGGLHHAKKCEASGFCYVNDIVLAILELLSITREFCMSISISTWRWEWKKLSTQQTGL

SEQ ID NO: 93193 - DNA, 1114 bp, Zea mays
  misc_feature: Ceres CLONE 1582370
  misc_feature: Translation starting site: 512
  misc_feature: SWISSPROT Homolog: EC 2.7.4.3 Adenylate kinase
  misc_feature (5)..(5): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (53)..(53): n is a, c, t, g, unknown, or other
ttttnttttnttttnnnnnnnntttnnncctaccccccctttctcctctctcnttttataaagatgtgttttgagttttatgtactctggagctccccgcggtggcggccgctctagaactagtggatcccccgggctgcaggaattcgtctcacccctagaaaaagtccacacaacgcacgcgaggtccatcgctcctcctctccgtcaccgagaaaatgtcggtctcctccccggccatggcctcgccccctctcgccgcgcccggcactcaccgcggcccctgcttctcgaccctctgccgcttaccgtcgccatcctgctacccgcctctttcggcttcctcctcaccggctatctccaccgtctccgcattcgctgtcctcaaacataagcccagaggtctgggactaaggtgccaggccgcggaggaggcaccaccgccggcgcggggtaagacttcgctcaaggtgatgatttcgggagctcccgcctcgggaaaaggaacgcaatgccgcatgatcgtcgagaagtatggtttagttcacataatcagctggtgatcttctggcgagctgaaagtatctttctgggcacagaaaattgggcaaagaaaagccagaaagaaatccagtgggaccaatgggaaaagccttggggcccggaaccccaggttggggaaccagaatatggggggggggaatccacgaaaccggttcccccaggcccaggagtttttcccaagcaaaaaggagggggtggggccttgtcccttgggagtggggttgtaccccccaagggggagggctttgcaggtgtccaagaggaacgcacaacgcctttgggaaaaagttttgtggaaaaaagaagaggaccccggaagagaatgattgccacgtgtgggagcgaaagaagagattaccccggaagagagatgggtccgctaaaagctaaccggaagtttgtgtttgggaaaagaacccgggtggggagtaccctgtgggagcttgggcaggagaagtttggccacttttaaaagaaaagtatcccccccgcggggagaaagaggggggaaattttttggcgccgagatattatagcaagcgcgtggtgg

SEQ ID NO: 93194 - DNA, 856 bp, Zea mays
  misc_feature: Ceres CLONE 1582371
  misc_feature: Translation starting site: 502
  misc_feature (826)..(826): n is a, c, t, g, unknown, or other
agctccccgcggtggcggccgctctagaactagtggatcccccgggctgcaggaattcgtctcacccctagaaaaaacgagacaaaagacgcccgccccggccggcgaccagtacctcgccattgctagtgctagccgccgtcgctggtgtcccctcctcccacttgcgccgcctgtccccgcgccctcgaaacctttttctcccaaaacagatttcgtcccggcgctctcctgcaaagggcggctagctgtcgccgatggatacgtttcacctctgtctcactgcttgggggggttctgcttcttcctgctttcccaagagagggccagcagcagacgaagcgagcaaagcgcgcaggaaccgctcggtctggtgattttaaggggcgaggtcgtgttcttgggaggcggagagacacgagctctctctcttcctgtcctctttcccgcggcttctctcttgtcttgctccaagagggcaaaactcgtcggggtagggaaatggcggaggtgaagccggaggagataagccatccgcccatggagcagctccaggggttcgagtactgcatcgactccaaccctccctggggcgaggcgatcatactgggcttccagcactacatactggcgctgggcacggcggtgatgatccccacggtgttgggtcccatgatgggcggcgacgatggggacagggtcagggtggtgcagacgctgctgttcgtgacggggataacacgctgctgcagtccctcttcgggaaccggctgccgacggtcatcggcgggttctacgcggtcgtcatcccgataatggccatcantcaggaaccgtcgcttttctgggatacccc

SEQ ID NO: 93195 - DNA, 863 bp, Zea mays
  misc_feature: Ceres CLONE 1582373
  misc_feature: Encodes the peptide sequence at SEQ ID NO. 93196
ccgcggtggcggccgctctagaactagtggatcccccgggctgcaggaattcgtctcacccctagaaaaagagaactccccttctccgccactaccgaagcccttgtacccctcaccgccgccgctgctgctagggagcttccacccgcgcgcgcctacaacgagagctagcagcagtagcggccgttatcttgtcgctccggctccgttcgtgtacccaagtcccagcctagatgccgcagatggaggggtccactgatcagatcgccgccggctggttcgctaaggagccggcttccgagcggcccgtgggcttgccgaggaccggctcttccagtcgcctcaacgcgcaggcgccggagttcgtgccgcgggggccgccgccgccggcgccggcggttgtgctgccgcctccgccgcaggtgatccgcatgttcgccgcgcctcccccgccgccgcgtgggggcttctttctcgcgccgcagccccggggcgttcgagtactatgcgcctattggtgaacgcagcggaattgctgccaaggagcaacacgcgccggagctggaagcggagatgctcccgcccgcccgcgtgaagacggagccagtggtggaagggctcgaccaaccagggggtgcacaagatcacccagcaggggggaataacaattttaagggacaccaaaccttggctaattacagaaaaatcttggagaggatttcatttaccaagggaatttctgaagggaaaatgttggcccaaaaatcacgaaaatggctggggccttataaaaaaaagtaaaaaactttctgtgtgccccaaaaatagtgggaaggttttggctggggggcttttctccgaaa

SEQ ID NO: 93196 - protein, 95 aa, Zea mays
  misc_feature: Ceres CLONE 1582373
  misc_feature (32)..(49): Pfam Name: PAM2 Pfam Description: Ataxin-2 C-terminal region
MPQMEGSTDQIAAGWFAKEPASERPVGLPRTGSSSRLNAQAPEFVPRGPPPPAPAVVLPPPPQVIRMFAAPPPPPRGGFFLAPQPRGVRVLCAYW

SEQ ID NO: 93197 - DNA, 1166 bp, Zea mays
  misc_feature: Ceres CLONE 1582376
  misc_feature: Encodes the peptide sequence at SEQ ID NO. 93198
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (751)..(751): n is a, c, t, g, unknown, or other
tgggggggtgtccccgcccagagaaaaatcaccttaaaagagacagcgggcaaacgccgaaaggnnnttttgggggtggaatttggtactcaccgcggtggcggccgctctagaactagtggatcccccgggctgcaggaattcgtctcacccctagaaaaaacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctatcggcggccggcggcgtggcggccgacggctccgatcaccggtacaagattcacgagcccgtcccgctctacgccaacaaggtcggcccatttcacaatcccagtgaaacatatcgatattttgacctgcctttctgctctcccgacaaaatgaaggagaagaaccagggcccttggccgaagtttctcaatgggggatcggttaattcgatgcgccctaaaaaccttggattttccctgaaccaaattgaaatcccaagggcaatttttgcctccaaaaaaagccttaacctaccaaaggaattgttatggaaaagtttccggggaaaaggccaggggggcctaaagggaaccaacctctacttccccggaaatgtgtacaccaacggaataggaattttctccccccacgcgtgggggggagggccctcctccacctcccggncataaaaaaattgtgaaaataaaaaagggagcccgcggtcctaggaggaatattgattattcccccctaaagcaccaaaaaagggcggacaaaaaataactccaacacctcggtgatagaaggggcggagaaaacactcaaaagcttgtatgcggaaaacaagccccctatatgatataaaccgagaacccaccccccgggggggggataaccgcaaaaaatatcctagaggtgggcgagacaccgcgtgaaattcaacaaagaggcaaattgggggtgtggaaccgcctgccttcaaagggttatatgggggggagaccccaaggtggggggaaattctcccgcgtatactccgccccccaatgggggtaagaggagaaatacccccgacccccccttgtgaaataaagaaagg

SEQ ID NO: 93198 - protein, 165 aa, Zea mays
  misc_feature: Ceres CLONE 1582376
MAALRAPAATLLVLLALSAAGGVAADGSDHRYKIHEPVPLYANKVGPFHNPSETYRYFDLPFCSPDKMKEKNQGPWPKFLNGGSVNSMRPKNLGFSLNQIEIPRAIFASKKSLNLPKELLWKSFRGKGQGGLKGTNLYFPGNVYTNGIGIFSPHAWGGGPSSTSR

SEQ ID NO: 93199 - DNA, 866 bp, Zea mays
  misc_feature: Ceres CLONE 1582377
  misc_feature (823)..(823): n is a, c, t, g, unknown, or other
  misc_feature (842)..(842): n is a, c, t, g, unknown, or other
ccccgcggtggcggccgctctagaactagtggatcccccgggctgcaggaattcgtctcacccctagaaaaactataacgaggttgtaaatgatctacttgatcctactggccaaaatttgcgtgtgcgggaggatgcacagggaacctatgtagaaggaataaaagaagaagtagttctgtcaccaggacacgctctttcatttattgcagccggtgaagaacatcggcatgttggctctaacaacttcaacttatttagcagccgaagtcatactattttcacattgatgattgaaagcagcgcccgtggtgatgagtatgatggggccatgtattcacagcttaatttgattgatctagctggttctgagagctccgagacagagactacagggttaagaagaagggaagggtcatacattaataagagcctcttaactcttggaacagtcattggcaagctcagtgaagggagggcaacacatataccctatcgcgattctaagttgacccgtctactacagtcatcattgagtggccatggtcatgtctcactaatttgtacaattacaccagcatcaagtaacatgcaagaaacacataatacattgaagtttgcaagcagagcacaacgtgtcgtaatttacgcctctcgcaatctgataagtgatgagaagtcattgatcacgaagtatcagagagatatatcctctctaaagcaagagctcgatcagctaaggagagggatgattggtggtgccagccgggaagaaattatgagcttacgtcagcagttgggagctggtcaggtcatgatgcancctcttctgaaagaagaantagaggcgaatgctgctctatgga

SEQ ID NO: 93200 - DNA, 895 bp, Zea mays
  misc_feature: Ceres CLONE 1582378
gcggtggcggccgctctagaactagtggatcccccgggctgcaggaattcgtctcacccctagaaaaagcggaccgagagggttttccggagaagtgttgcggacggtcactaaggtttttcctgatttcgcctcgggagccacaggcgttgccgccgtgggcaagcgccctgaatgcctgagcaccggacaggggatttgatagctctcgtgacgttgaggctgggcaggtacgggcgcactcttggatctgccgttgcctagggtggcgttgcccagctgatagaatgtcgtctgctctccaggtttggagcaatgagctcgtcttctctacttagagcaaatcgaaacagatgtcatagatatcgatctcagcactaacaattcctgggactccgtcatcgaacgtaagacacctctgggagattgaaaatgcagaaggcccgaggactactaacctccgttgttgccgagaattacaatggtgaccctgttgattggtgtcacagtccagcgagcaggccgtagccgatgtcctgaaactcaatacgagggttatagcggcttcatgggaagaaatttttgatatcgcattcacccggaaaggtgtaaaataaggtggccttacacatattgttaaagccccccaatggtggatgccttgggtccaaaatggttggccggcaaatacttcccctggtcagaattggttgcatattggtttccactaaccccgaaagggaaaattccggaggccttaaccttgggaatgaacgtctctccaagggctttctctttaaatgttccccatttttttttattaaaagatttggttggaagccccgggggcttttccaaggaattgctctgtttaggagttggcagtggaaccttt

SEQ ID NO: 93201 - DNA, 973 bp, Zea mays
  misc_feature: Ceres CLONE 1582381
  misc_feature: Encodes the peptide sequence at SEQ ID NO. 93202
  misc_feature (1)..(1): n is a, c, t, g, unknown, or other
  misc_feature (2)..(2): n is a, c, t, g, unknown, or other
  misc_feature (42)..(42): n is a, c, t, g, unknown, or other
nngggggttgttgtgggtttatcttccgccctttttcgccanttaacttttttaattgctcgtttatctctataatacttgcacctaccctaaaagcagaggccgccgctctcgaactactggatcccccgggctgcaggaattcgtctcacccctagaaaaaggttttgcagcttccagagcttgagaccagcgcggtagttctttcttggtcgatggcgctgaggaggatcatcaaggagctcaaggacctgcagagggatccacccacgtcctgcagcgcagggcctgtgtccgacgacatgttccactggcaagcgacgatcatggggcccagcgacagcccctactcggggggcgtgttcctggtcgccatccacttccctccggactacccgttcaagcctcccaaggtggcgttcaagacgaaggtgttccaccccaacatcaacagcaacggcagcatctgcctggacatcctcaaggagcagtggagccccgcgctgacggtctccaaggtgctgctctccgtctgctccctgctcaccgaccccaacccggacgacccgctcgtcccggagatcgcccacatgtgcaagaccgacccgcctcaggtacaagtccaccgccagggggaattggaccgcccaagtacgccatggggataacctgatgtgaagccggtaacaaacaaccaaccctttgggccgaattgggtaagggcgtgtgcccctgctaaagaaccaggggggttttcccccccccagaaattccaaaatctcctccggggccgtcggtttaaatttttttttactcctttattttttttttcccttttttccaccaatttttgcgcccccccccccccgggggggaaaacctggggttttcccctctttcttttcaaacaaaggtttctcgggggaaccgggtaaaaaacctttttctccaaaaaaagagcgcccaaaagggt

SEQ ID NO: 93202 - protein, 150 aa, Zea mays
  misc_feature: Ceres CLONE 1582381
  misc_feature (5)..(143): Pfam Name: UQ_con Pfam Description: Ubiquitin-conjugating enzyme
  misc_feature: SWISSPROT Homolog: EC 6.3.2.19 Ubiquitin--protein ligase
MALRRIIKELKDLQRDPPTSCSAGPVSDDMFHWQATIMGPSDSPYSGGVFLVAIHFPPDYPFKPPKVAFKTKVFHPNINSNGSICLDILKEQWSPALTVSKVLLSVCSLLTDPNPDDPLVPEIAHMCKTDPPQVQVHRQGELDRPSTPWG

SEQ ID NO: 93203 - DNA, 838 bp, Zea mays
  misc_feature: Ceres CLONE 1582382
  misc_feature: Encodes the peptide sequence at SEQ ID NO. 93204
ctccccgcggtggcggccgctctagaactagtggatcccccgggctgcaggaattcgtctcacccccctagaaaaaaagtctcaactatagtctccagtcccccgcctccacgcctccggctccggccagccgcagtaattgcagcgcagcccaagccaccaccaccaggcaccagccaaaggtgcggcctttgaccccgcgccggcgccatggccgcggacgccaccgcttccccctcctcctcctacctcccgccaccgctcccgacctcgcgcctggacatccaggccgccgtcgccgaggccgccgagctgcgcgcgctccacgccgcgctcctccagggcggcggcgcctccaattccgggacctacgccagcgctagccggagccccgccgtcatccgcctgccgccggcgctcgccaggccggcccccctgcccacggccgccgaggactaccccgtgtttgccccgatgtatgatgaggagcccttgggcggaacgaactgcattcgtcaagataacaggagcctgtccgagaactggagcggcgtcggtttggaccatgatggcctagaggacgacgaggtggccttctcggatttcgacaacaacaacaccttcttcttcgtcgaaacagcgagctccatctctccttcgtcgaaacgagcacctgcggaaacagaaagggcggtgcagaaaaccatcccgtcccttgcctttcaaacccacccgcccccttggctgcctaaaccgggttttgaatcaggggtcaaacccaggcaggggaatgaactggaactttggacctggaaatttccaaagggtcggctttacg

SEQ ID NO: 93204 - protein, 209 aa, Zea mays
  misc_feature: Ceres CLONE 1582382
MAADATASPSSSYLPPPLPTSRLDIQAAVAEAAELRALHAALLQGGGASNSGTYASASRSPAVIRLPPALARPAPLPTAAEDYPVFAPMYDEEPLGGTNCIRQDNRSLSENWSGVGLDHDGLEDDEVAFSDFDNNNTFFFVETASSISPSSKRAPAETERAVQKTIPSLAFQTHPPPWLPKPGFESGVKPRQGNELELWTWKFPKGRLY

SEQ ID NO: 93205 - DNA, 888 bp, Zea mays
  misc_feature: Ceres CLONE 1582387
  misc_feature: Encodes the peptide sequence at SEQ ID NO. 93206
gcggtggcggccgctctagaactagtggatcccccgggctgcaggaattcgtctcacccctagaaaaaatcgatctgtacgccctccccaccggtgggtcgcgcacctccaccaacctaccttcccgccccgcccgtcgccgtcgacgactcgccgtccgtttccgccctccaaaaccctactacctcttaccttccagccccgcgtcctccatggccaccaacggcagctctccgagggttcgggacacggagagcagtctggagaaggtgaagcggcagctgtcatcggggtctgggaggtacctgctgcaagggcccctgctcaagcgatctgagacgttacggaaatggaatgagcgttgggtcatattggacccgacatcaggaaagatggaatacaaactccggagaaatgaaactgccattaaggggaccattctgtttgacgcctcgagcaccattactttatctcctgtgaactttcaagggatgccaaaatataatgggctgctgcttttacatcggaactcctcaaaagaagggatactttctttggggggaaaactcctgggggctgcgaaaagcttggggtatttacattaaaaggcaactccggttagtccttacgaagcttcttaagggggcgtaaaaatttttttggctggggaaaggggttctcccagctaaatttaagggccaggtggccaccgggcagttggcaaaggcgtaaaggccacaagccctggggggggcttccaagggagaaataaaaagctggcccctaaaagggtttccaagggggggggacctcctttgggggttggggaaaaacaaataaaccctccaaccagggggggcccaaccttgagggggccccttaacaatg

SEQ ID NO: 93206 - protein, 130 aa, Zea mays
  misc_feature: Ceres CLONE 1582387
  misc_feature: SWISSPROT Homolog: EC 3.6.5.5 Dynamin GTPase
MATNGSSPRVRDTESSLEKVKRQLSSGSGRYLLQGPLLKRSETLRKWNERWVILDPTSGKMEYKLRRNETAIKGTILFDASSTITLSPVNFQGMPKYNGLLLLHRNSSKEGILSLGGKLLGAAKSLGYLH

SEQ ID NO: 93207 - DNA, 839 bp, Zea mays
  misc_feature: Ceres CLONE 1582390
  misc_feature: Encodes the peptide sequence at SEQ ID NO. 93208
  misc_feature (655)..(655): n is a, c, t, g, unknown, or other
  misc_feature (702)..(702): n is a, c, t, g, unknown, or other
  misc_feature (703)..(703): n is a, c, t, g, unknown, or other
  misc_feature (706)..(706): n is a, c, t, g, unknown, or other
  misc_feature (774)..(774): n is a, c, t, g, unknown, or other
  misc_feature (784)..(784): n is a, c, t, g, unknown, or other
ctccccgcggtggcggccgctctagaactagtggatcccccgggctgcaggaattcgtctcacccctagaaaaaagtgttacgcggcccacctgcacctgcaatgcaacgatcggtccctctcgagcagtagacgcccggttccttgtactttggcacccccatcacgtcgtctggtcaatctaaagcttggacttgcagcctcctcatcggtcgatcgatcggagtgacgtgctggggattgtaggtgcaagcgcgcgcgacattgcagctaccgagaagaaagcagaggggcgatcgagcagttgacgggcgtgcagcaatggcgggacttcacttcttgctcgtgccgctggtggcgcaaggccacatcatcccgatggtggacctggcccgcctcctcgccggcaggggagcgcgagtcaccgtggttaccacgcccgtcaacgccgcgcgcaaccgggccgttgtagaaagcgcccggcgggcggggctcgacgtcgaggtcgcggagatcgcgttccccggcccggggcacgggctgccggagggtctggagaacatggacctgctcacgaggagggagcacttcttgcccttcttccaggcggcgtggaagatggacgcgccgctggaggagtacgtgcggtcgctgncccggcgcccggactgcctcatagcagactcgtgcaacccgtggacnngcngaagtgtgcgcccgccacggcatcccgcgcctggtgctgcactgcccgtcccacctatttctcctcgncatgcacagnctgttccaaacacgcgtccacgaacgcgtcgccgacgaagctggaaacgttcgag

SEQ ID NO: 93208 - protein, 172 aa, Zea mays
  misc_feature: Ceres CLONE 1582390
  misc_feature: SWISSPROT Homolog: EC 2.4.1.238 Anthocyanin 3'-O-beta-glucosyltransferase
  misc_feature (112)..(112): Xaa is any aa, unknown, or other
  misc_feature (128)..(128): Xaa is any aa, unknown, or other
  misc_feature (129)..(129): Xaa is any aa, unknown, or other
  misc_feature (155)..(155): Xaa is any aa, unknown, or other
MAGLHFLLVPLVAQGHIIPMVDLARLLAGRGARVTVVTTPVNAARNRAVVESARRAGLDVEVAEIAFPGPGHGLPEGLENMDLLTRREHFLPFFQAAWKMDAPLEEYVRSLXRRPDCLIADSCNPWTXXSVRPPRHPAPGAALPVPPISPRHAQXVPNTRPRTRRRRSWKRS

SEQ ID NO: 93209 - DNA, 1173 bp, Zea mays
  misc_feature: Ceres CLONE 1582393
  misc_feature (71)..(71): n is a, c, t, g, unknown, or other
  misc_feature (1038)..(1038): n is a, c, t, g, unknown, or other
  misc_feature (1062)..(1062): n is a, c, t, g, unknown, or other
ggctcgggggggggggggcagatgcgggcctacccaaaaaaaaaggaagagggggggggggggggagattnaaaactggggctccccgcggtggcggccgctctagactagtggatcccccgggctgcaggaattcgtctcacccctagaaaaagaccccgccgcccctgtccccgtctggaccgagtgccccccgcgcgatttaagccctcgcctcgctcgctgggtccggttccctacaacgcggacaccaaacgcgcacgcggcgattggttccgcggccgctctccctacccacgtccttctccccccacagatctccgcgggccgtgaggttccttgattcgccttttccggggctgccggatctccgcggcggctggggatgggcaactgttgcgtaccaccgatcggagtcgccgaggccggccgcggctagaagcccaaggagccgaagcagaagaagggggagacgcccaccccctttctcgatcgagtatcacccgctcgacgtccggcagagcgcagccgaggcctggggggggactgccgggaagcccacagggggcggggaaattcgggggaagcgggtaccgagcattgggaggagttagcctcagtgccccgggccagggttcgggggggctcgcctaggtttcatggcagcggggaccggcgggcctccagcgggggaggggcgtcctgagcccttggcaaaggttcgcccgtttttccctaggcaaagaaaatgtcttcccggggtcccccccccgggtggggaacgcgtttcggaaggggaacccgggggcgcgcccgggtagcaatggcttggggaagaactccctttgttgatccccccacctttcgcccctaaagggggagccgcccaaaaccactttcttttttactcgccataaccgcggggaattaatccttctatcgagagggggattgcaatcagagtgtgtcccataggcacagacatctcgctgtccattggggaaagaattcctgtttttcaccacgggttgtgggggntaaaactcttcttattcgccaccncccccatttggaatgggtgcctcgcgtggggtgggacgactaatccgcgcggtaaaggaggggggacgttcctcttgtgctggtggcgagcaaacgcgtgaccgtagaggg

SEQ ID NO: 93210 - DNA, 843 bp, Zea mays
  misc_feature: Ceres CLONE 1582399
  misc_feature: Translation starting site: 192
  misc_feature: SWISSPROT Homolog: EC 3.4.21.25 Cucumisin
  misc_feature (608)..(608): n is a, c, t, g, unknown, or other
  misc_feature (614)..(614): n is a, c, t, g, unknown, or other
  misc_feature (720)..(720): n is a, c, t, g, unknown, or other
ccccgcggtggcggccgctctagaactagtggatcccccgggctgcaggaattcgtctcacccctagaaaaaacggccacgccccaccctcactccccttctgcccttcgcccgcatacacattgccccgcaagctaccggcgaacgcctagcatctgtggcgccgcgccgcgccgcctccgcctccgctgatggggatgaacaagtcacggtggtgtcgcgccaccctgctgctgctcctgtcccttgctctccgcggcgcggcgttcctgcaggagcggaagaactacatcgtgcacctccggccccgggaagccgccgacggctccgtcgacgagtggcaccgctcgttcctgcagcaggcggcggcagggctggactccgcggccgacgacggcccgcagatcatatactcctatagcgacgtcttcaccggcttcgccgcgcggctcacggacgccgaagcagaggcgctgagggccacggaacgggtgcgtgcggctgtaccccggaggtgttcctgccgctcgccaccacccgctcgccgggcttcctcggcctccacctggggaacgagggcttctggagccgctccggattcgggcgcngggtgnttggattgggatcctggacaacgggattctgcccagccaacccgtcctttcgcgacgacgggctccagccgccgccaaaggggtggaaggggacctgcgagtttcngagcatcgcccgggggccgatgcaacaacaagatcatcgggggcgcccccctttcggaaacccggcggttaacttcgaaggggtccccccgttaaaaaacccgggcccatggacgccaacggt

SEQ ID NO: 93211 - DNA, 1232 bp, Zea mays
  misc_feature: Ceres CLONE 1582400
  misc_feature (12)..(12): n is a, c, t, g, unknown, or other
  misc_feature (15)..(15): n is a, c, t, g, unknown, or other
tcgagcatagtnaangaatcagtagagttacgagcggcgcctattcttcagactatataagtataaggggtttgcaaagctggagctccccgcggtggcggccgctctagaatagtggatcccccgggctgcaggaattcgtctcacccctagaaaaagaaccctttcttcctcttcctcccccagtatactccaattcccacgtactcttcctccttgttctcctcctcctctctccctctctctcgccagaggatccaagaagtaccattgcagctcgctccattcgttcccaatcccaacacagcctctcagctgagctcagctcagctcagctcagggagttcccctgcttgtttttgctctagtgctcttggctgcctcagaaaaggactgcatgtgcagcagctgcaaagatagaatttctttatttttttcaccccaccttctcccaaggtgctgttggtgccccaggtggaggcaactggcgaagtgtgtgcgttctttgcttgatcaactaggttaagccatttctttgcccagtgtttctccgatttcagggttgggggaactagtcccgagaaatagctgggaggctgctccgtttttccctttcccaagaaagaaccaaaggcggggggggccgaagggccaaatcgtttttgaacccgggtaaccctggtttgcccccgtcctttgaaggggcaggttgcacaataataaaatgtgttggggcctcttctctctggcagattatcccgataatcaccggggctcctgtgtgggggccttttggggtaaacctcctgggtgaacaaaatatggggtgtttataaaagaggaggggtggctcagggcggattactccccagcgaaggggtgggggggtgtagataccacatataatttcgagggtgaatgtagccggccttgatgaatacaccctgaggaggcgagaaggaaataatacatgatgggacggcccacacatagggcagcgagagaagagaatttttgattgaaaatattaagaaaggagcgtagcttcatttatatccgcttttctcaggtccttatagtgttctgcgcacggcaaaacaagtaagccattagtacattcatcaaacacaagagggaggcgtttgttcgtcgtatagcaagtctggattatgagggggtgattaataaatctgtgtgtctacttatctttcagtgaggagacaaggggaata

SEQ ID NO: 93212 - DNA, 882 bp, Zea mays
  misc_feature: Ceres CLONE 1582402
  misc_feature: Encodes the peptide sequence at SEQ ID NO. 93213
  misc_feature (882)..(882): n is a, c, t, g, unknown, or other
ctccccgcggtggcggccgctctagaactagtggatcccccgggctgcaggaattcgtctcacccctagaaaaaagccactgccacgctaccaccgcttcctttcctcttcggctgctccgcctcgcctcccagttcacagcccctcccaggctccgaatcggcggccacttctcattcctcacttccgtcctcgcgcaccaccccctccatccgttccggatggtgccttcgaaatcccgtccggcgccctagcgtagctcgggctcggccaggctccgggcccgccgcgccgttccgcagtccagctccacctccagaatggtacggttagtaaattgaggttggtggtgggttggtggccatactaggggaagatcttttcttgagtataaggaagatgcttgcctttatttagaaggccctttttggtacgtcagcagtgttctttcctataggagtaaatgccattccgtagcatcgtgcgtgatgtaagggatggtttcgggagcttgtctaggaggggatttgaggtcaggtttctgagtcatcgcagagggaaatctcatgttgctgtccatgagctgcacgacacagtgcttgtggtacagagtagctgctgggctagcttgcctcctggattacttcaagatgtgattgaaaggttggagaccagtgaggatacatggccatctaggaaacatgtagttgcttgtgcacctgtctgcagaacatggagagagatgtgtacagagattgtcaagagccccgagttttctggaaaaaacccctttttccgttttccctgaagcacgcctgggcctccaagagggaaataatccagcggttttattatagaggggaataatttaccccaatctcn

SEQ ID NO: 93213 - protein, 114 aa, Zea mays
  misc_feature: Ceres CLONE 1582402
MPFRSIVRDVRDGFGSLSRRGFEVRFLSHRRGKSHVAVHELHDTVLVVQSSCWASLPPGLLQDVIERLETSEDTWPSRKHVVACAPVCRTWREMCTEIVKSPEFSGKNPFFRFP

SEQ ID NO: 93214 - DNA, 814 bp, Zea mays
  misc_feature: Ceres CLONE 1582408
  misc_feature: Translation starting site: 209
  misc_feature (650)..(650): n is a, c, t, g, unknown, or other
ctccccgcggtggcggccgctctagaactagtggatcccccgggctgcaggaattcgtctcacccctagaaaaagcgcgctgcgcggtcggtcgctcccctcctctgtccgcgatctcggctggccgcctgggcttggccctcgccccgctcccgtctccggttccggcggccgagccagatttgctcgggtcttcgtgccagcgacgatgaaggacaagcgtggactcgaggacgccggcgacgggcgccctgatgccaagaggccgcggcctccggctctggccagtgttattgttgaagcgctaaaggtggatagtctgcagaggctctgctcatcattggaaccaattcttcgtagagtagtcagtgaagaagtggagcgtgcactgggcaaacttggccctgcaacaatcggtggaaggccttccccaaagagaattgaaggtccaaatggaagaactctgcaactcgaattccgaacaaggctgtcacttcccctttttactggaggaaaagttgaaggtgagcagggagctgcaactcatggtgtttttgttgatgctggcactggctgtgatgtatcctctgggaccagagtcgtctgccaaacttgacatcgatgtttctagaaggtgatttcaccatgangatgaggagggctggaccggagaagagttcgacagtcacgttgttgaagagcgtgaggggaaaccgcctaattttactggggatctacaagtcaacttaaaagaagggggggggacaattgggggggcgtacactccccgaataactctggcctgggaaaaggg

SEQ ID NO: 93215 - DNA, 865 bp, Zea mays
  misc_feature: Ceres CLONE 1582409
  misc_feature: Encodes the peptide sequence at SEQ ID NO. 93216
ctccccgcggtggcggccgctctagaactagtggatcccccgggctgcaggaattcgtctcacccctagaaaaagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacctgtggtcccccgtgaaggcggagaagaaacgcccgaagcacccacgacgagaacgtgcagaaggtcgttgaaacggctctagccgaggaaccccaaaaaggaagggtcttgtttgcacgggccagaaaccctggaacgctgttggcctgcgccacggggaactacaaacggggccgaggcattttcaagggggaaccttttttcccttcaggaaaatcccttgaagatcccacaaaaaaaaagaatggttgccccaaaggccaagccccctttgttcacacggggtccgaaaaaacccggagcctctctcggcgcaaagaaacccttgtccccttggggagggtgggcccgaaaactcacaaaacacccccttttgtgtggcgggggtgggacaaccgggttgaccgcccacacaaggggggagcccccccaccctcctctggagccgccttctcctcccgaacaaagagaggtcacaccaaaaaggagaggggggtatctcccgccgaaaggg

SEQ ID NO: 93216 - protein, 71 aa, Zea mays
  misc_feature: Ceres CLONE 1582409
MADVHEPLVRRKRKKVLVDYLVKFRWILVIFVVLPISTLIYFNIFLGDLWSPVKAEKKRPKHPRRERAEGR

SEQ ID NO: 93217 - DNA, 859 bp, Zea mays
  misc_feature: Ceres CLONE 1582412
  misc_feature: Encodes the peptide sequence at SEQ ID NO. 93218
ggccgctctagaactagtggatcccccgggctgcaggaattcgtctcacccctagaaaaagataaccaagaacaaaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcattggatcctgtatcggttagtccttgcctgcaaggttcttgttgttttgttttggtggtcgagcatcgcatgttctgcttctggatccagatctggagaaatcgcgaagtcatcatctgtccgttcagagcggatctgaggcgacgatagatggaggcagcgggatctctcggtctgcagtgctgctccacctcgatggatgatgtctctgcgctgattcttactggatcaatttcgacaagtactaatagatctaggagaatatgccgcctggaagaagcgaggttaactgcagcctggcaaaaagagataaaaaaatgggacctcctagaagaagagggactttgccatgaatgggtgcgctcccaatggcagcccggccattattaaaagaggtatactggctgcccggggggagagaacccccccgggggtttgaagttttttgggcccccggggttctcctcccctcaaactttgttccggggttcctgttaaggcgttggcaattccgcttcccgtttggttcccccttaaaccttggccgatattgttggggctcccgagcaacggatatttcttaaaaccaaataa

SEQ ID NO: 93218 - protein, 35 aa, Zea mays; identical to SEQ ID NO: 7877
  misc_feature: Ceres CLONE 1582412

SEQ ID NO: 93219 - DNA, 801 bp, Zea mays
  misc_feature: Ceres CLONE 1582416
  misc_feature: Encodes the peptide sequence at SEQ ID NO. 93220
  misc_feature (564)..(564): n is a, c, t, g, unknown, or other
  misc_feature (568)..(568): n is a, c, t, g, unknown, or other
  misc_feature (580)..(580): n is a, c, t, g, unknown, or other
  misc_feature (583)..(583): n is a, c, t, g, unknown, or other
  misc_feature (749)..(749): n is a, c, t, g, unknown, or other
  misc_feature (786)..(786): n is a, c, t, g, unknown, or other
ctccccgcggtggcggccgctctagaactagtggatcccccgggctgcaggaattcgtctcacccctagaaaaaggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgggcctcgtggcgggcttcctcgtcgtcacctgcgcctacttctccaccgccaagttcgacgccatccagatcgccatgatcagccgacccgtctccagcaatgcggccggcgtcggagtcggctcgctgggagtgggcgccgccgccgccgacacctccaacgcctccaggcagggattagatttgggcgcgatgtccatggccntagnaggggagcgagnccntagcgctcgagaaagacggcggcaaggctttcttcacccttcggggcaggttctttggtcaggagttcctgccgctctcccttcctcccgtgttgctcgagaagccgcgaacagcacgcaggattcagccgtcctgaggacgaagagctacagttgcaggatgcanttgccagtggttccagaagagcaaagactcccgccgncaacgcagcgccagt

SEQ ID NO: 93220 - protein, 184 aa, Zea mays
  misc_feature: Ceres CLONE 1582416
  misc_feature (106)..(106): Xaa is any aa, unknown, or other
  misc_feature (107)..(107): Xaa is any aa, unknown, or other
  misc_feature (111)..(111): Xaa is any aa, unknown, or other
  misc_feature (112)..(112): Xaa is any aa, unknown, or other
  misc_feature (167)..(167): Xaa is any aa, unknown, or other
  misc_feature (180)..(180): Xaa is any aa, unknown, or other
MGMDAGGGKLPYSYAGQQDGGKLVKSVSRVEPRRFGLGLVAGFLVVTCAYFSTAKFDAIQIAMISRPVSSNAAGVGVGSLGVGAAAADTSNASRQGLDLGAMSMAXXGERXXSARERRRQGFLHPSGQVLWSGVPAALPSSRVAREAANSTQDSAVLRTKSYSCRMXLPVVPEEQRLPPXTQRQ

SEQ ID NO: 93221 - DNA, 857 bp, Zea mays
  misc_feature: Ceres CLONE 1582417
  misc_feature (225)..(225): n is a, c, t, g, unknown, or other
  misc_feature (383)..(383): n is a, c, t, g, unknown, or other
gcggtggcggccgctctagaactagtggatcccccgggctgcaggaattcgtctcacccctagaaaaagttcctgcctgtctgtcgcctcgtgacgtctgtccaagaacactcgctccccacctgttcgctgcttcttcttcttgccaatctgctccttcttctagctagatcttggatggagctggggatgacgatggaggtagcgaagatcatcgaggtatgntagagtacgcggctgctagtagttcaccaggccagcaagcgagctccagcttcgtcgatcgatagatgcgagctgtacagcgtgcagccattctcagttgtagatctagatcccccatcccgctactagttggggttagcaaatccaacaagcagganccacccgggagcgagccctggccatggattccgtttctgaaagtgggccctgggcttcgggggggtttccccccgggtttgggggggcggggcggtgttcccgggggggggcccctttccgtggccaattgggggggcagggggggggttccccttggggggggcgcccacaaccttaaaggggccccccctcggggggccttaaaaaaagagggggaaaaaaaacccctttaaccccccccggggggaacaccccccccccccttggggcccccgttttgtttttgcccccacctgggggggggggggggggggggtctctctgggagggggccccaccaaaaatatttccgcccccccctggggggggcccccccttttttttttgggaagaaaacacaggggggggggggcggggaaaccttcttgggtgggtgctccacttttggcgccggtttgttccaaccccccccg

SEQ ID NO: 93222 - DNA, 902 bp, Zea mays
  misc_feature: Ceres CLONE 1582422
  misc_feature: Encodes the peptide sequence at SEQ ID NO. 93223
ctccccgcggtggcggccgctctagaactagtggatcccccgggctgcaggaattcgtctcacccctaaaaaaacgtgtggccgcccgtgtcgtgtagtgtgtagtcgcagcagctagcgcccggccggccagtcgagtgagtccatcctccatcgccatccaatggccgccaccgccctgagcatgagcatcctccgcgcgccgccgccctgcttctcgtccccactcaggctcagggtcgcggttgccaagccgctggcggcccccatgcggcgccagctgctgcgcgcgcaggccacctacaacgtgaagctgatcacgccggagggggaggtggagctgcaggtgcccgacgacgtctacatcctggacttcgccgaggaggaaggcatcgacctgcccttctcctgccgtgcggggtcctgctcctcctgcgccggcaaggtcgtctctggctccgtcgaacagtccgaacagagcttcctcaacgacaaccaggtcgccgacggttgggtgctcacctgcgctgcgtaccccacctccgacgtcgtcatcgagacgcacaaggaggatgacctcctataattctagctagctatacaccgccagggcccgtcgtcttgtgccaccacatgcagtaccgcccgcgcaagagatgagacgtgtcgtctcaataattctagctatatatatatatgcatgcatgcaggtactttttcctgttcccaactgagtatattctaaattacaagaatttatcaccagggtttaaagcaactcccacccatgagtctcaataattggcccctttattttggatttagcaacctcactttaaattgggtttagagacctaaacccctggtttttgttttccaaaaaaaaaaaaaaaaaaaaaaaa

SEQ ID NO: 93223 - protein, 140 aa, Zea mays
  misc_feature: Ceres CLONE 1582422
  misc_feature (52)..(127): Pfam Name: Fer2 Pfam Description: 2Fe-2S iron-sulfur cluster binding domain
MAATALSMSILRAPPPCFSSPLRLRVAVAKPLAAPMRRQLLRAQATYNVKLITPEGEVELQVPDDVYILDFAEEEGIDLPFSCRAGSCSSCAGKVVSGSVEQSEQSFLNDNQVADGWVLTCAAYPTSDVVIETHKEDDLL

SEQ ID NO: 93224 - DNA, 1087 bp, Zea mays
  misc_feature: Ceres CLONE 1582424
  misc_feature: Encodes the peptide sequence at SEQ ID NO. 93225
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (992)..(992): n is a, c, t, g, unknown, or other
ttttttcgctttnnnttatttctatattctgtctccccctttcgctccctcgtttctccaagttcgcnnnnnncggggagctggagctccccgcggtggcggccgctctagaactagtggatcccccgggctgcaggaattcgtctcacccctagaaaaatagcccgggcgtcggatcatgagcgagctcgttctcaactcgactctgagctctgcctcctccaactccccttctctggcctccggagccacgctgagagatggaggctaatcccgagaacaccttcactatcacagtggaggacgggaagcccgggaaggacggccagctggcggtcggaccggtgttccggagcgttctggccaaggatgggttcccgcatgcttgagcctgagatgaacacctcatgggacgtgatcagggtagcaacagtcaagtctgccgaccacccgatgctcggatggcgtccgttcacagatgcgactgccagggcgcgtacttgtgagaacatatacgaggcagatctatcgacgagagtgctgccagtcaagcttctgcatttgcggcaagcctgcggatgtgccagccaggattccccggggctggggtattctacggggaccttaaagtgggcccgcaggctgggataagtgggccaatgtcaaaggcttggccaaaggggccttataggtttccaaggtcatggtgtttccccatactggttaatccaatatcctttttcgggattgcccggggggaaaccctggttacgcatcttaaccagtgtaggtcgggaactcattttcccggaaagaaatcgcgaagtcttgggtgcctttccacttgccccaggaagcccccgaaaaatgtgtataacaaggaattacctgtatccccccgcaaaacggtggaaagaattttgtgcccaaagcgaaaaacttgataaaagatatttggggaggggcccttttacacctgttgggctcggganaaatttttattcgggaaacgcaaatgaatagccgggtatccctatatttgggggcaactccccaaacgtaaagtgcccggtggggaaaccaatta

SEQ ID NO: 93225 - protein, 42 aa, Zea mays
  misc_feature: Ceres CLONE 1582424
MEANPENTFTITVEDGKPGKDGQLAVGPVFRSVLAKDGFPHA

SEQ ID NO: 93226 - DNA, 839 bp, Zea mays
  misc_feature: Ceres CLONE 1582427
  misc_feature: Encodes the peptide sequence at SEQ ID NO. 93227
ggagctccccgcggtggcggccgctctagaactagtggatcccccgggctgcaggaattcgtctcacccctagaaaaactgctatgctatgcttaccccgttctctctctcctccctttctttctcatctactactactagactactagtaactccgcttcgcttcttccgaagcggcgcgggcggaagcgagggcagctcacaccaccgtgccgcgcgcgcgcgctctccacccaccacctaattccgccgccgagctcgccgacgcggccacccgcgatcgggcatttggacccgtccccgctcgccgcccgcacggcggctcgttgcgggaaagtttctcgaggccgtctgtgaccccgctccctcggccgcgagatcccgcccagccgcggtcgcagaatggcgcagagcaactgggaagcggataagatgctcgacgtgtatatctatgactacctgctgaagaggaacctgcagacgacggccaaggctttcatggacgaggggaaagttgctgctgatccagttgcaattgatgctcctggaggggttctgtttgagtggtggtctgtcttttggggatatattcttcgcaggacaaatgaaaggcttccggaagttgcagcggcatatttagaggccccgccaattaaagcaagaaagcacccgccgcagatgcagatgccgcaattgcaactaatgccattaaaaaatgcttcacttccggggaattaaggcgaaaacatcctttccctaaagggggccaaaaaaggcttttaaatttcggaggggacattttgggggccacccaaccccagggggttttatagctgcca

SEQ ID NO: 93227 - protein, 111 aa, Zea mays
  misc_feature: Ceres CLONE 1582427
  misc_feature (10)..(36): Pfam Name: LisH Pfam Description: LisH
MAQSNWEADKMLDVYIYDYLLKRNLQTTAKAFMDEGKVAADPVAIDAPGGVLFEWWSVFWGYILRRTNERLPEVAAAYLEAPPIKARKHPPQMQMPQLQLMPLKNASLPGN

SEQ ID NO: 93228 - DNA, 1154 bp, Zea mays
  misc_feature: Ceres CLONE 1582429
  misc_feature: Encodes the peptide sequence at SEQ ID NO. 93229
accaaaagaggatgggagaggagttgttcctcctcctattcccgccggcaacaaaaattatagtcgtatgccggattacaaactcccgcggtggcggccgctctagaactagtggatcccccgggctgcaggaattcgtctcacccctagaaaaaagccagctcgaccgacgagacgacaacgccgccgtgccgcgcgcacgcccgacgccgacgacacgccctccgctcggccccggtgaggcagcgaacgcccgccacacgtacagataccgtgcgcgcccggcatgggggtgaccaccgccggggaggccgtctgtaagtccccggcgcgggcctcggtcatcgtgaggctcaacgccgcgttcctcgccttcttcctcttcgcctacgtggcgctcctcctccaccccaagtactcgggcctcctcgaccgcggcgccacctccctcgtccgctgcaccttccaccacccctgcccgccgccgtcgccgtcgaaccagcagctctcacggaagctgggaggcgtggcggcgaacaaggtggcggaaggaggaactcatcctgaacgcggggcggttcggcggcccatgttccaacgaagctcctggggcctggctgccggatgggggcttgggggaaacattcaggggcgccgactaagcttgcccgggcgcctttgggcgttgtggagggtctgaacgccggttggccccgtttgggaacttttctgatgcggccgtgtgcttcgggaaacgctttctctcccgcgggtgggtttctggaaactccttatttcccccccggggaggtgttgaatctcaccggaggaggagggtatgggaatgaaacggagagggggcccctggtcccctggcccccgtagaagccggcctccaagggccgggaacatgaggggcccccggtttcacggcggggtcgaacaatgtggaaacttgagtgagtttggtctgtatccccttgccatgtacaaagctggaatagttaccgccctgggtgttggaacaccccaacggtgttttggctgatcttccaccgtatatacttcggggggagcaggcgctatattgtggtgacccttctatatagggctgcggctttaaactctcatgtaggaagtagattcccttctcg

SEQ ID NO: 93229 - protein, 137 aa, Zea mays
  misc_feature: Ceres CLONE 1582429
MGVTTAGEAVCKSPARASVIVRLNAAFLAFFLFAYVALLLHPKYSGLLDRGATSLVRCTFHHPCPPPSPSNQQLSRKLGGVAANKVAEGGTHPERGAVRRPMFQRSSWGLAAGWGLGGNIQGRRLSLPGRLWALWRV

SEQ ID NO: 93230 - DNA, 1018 bp, Zea mays
  misc_feature: Ceres CLONE 1582437
  misc_feature (37)..(37): n is a, c, t, g, unknown, or other
  misc_feature (43)..(43): n is a, c, t, g, unknown, or other
  misc_feature (52)..(52): n is a, c, t, g, unknown, or other
  misc_feature (61)..(61): n is a, c, t, g, unknown, or other
  misc_feature (62)..(62): n is a, c, t, g, unknown, or other
  misc_feature (76)..(76): n is a, c, t, g, unknown, or other
tttttttttttctttttttggggtgtggtggagttancggggngggtggtgnggggggttnnctttggggcaccgngggcaaaactggaactccccgcggtggcggccgctctagactagtggatcccccgggctgcaggaattcgtctcacccctagaaaaaagcgtagtggtaggaagagagggaagaagacgaagcgaagccaaagcaaggtctgagccgtagagcggtagaggtaggtgtccgggtgggaaacctctctcgcgcgtcaggcgtcacgtgagaactcccgatccaccgggacgacggattcccgccgctcccccgcgcgcggcttcttccggtgcggtccggcagccgacggcggaagctactggcccaagcaaagtgagtgaattgcgagtccaggcggcgatggcggggcgctgcgattgacgtgcgacgactatgggcatccaagggaacaaggcggcgacgcacgagcacaacttcctctcgttgtacgccgccgccgccgccgccgccaaggacgctcctctcctgctccacgactccaagacgccgcctccttctcaaggtaatttttctcttggaagacgcacgactttcctgcagccggttcgaatcagaaagccaggaagcgcccgccgggagcccgttcgccggcttgcccggcctccaggccgtcgggaaaatcatggccacccgggcaagccaggggggggcgggtcggccaaaggcaggcggcggcggcttgtccccccttttccccctggcccccggggcggggggttccgggggacccttttccaggcattcaaggccccggccgccccccggtggttcggggatcggccccttggacccgttccgggcgccagctcgttccaaaagtccgggaagaaccccccccgccccccgtttaccgaggcactccggggggggcccaaaaactctggccataggggaaagcgtctttgttcaaacccggggggccgccgccaccaagagaggggt

SEQ ID NO: 93231 - DNA, 838 bp, Zea mays
  misc_feature: Ceres CLONE 1582438
  misc_feature: Encodes the peptide sequence at SEQ ID NO. 93232
  misc_feature (819)..(819): n is a, c, t, g, unknown, or other
  misc_feature (828)..(828): n is a, c, t, g, unknown, or other
  misc_feature (829)..(829): n is a, c, t, g, unknown, or other
  misc_feature (835)..(835): n is a, c, t, g, unknown, or other
ctccccgcggtggcggccgctctagaactagtggatcccccgggctgcaggaattcgtctcacccctagaaaaaagtagtgctgcgcatatgcacacaaagggcaggaccgcaggagcacacacctcagtgcgccagcgttctgcacctcgctagctcgtcgtcttgcctgcgctgtcgtcgctgatccttgagatctgcagactccatggaggctgcagcagcgacgacggcggcggcgcttcttcctcccgctcggaaggtgttcatcctgcccctgcttctcctcctggctgcatcgtcgctggttccacgagcttcgtctgatggagcgcaatatgattatagagcttacactgagtgcaaacctcaccctgagccagctctgtacaacggtggcgtcctgcgctgggcgagcaaaataacggacttcagaacggaggacgaaggcaactactccccggcatttgtgctctacaacatgtcggcggcgactgcgtacagcttctcttgctgggtgaaaatcgacgggccagaaagcgcacatgtgaaggcgaagatactgaccgtggagaacgcagcgtcgcagtgcgtcggcaccgctatcgcgcgcaacgactgctggtcttttctcaggggtggctttactctcaactccacgtctcaaacctcggtgctctatttgcagactgcgagcccaaatgcttctacgatctcaatcagaagcccctccttgcagcccttctcacccgatcagtggaatcagcacagggaggagcgtatcaacagatttcggagcgtttcgtgaaccctcatgtcntcgacgcanncgcagncgt

SEQ ID NO: 93232 - protein, 199 aa, Zea mays
  misc_feature: Ceres CLONE 1582438
MEAAAATTAAALLPPARKVFILPLLLLLAASSLVPRASSDGAQYDYRAYTECKPHPEPALYNGGVLRWASKITDFRTEDEGNYSPAFVLYNMSAATAYSFSCWVKIDGPESAHVKAKILTVENAASQCVGTAIARNDCWSFLRGGFTLNSTSQTSVLYLQTASPNASTISIRSPSLQPFSPDQWNQHREERINRFRSVS

SEQ ID NO: 93233 - DNA, 1325 bp, Zea mays
  misc_feature: Ceres CLONE 1582440
  misc_feature (71)..(71): n is a, c, t, g, unknown, or other
  misc_feature (497)..(497): n is a, c, t, g, unknown, or other
aaccaagggccccaaccttggggtaagaataacaccccaccccccccccctaaccccaaatccaaaaccancaataataaaactccccacggtggcggccgctctagaactagtggatcccccgggctgcaggaattcgtctcacccctagaaaaaccccgaattttctgcatatatctaaaaaaaatatcgaattacatcaaatccgaggagcagccacagccatccgtggaggcgctctacttgctgacctccctggccgcgactgtcgtcacctccgccttccactcggtcctggtgttcatacatattatacctccggcaccgcgcgccaacgctgccccctaccgatgaatgatcccggttatggttgcaccggctctataaagggcccggataccagtaccgcgcagacggggccccagagagagtaaacgcaataaaaaaatacgagagacgctacaggagcttggtgaatcgtgggagacgggtggcgncccttcgtgggcaactatatataattgaaagaaatgaaaggccccatgtatggccggcccatcttctcagtttacgcaaaggcacctttccaggaatcgggtactccaccagaacgaaggaggtggcgtataagcgcggaaaacaatatcttgaacaaactcaccgcaactgcgctgagacagtattatgcaaaggtcctacccccggaatggtttgagagaggcggtagtcagagaaagaatgcggagttcctgatgtaaagagtgacaccagaggtgccactcccgtagggattcgaaaaaaacagcttggttgagtgttcctgcacgtattagcaaattcggcggccttcctgggatagattcttggatattaccagaacacccaccctctcacttggcggacggaatcccacccgagcgtccacggaggacagacgtgtactgctatcatagctgtgtatgtgagtcattagggtgattagcagcgcagtgcaggtaccactagtcaggtcgaataatgagccgctggcatgcgccatcgactcatcgtgaggtttacagtgaggatgcactgccgctcagcgaattgtcgtccgcgaggtccacgaggtctcagtagaggcggcgtgtgagcgcgtccctctaatagtggcgcacggatgacaggcgctgtaggacgggattggaagtataacgcgccatctgtgtgagcagcgcaattatgccgtcgagcgcgcttgagtgcaccccgatgtcggtagtggacaaaggatatgacctcgggcgatcagatgcatggtaatgtgaacccggatcgcggacgaa

SEQ ID NO: 93234 - DNA, 547 bp, Zea mays
  misc_feature: Ceres CLONE 1582446
  misc_feature: Encodes the peptide sequence at SEQ ID NO. 93235
  misc_feature (377)..(377): n is a, c, t, g, unknown, or other
  misc_feature (386)..(386): n is a, c, t, g, unknown, or other
aagcgggagctccaccgcggtggcggccgctctagaactagtggatcccccgggctgcaggaattcgtctcacccctagaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccacccttgntcctcgccntcagggggaaggcatggcaagatctttccgtcaaggacccctcccctgggaaaagacctattcaccccctccgaagggggggaaagtccttttggaacccccatttcgaaaaaaacgtttcaagggggcccaaaaaaatccccgggggaacaaaggggggt

SEQ ID NO: 93235 - protein, 126 aa, Zea mays
  misc_feature: Ceres CLONE 1582446
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (70)..(70): Xaa is any aa, unknown, or other
MQIFVKTLTGKTITLEVESSDTIDNVKAKIQDKEGIPPDQQRLIFAGKQLEDGRTLADYNIQKESTLHPXSSPSGGRHGKIFPSRTPPLGKDLFTPSEGGESPFGTPISKKTFQGGPKKSPGEQRG

SEQ ID NO: 93236 - DNA, 1261 bp, Zea mays
  misc_feature: Ceres CLONE 1582447
  misc_feature (12)..(12): n is a, c, t, g, unknown, or other
  misc_feature (29)..(29): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (78)..(78): n is a, c, t, g, unknown, or other
  misc_feature (80)..(80): n is a, c, t, g, unknown, or other
  misc_feature (1143)..(1143): n is a, c, t, g, unknown, or other
gtgggggggggnccccctttttttattgncccacccacaacctttgccctctttcggcttaaannnnacctnnntttntnctaagctggagctccccgcggtggcggccgctctagaactagtggatcccccgggctgcaggaattcgtctcacccctagaaaaatcgctcccttgttctctcccgagccgtccgcgaaccaacccgtgctacctccgattctgagcctgctcatgctctctagaacctcggtctccgcctaatcccttgatcggggtcaagcctcgaactagactaggagaggttccatccgccgcccgctggagggagatgggcgctgggacatgagcctgggcctcgccgttccacctccgggggggcggaaatccttctccccgatcaagcttctccggcacccgggcgcaagtaagttcattggtggcccttcaccgttcttgtacccccccaccaaccggggccgagtggccgtggaaccgtaataaacatcccacccccccccccaacttcttggtgtgggggggattgtggcggccctgccccgcagtaatgagcaactatgtgcctccctggggcggggggcggcggatgtggggccgtgagccctgcggtacccaaaggtagattatcggctgttttttctcagcgtgggattctccccggggggtgttcgccggctagtcgccctgcggaggagaaggggggcgccctccctacttaatttgtgtcgagttatatggtacataggcaagtgtttgtggctcccttcggctggtacgtacgtgcaatttgtgctatttgaaactataaatgcgtggtaatctcgcggtgtggtgggtctcttctgggtatctaccctccttctctgtggtagcgagttatggctggtgaatgagggtgggggcgctagcgaaaggtgctgctcctgtctcttgtaactatcccaacaatcaaaatattttcttctcggggtgccgtcgtggttctacaaaatatatatggtgcgcgccgtgaatgagcgagacaccaccattcacccgagctcctctaaaatataactgccctcccgggctctggccctctgctatgttatcttctccgggtggcacaccgacgcgcggtgcncggcgatgatgtcctaaaatatatggcatagaagttaagacagagatagcctgtttgtgaacgacactcctagatgtgtataggggggggggtctcacgattgcaactatcctgtgtc

SEQ ID NO: 93237 - DNA, 1226 bp, Zea mays
  misc_feature: Ceres CLONE 1582450
  misc_feature: Translation starting site: 253
  misc_feature: SWISSPROT Homolog: EC 3.6.1.1 Inorganic diphosphatase
  misc_feature (995)..(995): n is a, c, t, g, unknown, or other
  misc_feature (1037)..(1037): n is a, c, t, g, unknown, or other
tttgtgtggttaagaatgtaatataattttaataatcttcgtgtcatattataaccaataacaaacacgcccctttcataaaataaaaaactcaccacggtggcggccgctctagaatagtggatcccccgggctgcaggaattcgtctcacccctagaaaagtgcagagcgagacgcgtcgcctcctcccttcccccaccccgccgccgccctcgcgtccgtccgtccgttattagggttcggtcgccgccatggcgatcctctcggcgctcgccaccgaggtgctcatccccgtcgccgccgtcatcggcatcgcctttcccgttcgtgcagtgggtggtcgtgttccgccgtgaactctccccggccccgtccggcggcaacggcggaaagcccggctaccccaaatccctcttcgagaaggagagggggttaaagaaccaaaagttttcttcaagtggcccaaaaacaaaaaaccccccccccaagggagcaaacttgttttttttttccccaaaaaccaaaaatgggggggattcctcccggggctccccctccggggggggagaaactcccccccctcccctgtggtccgggggggggggggtttcccccccaaaaaaacacccccccccccgtctctttttttgggggggggaaaattttcttttggggaggtgggtgtgttggtttttcgtggcggcgccccttttttaaaacagcggggggggtccccttttctttggtgggtggggaagacgaaccaccaccccccccccgggggggtgccctgcgggtgtgtctttcttctctgggtggtgatagaaagaatatagaccccctcccccctatttagtggtagaatgagcatccacaaaccaacccccttcccccttcctagaaaataggtagagatggggggtgggtgggtgagaatataaacccaatatatttatattatttctgttctttcttctcacctcacacccagggnaaaaggattgaagtgggtgtctatgtctcctcgccctacttngacgaagaagagagggatggtgtttgttctctcctcttcgcccacacctatagatgcaataatctctcctatgctatgtcaataatacggaaccccgcgggcggcgggtttgtttttttgtttctctccccccccccatgtattgtgtgtgggggagggggtgatacctcatttcactttaaaaagaag

SEQ ID NO: 93238 - DNA, 826 bp, Zea mays
  misc_feature: Ceres CLONE 1582451
tccccgcggtggcggccgctctagaactagtggatcccccgggctgcaggaattcgtctcacccctagaaaaaccaggtacgagcggggtaggcaggcgtcacgaaacggatcagcaaaccccgccggcgcatccgaggagatccgacgtcggcgcgatccagggccgcctcaacggcggcggcgcggcgtctcctcctagccctcgacgtcctccccgcctgcctcggctcggagccgctcggggcctgcgcgctgcactcgctcggcgtccggggcgccaaggcggccgacagggacgctgccgaggacctcgacgcatccaacttcaccgccttcctccagacttctccagagtcgttcacggtcatcgaattcttcgcccactggtgtcctgcctgcataatctacaagcctcactatgagagggttgaccaactttcctatggcccagatgctgcgcatcctgcgaccgttgtgatggcccaaactgattgtacgtcaaaggggaacgcggatctttgcaactaactgtctgtggaacattacccttagcagtggtgggcgtcggccgacatattcaatttggtgctctggacaccatagcaagagaatgtggaaatcggcaactaattgatgatggaagaacacccgatccgtcactgaaatggatcaataagaagatggggagctcatttcattttgaacgacaaaaaggatgagaattgaatggatgcacccccaatgataccttcgaatccatgatcgaatttgctccaaacacttttttgaccggtggaggaaacatacattcccagtgccatggg

SEQ ID NO: 93239 - DNA, 1082 bp, Zea mays
  misc_feature: Ceres CLONE 1582452
  misc_feature: Encodes the peptide sequence at SEQ ID NO. 93240
  misc_feature (803)..(803): n is a, c, t, g, unknown, or other
  misc_feature (1082)..(1082): n is a, c, t, g, unknown, or other
ttttcttattttccttccattagaagaaaccctaacctcacctcaatcaaataaaaaagaaatgtatttaaaactgggactccccgcggtggcggccgctctagaatagtggatcccccgggctgcaggaattcgtctcacccctagaaaaagaccctcccgccccgcggctcgtctccctctcacggtctcacctcacaacctcacggtcctcacctcactccacctcgttcgccgcctcgctgccgcgtcgggccagtgcgtgcgtgggggcgggcgtgagtgactggctctcctcggcgcgcggacccaggggcggcggcgatggggaagaatatgcgcatcaagacggcgcccaaggcgaaccgtgtccccctcctcggcgacggggagacgtcaagggcgctctcggacctggaagagggcagcgacgtccagccagcgaacgtcggcttctgtcgggtcatcaaacttgcgaagcatgacgccggaaagctggtcctcgccaccgcggcgctgctcgtcgcctccctcagcaaccttctcgtttcccaaatatgggtgggaaagataattcgacattgtggtcaagagatgtttcgggcacccagaaaagaataagggcgccaaggcccttgggaagggattgttgaaagggccccaaattttttggtatcaatttggtggaacaaattcgatccttaaatacgggtcttcaatttttggcaacgaggcctactattccggggtacatgaggcacaaattacaaaaattctatggcctaaagaggaagagaaaagancaatttcgcttcccgaacctaaaggggaaagagaaccagggtttccaagtccaacgctcccgaataaatccacgtgtaacaactcggcgcctcttttgttggaatgtttcaccccccaaaacaagcgaagtaagtcttctttaatagcagggggctcttttcttgtaaaaatatccccgaaacttaataacacaacaataggcctgtcctaaccgacccatacccttatattaaagggtcacattggcccaaggggtcaacttataagaacggtttttn

SEQ ID NO: 93240 - protein, 98 aa, Zea mays
  misc_feature: Ceres CLONE 1582452
MGKNMRIKTAPKANRVPLLGDGETSRALSDLEEGSDVQPANVGFCRVIKLAKHDAGKLVLATAALLVASLSNLLVSQIWVGKIIRHCGQEMFRAPRKE

SEQ ID NO: 93241 - DNA, 1245 bp, Zea mays
  misc_feature: Ceres CLONE 1582455
  misc_feature: Encodes the peptide sequence at SEQ ID NO. 93242
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (23)..(23): n is a, c, t, g, unknown, or other
  misc_feature (92)..(92): n is a, c, t, g, unknown, or other
  misc_feature (98)..(98): n is a, c, t, g, unknown, or other
  misc_feature (1048)..(1048): n is a, c, t, g, unknown, or other
nnnnnncccccccnnnccccccncccccccccctccccgaaccccagacaagaaacaccattccctcaaacgaaagtagtggcgcttctccnccaatntggagctccccgcggtggcggccgctctagaactagtggatcccccgggctgcaggaattcgtctcacccctagaaaaaagaaccagctccaacccaaccagaaccagctcgccccggccgccgcgaccgtcccccctcatcgactcgaggcaacgaagcggccggatgggagcagcagcctgaccctgacgcgatgagcccgcccgccatgctgctgcccgtctgctccgccgcgcccagctgctcccccctctgcccggtgacggcctcgcacgtcgtcgcgcgggtggcgcggagggtggacgtcggcgccgcgctcaggtcctacgccgactcgctcgtcgcgcaggtgcccgaccgcccgccgctcgccgactcctccatactctccccctacatcgcccgcgccgagacgacatcgtcgcgtagccttcgggcgcccccccgcctccgaagcttccccgccgcctcccccagtcgcccggacccccaaggccccttgggggcaattggtttggcaacggggagcagccgggtacccaaggccccggcttgtggcgggggccatagttccgaccacggaaacctctgggggctcccgccaaataccctgagccccgagtggaggggttcaaaaactcgtcagtggtggactttgcacccaatacccctgcgataacatccccccccacgctcacgaggagaaaagaccggaggtggggcgccccctctctgggcgttcccagcagaaatacgcaccctggcccgcggatatatctcgcacaccacaatgacaagagagcggatatcgaccccccgcagggtcagtgtgagaaagagggcgagagtcccactaataggacgcctcccaaatgaggagaacttctccgcggatggagccgccaaagacggcccctccactctctcgataagaagagaggatcgcagnggctattagcgacacaggttcctttctccactaagggcgaggaataagaatagtcagcgtctccaaccagaagaggcccctacccgaacataggcacggagaagacgtcggtctccgccgttatagaaacacagacctccgggtggacctcgataagagaaaaaaacggcgccgcaaaaccttcaagtatatcgggc

SEQ ID NO: 93242 - protein, 156 aa, Zea mays
  misc_feature: Ceres CLONE 1582455
MLLPVCSAAPSCSPLCPVTASHVVARVARRVDVGAALRSYADSLVAQVPDRPPLADSSILSPYIARAETTSSRSLRAPPRLRSFPAASPSRPDPQGPLGAIGLATGSSRVPKAPACGGGHSSDHGNLWGLPPNTLSPEWRGSKTRQWWTLHPIPLR

SEQ ID NO: 93243 - DNA, 1172 bp, Zea mays
  misc_feature: Ceres CLONE 1582457
  misc_feature (12)..(12): n is a, c, t, g, unknown, or other
  misc_feature (30)..(30): n is a, c, t, g, unknown, or other
  misc_feature (34)..(34): n is a, c, t, g, unknown, or other
  misc_feature (45)..(45): n is a, c, t, g, unknown, or other
  misc_feature (57)..(57): n is a, c, t, g, unknown, or other
  misc_feature (578)..(578): n is a, c, t, g, unknown, or other
  misc_feature (871)..(871): n is a, c, t, g, unknown, or other
  misc_feature (1056)..(1056): n is a, c, t, g, unknown, or other
aaaccaattttnccccaccctatcctagtngatntacaaatacangaaaactacgtngggggtggtagtgtgtgaaagctgggactcaccgcggtggcggccgctctagaactagtggatcccccgggctgcaggaattcgtctcacccctagaaaaaaaaactgactgattgtctgattgtgattgcggcagcaccgccgaccacgagcccgccgaaaggctcctccgcctgccgttccagggtgctctgccgccattgctcatctccccgtggtgcggaggtccacccgggcgccaattggtctcctctttcgttggcagactgagtggcatccaatcctgaatcaatgacgggctggggtttgctcgtgttatcgctacgtgttctttcgtgcctggttagtggcgttgcttctggtcgaaccagctcttgtgtgcgcactgagttcccatctacagatatacctctacaaagtgaaccgattgctatgccactgggatacattgctcctcagcaggtgcatatcactcacggtgattaattaatggaaaaggcggtaatgagtaactcggggtnaactatctaaaagaactatgagtcccatgtcgaaagattttttatctggcctaagggagacagcttaataagcacccagaaaaagcctgaacaggcaaaatacaacccaaatcttactacagtgaatttaccgaatttacccacattcttgtgggatttcccttccccgcgccatttgggccccaaatggactccgtaataggggacactgtggggagctggtattaagcagcttctaacagagtagcttaagtttcaacaaaagaaatttggtggcaccacctccgggaagntatagtatgataggcctgccgaagtacaaatttcctggggtgttttcacacaaaaacgaggcgcttacccagcagagtaccgtgactatccctagtaaagaccaaatactgatagaacaataggtgttagggactctcccgtttagatgctcgctcttttcttgtggaaggcagaaaagacatangattgattctgtgagtacagcgacagattttttattatagctacttatgtacacaacgaaaaactggtgtaggtgttcagatcatgcgcactcctcattttgttatgtggggaaag

SEQ ID NO: 93244 - DNA, 1101 bp, Zea mays
  misc_feature: Ceres CLONE 1582458
  misc_feature: SWISSPROT Homolog: EC 2.7.11.1 Non-specific serine/threonine protein kinase
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (49)..(49): n is a, c, t, g, unknown, or other
  misc_feature (53)..(53): n is a, c, t, g, unknown, or other
  misc_feature (71)..(71): n is a, c, t, g, unknown, or other
  misc_feature (76)..(76): n is a, c, t, g, unknown, or other
  misc_feature (77)..(77): n is a, c, t, g, unknown, or other
  misc_feature (313)..(313): n is a, c, t, g, unknown, or other
ttgctgtttttnnnnnntagacggtttgggtgtaatttgtttattgttntttnttgtttatgtaacacaanttttnnccaaaactggaactccaccgcgtggcggccgctctagaactagtggatcccccgggctgcaggaattcgtctcacccctagaaaattgccagcctcaaggcgctgtttctgcaacagaacctgctctccggccccatcccgacgggaatccagaagctcggcggcctcgagcgcctcgtgctctcccacaacaacctctcgggctccatccccttcgcgctcaacaagctcaccgncgctgcgagtgctcaagctcgacggcaaccacctctccgggagcattcccagcatcagcatcgcggggctcggcgccttgaacgtctccgacacaacctcaacggctccatcccccaaatcgctctcgcacttcccgcgggaatccttcgccggaaacctccgagctctgcgggggacccgctgccgccctgcaagcagctccgttctttccccccagccaccattcgccccgggctttaggcccctggcccccccgaaccgggctccctcccaagaagacgggaaagctccttcccggcgcccgcaaatccgccggggcaatccttccattggagcaggcccttgggtttggttgggggggcttcccctccctacccttcaaattcagcccgttccctggagatatcttgatccccccggttagtttccaaaaaaacccttccctggataatcgcacccgcgggcacccgcccttttgtaaaggggggtgccccacaaaggggaccccccctaaaccttattgatttcccccccatatacgtctctgtgcacaggccgggggttttcctcgggaaacccgtaaccctgggggtgggcccaagaccccccctcgtcccgggactttccccctgccaaaaaaggaccgacctggccattaaaaaccatccttttctatctcaagaggaagggaaccctccgtaagtgagcggggggaccaatccggggagttcttagcccctggtggccgtctttcattcctccctgtgtggggaaggggatggtagcc

SEQ ID NO: 93245 - DNA, 842 bp, Zea mays
  misc_feature: Ceres CLONE 1582459
  misc_feature: Encodes the peptide sequence at SEQ ID NO. 93246
  misc_feature (457)..(457): n is a, c, t, g, unknown, or other
  misc_feature (488)..(488): n is a, c, t, g, unknown, or other
ggcggccgctctagaactagtggatcccccgggctgcaggaattcgtctcacccctagaaaaaccctagaaaaatatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaggaagtctcatcctacctcaagaaagttgggtacaaccctgataagattgcctttgttcccatttctggttttgagggtgacaacatgattgagaggtccaccaaccttgactggtacaaaggcccaaccctgcttgaggctcttgaccagatcaccgagcccaagaggccttcagaacagcccctgcgtctgcccctcccagatgtgntacagattggtggtattggaactgtaccggntggtcgtgtggagactggtgtcatccagcctggtatggttgtcacctttggtccactgggctgactacccaggtgaattctgttgagatgcacaccgagcgcttccagaagctctttccgggtgaaatgttggctttcacgtgaaagactttgctgcaaggatcttaaccggggtttggggcctccaatcccaggatacccctccaaggaggtgcccatttaccctcccgggttttttatgaaccacctcgggaaaatggcaaagggttttcccccgggtgggacggcccactccccaatttggtttaaatttgtgaatccctttccaaaatacaaaggggtttggaaaggact

SEQ ID NO: 93246 - protein, 125 aa, Zea mays
  misc_feature: Ceres CLONE 1582459
  misc_feature: SWISSPROT Homolog: EC 2.7.7.4 Sulfate adenylyltransferase
  misc_feature (95)..(95): Xaa is any aa, unknown, or other
  misc_feature (105)..(105): Xaa is any aa, unknown, or other
MICCCNKMDATTPKYSKARYEEIVKEVSSYLKKVGYNPDKIAFVPISGFEGDNMIERSTNLDWYKGPTLLEALDQITEPKRPSEQPLRLPLPDVXQIGGIGTVPXGRVETGVIQPGMVVTFGPLG

SEQ ID NO: 93247 - DNA, 836 bp, Zea mays
  misc_feature: Ceres CLONE 1582460
cccgcggtggcggccgctctagaactagtggatcccccgggctgcaggaattcgtctcacccctagaaaaaatttgtccccacacgcgagtaaaattctacatcacctcgaaagggagcggcggcggctgcggcggttactcatctgcggcgcctcttcgatgctgtttgctttgccaaggcctttgatcccagatggggatctcgatccggtgcatacttccaccaccagacatcgccacaggccgtgctgccgccacccccccatgggcgtgctccgacgctgcagacgtatctctcgctggctggttacgactcgccggagcaagacgggtcgcctcctgacacacaggagccgctgtcaaaatcttacgcggggcatgaatgcgccacacagagcgccagctcacgggagacttggcctgaggagcccggccagagtggaggcggggacgctcctcccgtggcatcaccaacgataactgcactgaggatagctgataataaggagaatgaagtggttggtaatggcgtcccccagctgcaaggctttcggaatggatcccaagtgctggcgggatgactctcagggaagttgcttgtgaccagggtgggacctccgttgctgataagaataaaggtactaaaccatagagcttggtggaacaaaaacccatggcgaaatctgcaaagggaattctttggaaggggacttgggggggtctctcccccaggaattcggaggaaaatttcctgttccccccggtcgaaaaaccttttcttttccaaaggggaaggggtttttcgaattctataacaccctctgaggcccgcatg

SEQ ID NO: 93248 - DNA, 810 bp, Zea mays
  misc_feature: Ceres CLONE 1582461
  misc_feature: Encodes the peptide sequence at SEQ ID NO. 93249
  misc_feature (303)..(303): n is a, c, t, g, unknown, or other
ctccccgcggtggcggccgctctagaactagtggatcccccgggctgcaggaattcgtctcacccctagaaaaacctcctctccactctctcttctccctccaataattctctccacccctgcgttgctgcagcttcaagcactaccgaaatcaaggcgagtgggagcagaggagggaatcccatgtctccgcccctcgctgagagcagatcgttgtacgagccgacgtggagctgctgccgtagaaagctagcggagcctgcgagctagcctgatccgtccggcagtccgatcggatcaggntggtggggaaagcgccagagccgctgcggctgacccgggcgctgagcatccgcggcggtgactgcggctgggttcccgaggagatgctgcaactcgtgatggggttcgtcgaggacccgcgccgacgggatgccgcgtccctggtgtgtcaccggtggcacctcgtcgacacgctctcgcggaagcacgtgaccgtgcccttctgctacgccgtttccccggcacgcctgctcgcgcagttcccgcggctcgagtcgctcgcggtgaagggggagccccgcgcggtcatgtacgggctcatacccgacgactggggcggctacgcccgcccgtggatcaccgagctcgccgcgccgctcgagtgcctcaaggcgctccacctcctacgcatggtcgtcacagacgacgatctcgccccagctcgtccgtgccagagggcacatgctgcaggagctgaagctcgataagtgcacgcgcttctccactcatggactccgcatcgatgcc

SEQ ID NO: 93249 - protein, 127 aa, Zea mays
  misc_feature: Ceres CLONE 1582461
MLQLVMGFVEDPRRRDAASLVCHRWHLVDTLSRKHVTVPFCYAVSPARLLAQFPRLESLAVKGEPRAVMYGLIPDDWGGYARPWITELAAPLECLKALHLLRMVVTDDDLAPARPCQRAHAAGAEAR

SEQ ID NO: 93250 - DNA, 812 bp, Zea mays
  misc_feature: Ceres CLONE 1582462
  misc_feature: Encodes the peptide sequence at SEQ ID NO. 93251
ggagctccccgcggtggcggccgctctagaactagtggatcccccgggctgcaggaattcgtctcacccctagaaaaaaacacaaagccaaagcgcagcgcagccagagtaagcagagagttgcacttggggaaaaaattaccgtgcttcttcagttcttcttcctagcatgcactcgcttgtgaggcgtggcaatggctacggctacggctatggtggttacggcaccagcaatccccatatgaactaccaccgccaaaacaccgagtccgtgtccaccgtcgtcacggagatgaaccgaatggccgtcgacgacaagccctgctacggcggcggcgtgcagaagcaggcctgcaaggtggaggcgttccaggagcacgacgaagcgtacaagggcgccgtggccgtgcagcagaagcactcctccttcaaggaggacaaggaggaggtgcgcggtgctgctgccgccgtcagaagctggcacgacgagttatacaaggaggaggaggaggagaagcacgtcgtcgacacggagtacagtgcccgctacgggggtggcgccgccgccgtgaagaagccgggctacaactacaagcagcacgaggcatacggggagaccgaaggtgcagggtacggctactgcgcctgcgccggcggcgtgaagaagcaagcaagctacatctactcacaggaggcgtgcggagagagctacggcggcgctcaccacggaggtgcccgtgccgccgcggaaaactacgccctacgaacagcagaaggtcctacagcacaagaacccggctaggggcggggta

SEQ ID NO: 93251 - protein, 210 aa, Zea mays
  misc_feature: Ceres CLONE 1582462
MHSLVRRGNGYGYGYGGYGTSNPHMNYHRQNTESVSTVVTEMNRMAVDDKPCYGGGVQKQACKVEAFQEHDEAYKGAVAVQQKHSSFKEDKEEVRGAAAAVRSWHDELYKEEEEEKHVVDTEYSARYGGGAAAVKKPGYNYKQHEAYGETEGAGYGYCACAGGVKKQASYIYSQEACGESYGGAHHGGARAAAENYALRTAEGPTAQEPG

SEQ ID NO: 93252 - DNA, 837 bp, Zea mays
  misc_feature: Ceres CLONE 1582464
  misc_feature: Encodes the peptide sequence at SEQ ID NO. 93253
  misc_feature (501)..(501): n is a, c, t, g, unknown, or other
ctccccgcggtggcggccgctctagaactagtggatcccccgggctgcaggaattcgtctcacccctagaaaaagccgcgccgcgcagtgcagaactgcgcaggtgcactgtgcagagtgcccgagacacacgacgcgtcattctgttccgctcccccttcatttccgcgtccgctgctttggcttcgcctcgcggtcgcccagtcgcagcagcaacaccgcccccggcctcgctttgcagccccctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgttcgtctaaatcccctgtgataagcaccactgctcgtgatgcattcttcggaaaataaactgggttggaatgagacctctatggngttggttcctgtaccaaaaagaccagctagacctgatgcttcccaccaatgcaaatctgattcctttatgaagcgatcaccaaggaaagttagaaatgctactctggcaaaaagcataaagagcaaataccactatagtcccctcaaacagcgggaagggttcagattctgttccttggggaaatcgtaacaggactaacccgcaaggaaaagaagaaaaaggaaaatccaatttcagacgaagccactcgttttggaacgaagagcgagatattttctattcaagataaaactggagcagaatttgctagatgcttactctggaggagggagggc

SEQ ID NO: 93253 - protein, 78 aa, Zea mays
  misc_feature: Ceres CLONE 1582464
  misc_feature (16)..(16): Xaa is any aa, unknown, or other
MHSSENKLGWNETSMXLVPVPKRPARPDASHQCKSDSFMKRSPRKVRNATLAKSIKSKYHYSPLKQREGFRFCSLGKS

SEQ ID NO: 93254 - DNA, 924 bp, Zea mays
  misc_feature: Ceres CLONE 1582467
  misc_feature (351)..(351): n is a, c, t, g, unknown, or other
tcaccgcggtggcggccgctctagaactagtggatcccccgggctgcaggaattcgtctcacccctagaaaaagcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctgttgaacactttctgacgctgctgctggtgccggtgatggccgcacggcgctggaattgggnccccctcgccccggcgagctgcttttgttggggggccccccccaattggacggggccaaattcccttggtgggggttccggggggttttttctcgggccccggtattttatttttcgggccccaggccgggggaacttgggggggaaatgccttgtgtaaaagcccccccgcacggtgggccgggggggccctctttgccccctctttttggggggggaacaacctctctttttttgggggtaaaaaaaaaaaaaaagggggggggcttcttctgcaacaaaggaatacttctaaaaaccccccgcgggtgcttttgagaaaaaaaaaaaaattctttttctccccgccccaaaaaaaaaattttttttttttgcggccccaaccaccttccaatgggggggggtttttgttccgcccacgagaagcgccacattccttatttttcttttgtcccccaaaaaaaaaaaaatccttttctttcgcgcggggggggtttttccccacgggagaaggggatttttctccccctcctgaggaaggagggggttttttttacgcgcacacctcccccc

SEQ ID NO: 93255 - DNA, 883 bp, Zea mays
  misc_feature: Ceres CLONE 1582473
  misc_feature: Encodes the peptide sequence at SEQ ID NO. 93256
tccccgcggtggcggccgctctagaactagtggatcccccgggctgcaggaattcgtctcacccctagaaaaaaccaccaggcaccagcatagatctcgtgctcgccactattattctgcacagcaacgcatcagccttctggaaccatctcgccgccgccacaccacaatccacaacccgtcgaagcgaagcaagcaatggccggagtcggatcgaaggccctcgccgttgccgccgttctggcggccgtctccttctcggtggccgccgcggccgaggcgcccgcgcccagccccgtctccgccgccgtcgcggcgtcgtcgcccttcgccgcggctctcgtcgcctccgccgccgccttcctcttcgccgccgtccgccactgagccgatggggcctcgtgcctgcaggctacctagcagtacttcccccgccgccgccgccgccgcctagatctatttattggagtgctattcagtagtactagtagtagtgagatttgttcggggctgtcgtgtcgtcgtcccaatttggtcggatctggtttccttggtgcagggagggtttctatccatgtcgcggtgtcgggtgtgtgatctcaccccccccttgtagatagaactctgctatcccgtcgggaacgtgagtggggatttggtctggttgaaattggccacggaaatgggccccatttgagaaaaaaaaaaaaaaaaaaaaaagaacgccggggccccctcttcgggttttgggccgggccggtccggcttcaccaaggtctccaccaatcaccagaaaggggggggctcttttcttttctcggccaaaaacaaggccggctaattggaagaagggggaaaaatggccggggggggctaaaaaggc

SEQ ID NO: 93256 - protein, 62 aa, Zea mays
  misc_feature: Ceres CLONE 1582473
MAGVGSKALAVAAVLAAVSFSVAAAAEAPAPSPVSAAVAASSPFAAALVASAAAFLFAAVRH

SEQ ID NO: 93257 - DNA, 1052 bp, Zea mays
  misc_feature: Ceres CLONE 1582474
  misc_feature: Encodes the peptide sequence at SEQ ID NO. 93258
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttttnnnnnnncaaaaactggaagctccaccccgggtggcgggccgctctagaactagtggatcccccgggctgcaggaattcgtctcacccctagaaaaagccgcaacgaattcccagtctccagccaaccaccgcagacaagatcctctcttccgcgtccccaaaccctcgagttcgcacgggctccggccagattcgcgcagtctaagcttcgaatcggcgcatggaggcggcagcagtagccgcggcgctcaggtcgcctaccgccaccaccgccgccgccgccgctggccccacgtggcggcccgctgccccgggcgccgcctcgctcgcctttgacgggagacgcagctttccctttcgggctccgtcaaggggttctcggggcggcaagcagcagcttcaaccttctaggtcctaccttaggagggcgaaaaaccattgtgggttcaaggggcaacccctggggcccccccctcccgaaaaatttttttggcccaccccggttcttttctcccaaaaaaactgccccccctccttccccgggggggtgggggagaaattccccccccggggggggggggggggaaaaaaatatttatttttttttggaaaaaaaaaattttttgttgggaaaaaaaaaaccccccccccccgaaaccctgttttggggggggggnnnnnnnnngcgcccccctttttttcaaaaaaaaaaaaaaaaaaaaaatcctttttgggggagaaaagacccccttcccccaaaaaaaaataaaacccccccccgcggggggggggccgccaaaccctgggggggggaaaaaaaagggtggttttttttttttggggggggggggggtggttttttttattttgtgtgtggaaaaaaacaaaaaa

SEQ ID NO: 93258 - protein, 182 aa, Zea mays
  misc_feature: Ceres CLONE 1582474
  misc_feature (153)..(153): Xaa is any aa, unknown, or other
  misc_feature (154)..(154): Xaa is any aa, unknown, or other
  misc_feature (155)..(155): Xaa is any aa, unknown, or other
MEAAAVAAALRSPTATTAAAAAGPTWRPAAPGAASLAFDGRRSFPFRAPSRGSRGGKQQLQPSRSYLRRAKNHCGFKGQPLGPPPPEKFFWPTPVLFSQKNCPPSFPGGVGEKFPPRGGGGGKKYLFFFGKKKFFVGKKKTPPPRNPVLGGGXXXAPPFFSKKKKKKKSFLGEKRPPSPKKK

SEQ ID NO: 93259 - DNA, 828 bp, Zea mays
  misc_feature: Ceres CLONE 1582478
  misc_feature: Translation starting site: 453
  misc_feature: SWISSPROT Homolog: EC 6.1.1.6 Lysine--tRNA ligase
  misc_feature (224)..(224): n is a, c, t, g, unknown, or other
  misc_feature (627)..(627): n is a, c, t, g, unknown, or other
  misc_feature (794)..(794): n is a, c, t, g, unknown, or other
  misc_feature (828)..(828): n is a, c, t, g, unknown, or other
ctccccgcggtggcggccgctctagaactagtggatcccccgggctgcaggaattcgtctcacccctagaaaaactaccactctactaccaccacacctgcgcctccacagtccacactcaccgcgtctcattttgttctgcgttcttccgctcgccccctcacaacgaaacctagagagtcccgcgcgtgacatggcggacggcgcgggctcggcgtctggtnctggtggagaagctcgcggagctttcaacgggcagcgccgggcagaatcctccgccggcgggtgaaggcggagaggagctgcagctctcgaagaacgcgaagaagagagaggagaagaggaagaagctggaagaggagcggaggctcaaggaggaagagaaaaagaacaaggctgctgctgctgctagtggaaagcctcagaaggcatctgctgctgacgatgatgacatggatcccactcaatactacgagaataggctcaagactcttgattcactcaaggccgcaggtgtaaacccctatccacataagtttccagttggcatctctgtagtggaatacattgagaagtacaagaccttgaacaacggggagaagcttacagatgcgacagaatgtttangctgggaggatcatgaacaagagaacatcatcatctaagctattcttttatgatcttttatggtgggtggcatgaaggttcaagtgatggctgatgcccaggacctcagaagtggatgaagctgaactctctaagtaccactcaagtgtgaagcggggtgatattgntgggcatatgtggttatccaggaaaaagcaacgn

SEQ ID NO: 93260 - DNA, 1270 bp, Zea mays
  misc_feature: Ceres CLONE 1582482
  misc_feature: Encodes the peptide sequence at SEQ ID NO. 93261
  misc_feature (913)..(913): n is a, c, t, g, unknown, or other
tgttctttatttgtttttatgttttctcttgttgtcgagttcctcccctctcccgagtttagagagaaggtggtatatactggactcaccgcggtggcggccgctctagaatagtggatcccccgggctgcaggaattcgtctcacccctagaaaaagtccctccctcgtcacatttgccgcccgtcgccatggggtgttcgtgtcctccgctcgccgacgccgcgtgcctggccctgcttcttctggcctcgtcgctggcgtgtcgccaccacgggtgcgcggcggccacgctgtcgacggcgtcgcggtgggtagtggacgagagcgggagccgggtgaagctggcgtgcgtgaactggccgtcgcacctggagccggtgctggcggaggggctgggcaagcggcccgtcggcgccatcgcggcggacgtggccgccatggggttcaactgcgtcaggttcacgtggcccacgtccctggtcaccgacgcctcctactccgaacctcgcggtcgcgcaagtcctttccagaggcttcaaccctccccgaagtcgcctcggccgggcattcaggggttcaacccaccctccgcgggggcccctccgaaccttccaagagtttcaattctaaccgccccttttcccaaggcccccgcttgggagggagaaccaagaccctgggtggggcctaaaggcactccaacccccctggtaaatgaggtggcacatttccacctgcgggaaaaccaaaacccccctccccccgtgtgaaagaccccacaaaggccccccccctcggggaggtccggggggataaggatccctttagcgccacaagagctacaaaagcctcctcccccctaataaaaccgcgggacccaaaagcatctgggtctatttttcttttttttncgtgggggcgaaaaaaaaaccccccttatactgcctcttccgaaaaacaccccgcgccgaaaaaagctttctctcgtggggggttttgggaaaccgggggcgccctcccctccccccgaagataaatgtggaggcccccacccacatgtgtgtttttctccacaccggggtgtgatttcctccccccataactatttttttcctcctccgggcatagagtaaagcaccctcttccgtggagaaaacacaaattgtctctctgggggggggagtcccccccaggcgccgagagaaaccctgtggataatcccgaagcggcggtgatcccacggtttagaacgcggcgcgcctcaaact

SEQ ID NO: 93261 - protein, 193 aa, Zea mays
  misc_feature: Ceres CLONE 1582482
MGCSCPPLADAACLALLLLASSLACRHHGCAAATLSTASRWVVDESGSRVKLACVNWPSHLEPVLAEGLGKRPVGAIAADVAAMGFNCVRFTWPTSLVTDASYSEPRGRASPFQRLQPSPKSPRPGIQGFNPPSAGAPPNLPRVSILTAPFPKAPAWEGEPRPWVGPKGTPTPLVNEVAHFHLRENQNPPPPV

SEQ ID NO: 93262 - DNA, 836 bp, Zea mays
  misc_feature: Ceres CLONE 1582484
  misc_feature: Encodes the peptide sequence at SEQ ID NO. 93263
  misc_feature (776)..(776): n is a, c, t, g, unknown, or other
tggagctccccgcggtggcggccgctctagaatagtggatcccccgggctgcaggaattcgtctcacccctagaaaaactggagaagttggtgggagttcctgttatcaatgttcatatatggtttgacagaaaactgaacaacacatatgaccaccttcttttcagcaggagttcacttttaagtgtctatgcagacatgtcagtaacctgcaaggaatactatgacccaaaccgttcaatgctggagttggtctttgctcctgcagacgaatggattggtcgaagtgacactgaaatcatcgatgcaactatggaagagctagccaagttatttcctgatgaaattgctgctgatcagagtaaagcaaagattcttaagtatcatattgtgaagacaccgagatcggtttacaaaactgtcccaaactgtgagccttgccggcctctccaaaggtcaactatcgaaggtttctatctagctggtgattacacaaagcagaaatacctggcttcctatggaaagtgcagtcttatcccgggaagctttgcgcccagtccatagtgcaagattatagcaggctcgcactcaggaagcagaaaagcctacaatcaggaagagttcctgtcccaatcttagttgtagtttggctttagcctatcttcatcccccactggggtgcctaccttaacctcccaattccaaggggaaacccacgccaaagggttaatgtttggaaaaaaaacacccggtttaagggttcccttggaaaaccncctcccgggggggaaaggcaagtttgaaggtccaaatttcccgaaataattatggcccca

SEQ ID NO: 93263 - protein, 121 aa, Zea mays
  misc_feature: Ceres CLONE 1582484
  misc_feature: SWISSPROT Homolog: EC 1.14.99.30 Carotene 7,8-desaturase
MSVTCKEYYDPNRSMLELVFAPADEWIGRSDTEIIDATMEELAKLFPDEIAADQSKAKILKYHIVKTPRSVYKTVPNCEPCRPLQRSTIEGFYLAGDYTKQKYLASYGKCSLIPGSFAPSP

SEQ ID NO: 93264 - DNA, 790 bp, Zea mays
  misc_feature: Ceres CLONE 1582486
  misc_feature: Encodes the peptide sequence at SEQ ID NO. 93265
tacccgcggtggcggccgctctagaactagtggatcccccgggctgcaggaattcgtctcacccctagaaaaaacagcgcgcgcgcacgacacgaactaaggccaagccgccgcgccgccgccacctttctttgcccagcctacgccaacaccatccgtgagcgccaccatggacaccgccgtctcgcaaaacgccacggttgccgcggcggccggtgccggaagcggcggcgggctggcgggcctgctcccggaggtgcagacgctggaggtgctggtggccgtgtccatcttcgtggccatccactcgctacggcagcggcgcacgcagggcttgccgacgtggccagtggtgggcatgctcccgtcgctgctcctcggcatccgcggcgacatgtacgagtggatcacgggcgtgctgaaggcgcgcggcggcacgttcacgttccgggggccgtggttcaccaacctccagtgcgtggtgacggccgacccgcgcaacctggagcacctcctcaagacccggttcggcagcttccccaagggcccctacttccgcgacacggtgcgggacctcctgggcgacggcatcttcggcgccgacgacgaggcgtggaggcggcagcgcagggcggccagcctcgagttccactcggccgagttccgcgcgctcacggccagctcgctcgtggagctggtgcacggccgcctgctgcccgtgctggccggcgcggaaggcgccggcgccgccgtcgacctccaggacgtgctccctcgcctacctttcgaa

SEQ ID NO: 93265 - protein, 207 aa, Zea mays
  misc_feature: Ceres CLONE 1582486
MDTAVSQNATVAAAAGAGSGGGLAGLLPEVQTLEVLVAVSIFVAIHSLRQRRTQGLPTWPVVGMLPSLLLGIRGDMYEWITGVLKARGGTFTFRGPWFTNLQCVVTADPRNLEHLLKTRFGSFPKGPYFRDTVRDLLGDGIFGADDEAWRRQRRAASLEFHSAEFRALTASSLVELVHGRLLPVLAGAEGAGAAVDLQDVLPRLPFE

SEQ ID NO: 93266 - DNA, 788 bp, Zea mays
  misc_feature: Ceres CLONE 1582487
  misc_feature: Encodes the peptide sequence at SEQ ID NO. 93267
ccccgcggtggcggccgctctagaactagtggatcccccgggctgcaggaattcgtctcacccctagaaaaagcatcacgcaatcgagaaaaacacaaaccgaaaaacctcctctacagtcccatctaggcgcccctcctcggctccgatccagtttcgccggcggccatgtcgcagccagcagcgactgtggccgcggcggcacaaccgcagggtcgcggccccgcggggcgccagggcggcctggggcagagcatcacaggcatcgtgcagatggcggtgttctggtactttgcgtccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcacgaggcaaacataccatatgcagtctggggacctaccagtactagaacacggtcattaacatactatccgtcagaggctctcaagcataatggctctttgtatgctcatgtttacttcgcccgtatcggttatcctgtggaccctacagatccagaatatgagcagaaatcttcgtttgggaggacacatcctgttgtggcattcttgccaatatcaaaagctggtaaaaagaagagcttgcttggagattcataagagcctgaagagaaagcacgtcgcatacggagaataaagggtctgatgataaagacgagggtccgactgaatatgtatcttat

SEQ ID NO: 93267 - protein, 178 aa, Zea mays
  misc_feature: Ceres CLONE 1582487
MSQPAATVAAAAQPQGRGPAGRQGGLGQSITGIVQMAVFWYFASKFFGPKRPPADPGMLMSNLFQKGEPMDMWMYLSENEKFNDFANEDALIWHEANIPYAVWGPTSTRTRSLTYYPSEALKHNGSLYAHVYFARIGYPVDPTDPEYEQKSSFGRTHPVVAFLPISKAGKKKSLLGDS

SEQ ID NO: 93268 - DNA, 856 bp, Zea mays
  misc_feature: Ceres CLONE 1582488
  misc_feature (223)..(223): n is a, c, t, g, unknown, or other
  misc_feature (602)..(602): n is a, c, t, g, unknown, or other
  misc_feature (603)..(603): n is a, c, t, g, unknown, or other
tggagctccccgcggtggcggccgctctagaatagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcgggcgccgtgatggcggcgagcggctacggcggtggcggcnggcggctacggtggcggcggcggctaccggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagggtttatcttcgttcgtctcatgtttgttgttgcccatctgtgtttttgattgcagcttcagctcggcgtcttcacaaacgccggcgcaaactctcgcccgagcccgacagatcttcaattccccattccgcccaccgatcgaccttcacgccagtctcggtctcttccgaaggcgtcgcgcgcgggttgtttgagaggagaggaggaanngatgagggagtgcatctccgtccacatcgggcaggccggcatccaagtcggcaacgcgtgctgggaactttactgcctcgagcacggcatccagcctgatggccaagtgcctggagataagaccgcgggccatcacgatgatgccttcagcaccttcttcagccagactggtgctgggaagcacgttccccgtgcaaatcttcgttgatctagaacccactggtgatcgatgaagtgcgcactggcacgtacc

SEQ ID NO: 93269 - DNA, 825 bp, Zea mays
  misc_feature: Ceres CLONE 1582490
ccgcggtggcggccgctctagaactagtggatcccccgggctgcaggaattcgtctcacccctagaaaaaatctccgcatccgcttgctgctgccgcccctgctccggctgggacgagcgagcctcctctccctccttgtcgcgtcccacataactgtgcctcctcgccgctgcgccccacctctgctcaggcccacactgccctgatcccgccggagtgcccgcacgcgcgcccttgcctgggccggccgccggcgaggggtctgggcggtcggtcgacgtgaccccccccgcaggcgcgctgtctcttcgtcgccctgctctttttgaccggcctcgcctcgctgtccgcaagtggcgccgtgtcggctgcacacgccggcggaggtgccggaacaaagcgagggcggcgcgccttgtcgccgtgcggactgagcatgacttgagccttgagatttaggatgtgtacagaggggctgtattcttgtgtataggatctctttctagcggtcaaccgttgctgattccgacagaatgttggaggatcaatcttgcctgatatcaaggtcgctgcccggttcctgtgagcagaaatccagactagcttacatgactttaccaccgacttgagatcacgaggagtaagcgcccgcctgagaacctggtcgagtgagcacgatctcccgggcagccattgactaaaaagacaaaggcctcttgagcaccaaaaacagagaggcgcctggactgccataggaaaattatgggtcagggcgaactcagaattcagagacccctgaataaattccattgtggccgggaaca

SEQ ID NO: 93270 - DNA, 1289 bp, Zea mays
  misc_feature: Ceres CLONE 1582495
  misc_feature: Encodes the peptide sequence at SEQ ID NO. 93271
  misc_feature (791)..(791): n is a, c, t, g, unknown, or other
  misc_feature (1225)..(1225): n is a, c, t, g, unknown, or other
  misc_feature (1289)..(1289): n is a, c, t, g, unknown, or other
aaaaaaaaagaacaggggaggaggtaaatagtccgcccccccccccccgcccaccaacccaacagaaaaacacaaaacacgaactccccgcggtggcggcctctttcgaagagtggagcccccgggctgcttccaaaagaggacccctagaaaaaccgaagccccaaacccctaccaccatttctcgggagtctcctttcccggagagtggatccgccactccaatctgcaccattctataaggaaaacctagatccggactcctagccgtcggccatggccacgcgccgggccttctcgtccatcctccgctctgcctctcgcattcgctccgcctcaccgtccccatgcccgcgtgcgccgctccaccaccgcccgtcccccgcgggcttcatactcaaccgtgtagccgcctacgcctcctccggcaagggggagggtgaaacctttccaccacccccttcaaccccaacaaaagcggtgggggcaagatcaccgaagaattcaaccgcgccaggcgccaatcggccaagcgtgccaagtcaatcgtccccctcaatgggaggcgccccttcaaacgaaggggctgcccccccaaaccctggaccggcgttttgaagttggttccaaaaaaaaaaacaattcaacccttccttagctcccaaagaggggtggtccagccatactcttaagggggagatgaataatggggtgcgcctgccaacccaatccatatcaaaatgggaaagcggggggaccaaataagaggagagcctccttgttttttttcngctgaggtcccacaaggaatagagggtttgtcctatataagagaacaacccacgggggggttatctctatctagcgcacatatcagacatcgggggagtctacccccgtgcgtgttgtgggaaaatgggagggtccaaacaagcccaccttatggtgtgaaccctaccctttttatataataaataactgagtgtacgctgttcggcgagcaagataactgctgagacttgtataaaaaacataacagagggggtggggattttattctacacacatcaagagatcgtatgccgtcttccacaccgcccgatatctcagtagtgaggagagaacgcccctccggtcgctttctccgcctataaacgcaaccactgacgccgataaggcaccgcagacattccgtggatcatacgccggaaaggtgagagggtanggaggaggacctatgactgcaaggcgttaccccataaatagaggtgactaacaagaggtgggtn

SEQ ID NO: 93271 - protein, 113 aa, Zea mays
  misc_feature: Ceres CLONE 1582495
  misc_feature: SWISSPROT Homolog: EC 3.6.3.14 H(+)-transporting two-sector ATPase
MATRRAFSSILRSASRIRSASPSPCPRAPLHHRPSPAGFILNRVAAYASSGKGEGETFPPPPSTPTKAVGARSPKNSTAPGANRPSVPSQSSPSMGGAPSNEGAAPPNPGPAF

SEQ ID NO: 93272 - DNA, 1219 bp, Zea mays
  misc_feature: Ceres CLONE 1582497
  misc_feature: Encodes the peptide sequence at SEQ ID NO. 93273
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (40)..(40): n is a, c, t, g, unknown, or other
  misc_feature (65)..(65): n is a, c, t, g, unknown, or other
  misc_feature (82)..(82): n is a, c, t, g, unknown, or other
  misc_feature (83)..(83): n is a, c, t, g, unknown, or other
  misc_feature (988)..(988): n is a, c, t, g, unknown, or other
  misc_feature (1092)..(1092): n is a, c, t, g, unknown, or other
nnnnnnnnncccccccccccaccagacgcaaacccgcaanaccccccccgacgaaagggagggangggggaggggggggttnnttcctggagctccccgcggtggcggccgctctagaactagtggatcccccgggctgcaggaattcgtctcacccctagaaaaaaacctcgtgttcgttcggagcgcacacacacacaaccagatctcccccaaatccacccgtcagcacctccgcttcaagatgcagatctttgtgaaaaccctgaccggcaagactatcaccctcgaggtggagtcgtctgacaccattgacaacgttaaggccaagatcgaggacaaggaggggatccccccagaccaacagcggctcatcttcgctgggaaaaagcttgaggacgggcgcacgcttgctgactacaacatccgtaaagagaggaccctcaacccttgtggtcccgctcaaggggaaggtatggagaatctttctaaaaacccctgaacccgggcaagattactcgcccctccaacgggaaggtgcctccgcgacatcccaattgggacccaccggctagaggggccacagagtcccaacgaaacaatagggaggaggggattttcgcttcccagcacaccaggggagacgagcgccccactccttcgaggctcgggcggggaaacccacggccgtctccaagggaaacgagggggcggtcacacgcgctgtcgggccgctccaacaatgggagcgataccatagtccgacagcgcaaaggggggagagaagagaacgaccatcactcggagcacaccacctttatcgagagggcgcacgcataaccaccactcgacactctaggggagcgggaagatctctccatcgtacgcaccgaaatttcttgatttacaagcgatgtataacacaccctctctcttaccacgagggccacagaaaagcgtatcacatatacacgccccctcaaaaggngagtggacgaagcgcctgtactcgagaagcaggcccatgaacacgaactgcaactcctcttagggctaccttgcgtatctcttcaagtgacccaacagatatgnggaggcatcttttccccccgagagcacttacaaatagcgggcgtggcgacgcccggtacgtgcgagcaagaagagaagactgacgtaagaaacgagcacacaccaacaagtaggcgcagctacccaa

SEQ ID NO: 93273 - protein, 85 aa, Zea mays
  misc_feature: Ceres CLONE 1582497
  misc_feature (6)..(70): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIEDKEGIPPDQQRLIFAGKKLEDGRTLADYNIRKERTLNPCGPAQGEGMENLSKNP

SEQ ID NO: 93274 - DNA, 846 bp, Zea mays
  misc_feature: Ceres CLONE 1582500
  misc_feature: Encodes the peptide sequence at SEQ ID NO. 93275
gcggtggcggccgctctagaactagtggatcccccgggctgcaggaattcgtctcaccccctagaaaaacccgactcttccatccctctttgcccttcccctgcccgccaatcgcttgccccactcccttgcttccgtggcgctcacgccgcgcacgcgtgctcgcctctcctggaaccgtctccgccgccctcccgcgtcggcgtcgcggcgcaagagggtaccctgaatttcgtcagtgccaagtgacgaccgcttttgcccatttgtgatagctgaatctctgtggttcaaaggcgattgatttgggtttgctgacgcacgcctaatgagctcccaagtctccacatcacacggtcttcatcccccggggaagcttgggacatttgagtcgccccatgcctggccgctgtcagcgcctacggcccagcccgaagcgggacgcggtgatgaccaggaggtcaggctgttgtcggtcgcctggaaccaagattgcggatgcttcgcggctggtaccagcaatggttttaggatctttaactgcgaccctttcaaggagactttcaggagggatcttaagagcggcggtttcgggatcgtcgagatgttgttccgttgcaacatccttgcccttgtaggaggcggctccaatgtgcagtacccgccgaacaaggtgatgatctgggatgaccaccagagccgttgccattggagagttcgccttccgctcagatgtcccgagctgtaaagttggcgaaagactacatcgtggatgtcctcgagcgcaagattttcgtctacaactttactgatttgaagctgctctaccagattgacaccctgtcc

SEQ ID NO: 93275 - protein, 139 aa, Zea mays
  misc_feature: Ceres CLONE 1582500
MSSQVSTSHGLHPPGKLGTFESPHAWPLSAPTAQPEAGRGDDQEVRLLSVAWNQDCGCFAAGTSNGFRIFNCDPFKETFRRDLKSGGFGIVEMLFRCNILALVGGGSNVQYPPNKVMIWDDHQSRCHWRVRLPLRCPEL

SEQ ID NO: 93276 - DNA, 1061 bp, Zea mays
  misc_feature: Ceres CLONE 1582501
  misc_feature: Encodes the peptide sequence at SEQ ID NO. 93277
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (28)..(28): n is a, c, t, g, unknown, or other
nccccnnggccccnnntaaacaacgccnactcaccccccccccaaaaacaaaagggcaacgagaaaaataaaaattggactccccgcggtggcggccgctctagaactagtggatcccccgggctgcaggaattcgtctcacccctagaaaaactctaatccccgtccctcatccctcaccctttgcaaaaatcacagcggcaggggtcagcaaaaatctccatgcccacgctcggcctagatctcccgcgaaccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctgctcgccaggttccggcggctcgagtcgctcgcgctcaaggggaggcccccgcgcccccatgtacggggctcatcccccgaagacttcgggcgcctacgcggcgccccctggggtcggccgaagcttcgccggcgcccgactcgaaattgccctcaaagggcggcttccaaccttggcgccccgcatggaaaccggttccacccgaacccaagggaacattccgccccggtggccttcggtcccggacgaccggcgccgggagccaacaatttgcctaaccaggatgggctttcaaagccttcggaaccaaagtgggcttcccgggggtttcctcaaacagggaaaaggcccgctcccggcccttcggatcggacaacggtttccttgggagaaattctctctgaaaaacactttttgtttcccctgggcaaaaaaaatgggaaaaaattttgcccccaataaaaaagggggaagcaaaaattgggcttcccctatgtaaacctccgccccggtggaaaacaatattccgtgttcctgggggga

SEQ ID NO: 93277 - protein, 227 aa, Zea mays
  misc_feature: Ceres CLONE 1582501
MGGEVPEPRRLSRSLSFGCGGVPEEALHLVLGYVDDPRDREAASLVCRRWHRIDALSRKHVTVGFCYAVEPARLLARFRRLESLALKGRPPRPHVRGSSPEDFGRLRGAPWGRPKLRRRPTRNCPQRAASNLGAPHGNRFHPNPREHSAPVAFGPGRPAPGANNLPNQDGLSKPSEPKWASRGFPQTGKRPAPGPSDRTTVSLGEILSEKHFLFPLGKKNGKKFCPQ

SEQ ID NO: 93278 - DNA, 819 bp, Zea mays
  misc_feature: Ceres CLONE 1582502
ctccccgcggtggcggccgctctagaactagtggatcccccggagctgcaggaattcgtctcacccctagaaaaaccctccctccattccatcgtcttcgcttccactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgccggagggaagctgcgcgcgctatgctgccatggcggtggagtagacgctgcccggcgcgagtgcggggaggaccgtgctggtcacggggcggggcgggctacatcggtagccacgccgtgctgcagctcctcctcgcggggcttccgcgccgtcgtcatcggacaccctcaacatctcctcccgagctggccgttccgcccccggtcgccggcgctcgcggggggtacacctcccgcaaacctctctttccaacaggatttgatcttccgtgacaagggagcaccggggaattggtttttgctttctaccagaatttgtaagcttgtcattcacctccgctgggattgaaaagctgtggggtggaaagcggtacagaaagccaattacttttattattgaccaaccaccgcctttggccaccataaaatcctcctaagaaagttatgttctggttccccgggttgccagaaaggttgggtgttcctcattctttcggctgggaggttttttgggattcccccccaaaaatccccccccgggccacagg

SEQ ID NO: 93279 - DNA, 968 bp, Zea mays
  misc_feature: Ceres CLONE 1582504
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (47)..(47): n is a, c, t, g, unknown, or other
nnccccaaaaannnntttaagtaaacgtccctcatatcctccaccanaaaaaaaatacacgcttccggtttagggtaattaaaaattaaaactccccccggtggcggccgctctagaatagtggatcccccgggctgcaggaattcgtctcacccctagaaaaagtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgatgctttcgcacaatggggttcgaccgtggcggctcaaccgtcttcttagatcaccatcctcggtggagacgggttgaagtctttacatccctctcgaccctctttgcctggcctcaattttttttttttttactgtcaagggataagcaaaggtgaaccttctggtggtggcataccccccacccacccatacggtaagcaataccacaagggccccagaatggggcaaaaccactaaaaggggaaccgtttcttctttggcaacaaaataattaagaatgggggaaaaaatttggctttgggccccaagggacaacctcttttggccacaagggggttttaaccaactgtcttccgcaaaaaaacacccggccggaaatctttccagaaaag

SEQ ID NO: 93280 - DNA, 813 bp, Zea mays
  misc_feature: Ceres CLONE 1582505
  misc_feature: Encodes the peptide sequence at SEQ ID NO. 93281
ctccccgcggtggcggccgctctagaactagtggatcccccgggctgcaggaattcgtctcacccctagaaaaaacgagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaagctgcccgcgcggcgcgatccggtgtccaccgctgccccgccggaggaggaggagaaggggggccgggggggtggagcccccggtgatggatcacgctaagatgtcgcatccggctcggccaggtacaacggcgctggcgctgcccctcatggcgggtggtggaatacggcggtgccctcgacgacgtgctcgacgacggagctggctgggttcaccacgtggtcgtccgccctggctgctagctacgacctggcggccgaggggacaaaggccaagagcgccgccacctcttcggagtcccccgggaacaacagctccgtgaccttccaagaaccggcctgcgtcacggatcctcccggcgtcggaaccgccgtggtgcaagtgcaacagcctcttgccaccggttacgccgactggacacatccctatatgagcagtggcgctactactttgcatgggtttctgctagacggtcaccagcaggacatgagctcagcaactgagcagagctccatgaccgcatcaagcctgatgaacccttcatgcaataacctagccctggcgctgcaaggtcaccaccaccaccaccaggagcatgagt

SEQ ID NO: 93281 - protein, 57 aa, Zea mays
  misc_feature: Ceres CLONE 1582505
MSSGATTLHGFLLDGHQQDMSSATEQSSMTASSLMNPSCNNLALALQGHHHHHQEHE

SEQ ID NO: 93282 - DNA, 855 bp, Zea mays
  misc_feature: Ceres CLONE 1582506
  misc_feature: Encodes the peptide sequence at SEQ ID NO. 93283
ggagctccccgcggtggcggccgctctagaactagtggatcccccgggctgcatgaattcgtctcacccctagaaaaagacctgtgcggcgttcccgtgcccggccggagtattgatcgcatggcctgcgccggcgccgcacggaaggtctcagcggtgctctaccactacacgtgcccggacggcgcgttcccagcgctcgccgctcacctctatttttccggcgccgcccatccggtccgattcttccccaataccgtctacgaccccatcaggagtgattcacttcctctggaagaaataaaagatgtttaccttcttgactttgtgggacctcatggttttgttgaagatctagcccctaaagtcgaaagaataacaatcctggaccatcataagaccgcatttgaaagttagtgtgtgaatgccacacttgggcaaaatgtgaccaaggtgatagacatggcagcgtactggtgcgacaattgcattttgacttcacttagaaacaagctcttaacagaagttagcacccttacaggggtaatgaaagttgggaaaagaagtagggcaacgtcaaatatgtacctgaacaacaatggctggaaacagtacacagagcttgtttaagtttaattgaaagaacggggaccttatgcgagaatggaaaatttccaaaagagcaaagggccttcccggaatgggacctttaaagattttgcgacccttggatttacaaatgtccaatacaaaacaaataaaattggtttagaaccaaatgttgtggggatctgggaatccctgaaaccgtggaaatttttccccttgggaacaatcccaccctttatttgggag

SEQ ID NO: 93283 - protein, 98 aa, Zea mays
  misc_feature: Ceres CLONE 1582506
MACAGAARKVSAVLYHYTCPDGAFPALAAHLYFSGAAHPVRFFPNTVYDPIRSDSLPLEEIKDVYLLDFVGPHGFVEDLAPKVERITILDHHKTAFES

SEQ ID NO: 93284 - DNA, 1166 bp, Zea mays
  misc_feature: Ceres CLONE 1582507
  misc_feature: Encodes the peptide sequence at SEQ ID NO. 93285
  misc_feature (9)..(9): n is a, c, t, g, unknown, or other
tttgtgttngggcgggtgggggcggctgtataccatttttttgataatttaggatgtggggtcacagtaattgaaacgtgtactccccacggtggcggccgctctagaactagtggatcccccgggctgcaggaattcgtctcacccctagaaaaagtgaatcactagtgtcgcaaatcccaatctcccagcttgcgcctaaaccctagcttgcctatcgatggacgccgaagaagcgcaaggccgatcccgccgagtcccccgccgccgtggaggcagccaccaccaaccaccaccacgagccggcgtcctctgagcccaagccactcggctccatctacttccccatcacagacagacccgcccgaacccaacgccgccgaaaaggacgaagacgagggggcctgcgacgaccaagaagaatcggaagaaattggtaagctaaataagccactgtctcggggtagcagactcgttggtgctacccccacacgacagccgaaggggaaaccccccccccaacgatggggcgggaagttcgcccaagacctgataaagaacgaaaccctggcaaaaagggaaaaacatctttcgttacaaagcggctctaccgtatagaagaatggcccggtgtgaccgaaaggaagatctacacagcttaccgatccatggtgcctttaaagagttatgaggggggagaagacctccgagaggagaacctgaaacgcgccgaccgcagaagactcaattgggaacacgaaagacgaaatacaggtgaggctactggacatgcctcggagggggaccctaaacagggtggactttacgggtggcctctagtttatatcaggatctataaccgacgggaggaagttcagagtgattatagtccgagctacacctccgtgaaaagtgagaggcctggggaaaaagtctcatctaagatcgacggaaggggcagcacgtaccattgggcattactaccagagggaaacccacgtcggccggaaaacttgtagggatccacacctaacacccaacacaacgcgtacaaggcaatctcggaaaagcgctgtactaatgtaacaaatcgctcaaagagcgcccggataggaggaatcaggccaagaggtagcccacggagatcatgtacattattactggga

SEQ ID NO: 93285 - protein, 164 aa, Zea mays
  misc_feature: Ceres CLONE 1582507
MGREVRPRPDKERNPGKKGKTSFVTKRLYRIEEWPGVTERKIYTAYRSMVPLKSYEGGEDLREENLKRADRRRLNWEHERRNTGEATGHASEGDPKQGGLYGWPLVYIRIYNRREEVQSDYSPSYTSVKSERPGEKVSSKIDGRGSTYHWALLPEGNPRRPENL

SEQ ID NO: 93286 - DNA, 1206 bp, Zea mays
  misc_feature: Ceres CLONE 1582508
  misc_feature: Encodes the peptide sequence at SEQ ID NO. 93287
aaaacaggatatatattaatattaaagtagtacaagaaggtctaaccaccacaggagaaacccacatcacctttaacctggaactccccgcggtggcggccgctctagaactagtggatcccccgggctgcaggaattcgtctcacccctagaaaaaccatccctgcccctccccccgccccacctcaatacaatcctctgctcgcgttctctcgtcccggcggcggcgtaggcgcgcgcaccaggtgttcgacgggagttttcgccaccgcggaagatgtacgtggtcaagcgggacggccgccaggagacagtgcacttcgacaagatcacggcgcgcctcaagaagctcagctacggccttagccaggaccactgcgacccggtgctcgtcgcgcagaaggtctgcacgggggtctacaagggcgtcaccaccagccagctcgacgagctcgccgccgagaccgcggcggccacgactgcgtcccaccccgactacgcctcgttggcggcgaggattgctgtgtctaacctgcacaagaacacaaagaagtcctttctccgagaccaattaagggacctgttacagggcactttaaacgaagagggtctggggcttgatggggcccccatcttgggccgcctggaagaaagttttttttgaaaattccatcattgaaataaaatgcctggcctccgcctttgggaaccggttggaaataaaaattttttttggaataaagggggaatttttcttaaccacaagtggacaacataccttatttggggcgctttcccaaaaaaacctctcttgtggtataaagaagggagctcttataacccctctctattgagaaaaaccctttgaggattgtgggagaaaaggtatctccttttttataaaaagggcctcactcaacgcacacaaatgtgcctgataaagaaagaggggtatttctccgaggtgggggaaaatatccccccgcgggagaaaagaacatttggatgtcctctgccgcgctcttggtgaaagcgttacacccctctctgatagtatcccccccaaaccacagggggtttaactcaatagaaaacgcatacgcaacacaacatctttttatcagccgtgtgggtgcctatagcagggaggcgcccaaatataaaaagaacggcgtgttatatcttcctaaatcgtgggtagagaag

SEQ ID NO: 93287 - protein, 128 aa, Zea mays
  misc_feature: Ceres CLONE 1582508
  misc_feature (1)..(91): Pfam Name: ATP-cone Pfam Description: ATP cone domain
  misc_feature: SWISSPROT Homolog: EC 1.17.4.1 Ribonucleoside-diphosphate reductase
MYVVKRDGRQETVHFDKITARLKKLSYGLSQDHCDPVLVAQKVCTGVYKGVTTSQLDELAAETAAATTASHPDYASLAARIAVSNLHKNTKKSFLRDQLRDLLQGTLNEEGLGLDGAPILGRLEESFF

SEQ ID NO: 93288 - DNA, 843 bp, Zea mays
  misc_feature: Ceres CLONE 1582511
  misc_feature: Encodes the peptide sequence at SEQ ID NO. 93289
  misc_feature (289)..(289): n is a, c, t, g, unknown, or other
  misc_feature (296)..(296): n is a, c, t, g, unknown, or other
  misc_feature (298)..(298): n is a, c, t, g, unknown, or other
  misc_feature (299)..(299): n is a, c, t, g, unknown, or other
  misc_feature (301)..(301): n is a, c, t, g, unknown, or other
aagctggagctccccgcggtggcggccgctctagaactagtggatcccccgggctgcaggaattcgtctcacccctagaaaaagtcgctcccttgttctctcccgagccgtccgcgaaccaacccgtgctacctccgattcttcgcctcgtcgttctttctagaacctccgctccgcctaatcccttgaccgggtcaagcccgaacgagactagggaggttccagcgccgccggtgggggagatggcgctggagctgagcctggcctcgctgcgcccgggggggcgggnggttggngnnancgccgcccctcgccccaccgggaaggaccagcaagtgggccggcggggggatctactgcagatctccatgctcgtgctctcggtcgtccttgggcacgtcctgggcccgcaccgcttctactactttcccgaaggcaggggccccgcctttctaattggggcttaatttgttggggggcccccgtcaattatttgcaaattcccgaggcccccccccccggggggggggtggtttccaacctttcccaagaaaaaaaagtcccccccccggggggggggcccctaaatataacccccccgaaataaaattttccccgcgggggggggttttataaccttttttcccccaaaaaacaccttttttttgtggaaaaaatttttgggggggggattagggaaaacttttttgggaaatttttggggggaaaaaaaatcaatggggcctccgggggggaaaaaaaaaaggtgccctccggccccccccccggggggggggggcccccctttcttttttaagagaaaaaaaaacccccggcgggggg

SEQ ID NO: 93289 - protein, 74 aa, Zea mays
  misc_feature: Ceres CLONE 1582511
  misc_feature (16)..(16): Xaa is any aa, unknown, or other
  misc_feature (19)..(19): Xaa is any aa, unknown, or other
  misc_feature (20)..(20): Xaa is any aa, unknown, or other
MALELSLASLRPGGRXVGXXAAPRPTGKDQQVGRRGDLLQISMLVLSVVLGHVLGPHRFYYFPEGRGPAFLIGA

SEQ ID NO: 93290 - DNA, 949 bp, Zea mays
  misc_feature: Ceres CLONE 1582512
  misc_feature: Encodes the peptide sequence at SEQ ID NO. 93291
  misc_feature (877)..(877): n is a, c, t, g, unknown, or other
ctccccgcggtggcggccgctctagaactagtggatcccccgggctgcaggaattcgtctcacccctagaaaaaaaaaccacacccatcgcacccagccagccctcgccatccatggccaccaccgccgccatccacctgcgcccgctccgttccgtcgccgtctcctccgcgaggtcacgctcgctcctccacctcctcgcccggcccctctcctcttcccaatcgtcctacgcctaccgcccttcccctacagcgcccgccgccgccgcccccaaccatgtccaccaccctccccatcaccaccagtcggtgccctcccccaggaccaccccttccacagtggtccgcgcagggacatccgcctcccgcgacccgtggctatggggcctccatcgccgcatcaccagcatgttgccgcctaccccatcaacgcgggctacagaactgcccacagcggactgccagagggagcaagttaaacttcggccgttctccgacggcggaaaggggccacgggggacctccaaacagcgggggccaagaacgttaatggccgcacccctggctttccaacaggggcccatggggaaccctcccgggccaccgggggccaaggcataatgttccaacccccccaaaaaagggcccacggggaccctcccaaccaccggggggcccattggaaggttaaccgggcgagccttcggggccgccccaagagggagacaaccggtacctcccggccaacccggggccagggattctttacgccccgccctcccaaccaagcaaaaaggggcggagggttccttccaacccgcgcttaaccaataaagggaacccgccggccaacatgaattccttgtgggaggggnccccggggggaaacatacaggagaaccgtttcccggaaaggagcccgggttataggaaatgccccgccaact

SEQ ID NO: 93291 - protein, 169 aa, Zea mays
  misc_feature: Ceres CLONE 1582512
MATTAAIHLRPLRSVAVSSARSRSLLHLLARPLSSSQSSYAYRPSPTAPAAAAPNHVHHPPHHHQSVPSPRTTPSTVVRAGTSASRDPWLWGLHRRITSMLPPTPSTRATELPTADCQREQVKLRPFSDGGKGPRGTSKQRGPRTLMAAPLAFQQGPMGNPPGPPGAKA

SEQ ID NO: 93292 - DNA, 1201 bp, Zea mays
  misc_feature: Ceres CLONE 1582513
  misc_feature: Encodes the peptide sequence at SEQ ID NO. 93293
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (1080)..(1080): n is a, c, t, g, unknown, or other
aacaaaataaaaataaaaatttgttgtacatccccaaacaaccaaacctacccccccccccccccacaacnnnacaaaactggagctccccgcggtggcggccgctctagaatagtggatcccccgggctgcaggaattcgtctcacccctagaaaaaacggtcacggggacgcccccagtccctcacctcactagctatcgcaatagctcgcaccacgcaccaccgtgccgcgagcgccactctgagcactctatttatgccgctgccagcgcctgtgctacaagcgggagcggggtggtgctggtggtgaccaagaatcaatctcattcgacaggtttggggaggtgcagcgagctagtagctgcctagctatataacatgcccgcgtcgtccccggcctcggccgcgctggcggccaccgtggaggcggcgtcgctgctgctgctgctgctctgctgcaccaatgaggcgtttccccacacaccggcgatcgcgtgcgacgcgtcgaacgcgacgctggcgtcgtacgggttctgcaaccggtcggccgacggctgcgtgcgcgcgcgagcggaccaaggcgtcgccgtcctgacgcttggcatgaaaaaagtggggggttccctggtgggacaaaagcaaggcggccgcctggcccccgggctggggccgttccccagctgataacaaagttggttttggtctagaaaggccccttttcacacgggaagattcaccccctaaaccgttgggtggtgctcccgaggccaacactccgggtaatctattcagacccgctcattgggagtgtacccccacggggtgggctccaccccaagggtcttttactccctccgccgaggtccctcacatttccttcccaaaccggtgcggggcgatatacacgttgtttacaaaagggcccacacgtcatacatttgtcggagcggacccaatatctacgatgaagaggagatagagatgtgtcctaaaacacataaggggcgccgcgggggcgcaatatctccacaacctatggtagccgccttgggcacgagggggggtacacagggttttntcttgggaaagaccccctaaacacatataagacattcttttttctgcacgaaacctcccttagatagagagggcctgctccggggcgctaggaaataaccaccccgcgcgcgaaaagaatc

SEQ ID NO: 93293 - protein, 101 aa, Zea mays
  misc_feature: Ceres CLONE 1582513
MPASSPASAALAATVEAASLLLLLLCCTNEAFPHTPAIACDASNATLASYGFCNRSADGCVRARADQGVAVLTLGMKKVGGSLVGQKQGGRLAPGLGPFPS

SEQ ID NO: 93294 - DNA, 835 bp, Zea mays
  misc_feature: Ceres CLONE 1582514
  misc_feature: Encodes the peptide sequence at SEQ ID NO. 93295
  misc_feature (799)..(799): n is a, c, t, g, unknown, or other
ctggagctcaccgcggtggcggccgctctagaactagtggatcccccgggctgcaggaattcgtctcacccctagaaaaactcccaaggtcgcgttccatcgattctccacgagcggatagcggcgtacagatcttttcgtgctcgtcttcgcgtcggtgtggctggcccgtgactgtgagaagtcaaaatctcacagcatattgattgggctgattccgtgggagggaatcggggatctggcattctcgcgcccaaaaggtcgcagctttctttcgtgtcgccagccggtgcgcggtcgacgcagagcgcgtggagggtgtcccgctagtagctcctcgacgacgacggtgacgggaggccgggggttgaccatggtggcggcggcggacctggaggcggcggagcgggtggtggcggagctccgcgaggcgtgcgcggcgcggctcgacgaggtggcggcggcgatggaggcggagatgcgcgccggactgcgcgaggagggcggcagcaagatcaagatgatcgtctccttcgtcgacaacctccccacggggaacgaagagggcgtcttctacgccttggaccttggcggaacgaacttccgcgtgctgcgcgtgcagctggccgggaaggacaggcgtgtggccaagcgagagtccaaggaggtgtccatccctcctcacctcatgtcaggcaacgcatcggagctgtttggcttcatcgcctcggcgctagccaagtacgtcgccgcggcgggcgaaggggacggcaggcagaaagagctcgggttcaccttnctctttccccgtgcgcccagacgtcgatcgcgtcag

SEQ ID NO: 93295 - protein, 154 aa, Zea mays
  misc_feature: Ceres CLONE 1582514
  misc_feature (4)..(153): Pfam Name: Hexokinase_1 Pfam Description: Hexokinase
  misc_feature: SWISSPROT Homolog: EC 2.7.1.1 Hexokinase
  misc_feature (142)..(142): Xaa is any aa, unknown, or other
MVAAADLEAAERVVAELREACAARLDEVAAAMEAEMRAGLREEGGSKIKMIVSFVDNLPTGNEEGVFYALDLGGTNFRVLRVQLAGKDRRVAKRESKEVSIPPHLMSGNASELFGFIASALAKYVAAAGEGDGRQKELGFTXLFPRAPRRRSRQ

SEQ ID NO: 93296 - DNA, 910 bp, Zea mays
  misc_feature: Ceres CLONE 1582515
  misc_feature: Encodes the peptide sequence at SEQ ID NO. 93297
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (22)..(22): n is a, c, t, g, unknown, or other
  misc_feature (23)..(23): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (111)..(111): n is a, c, t, g, unknown, or other
  misc_feature (118)..(118): n is a, c, t, g, unknown, or other
nnaaaaaaaannnntggggttnnggaaggtnnnaagtanngattggnnnttnntnnntttnnnnnnttnnggccgggnnnnncaatgatggaactcagggggtgaattccnctctccnaatagtggatcccccgggctgcttttattcgtctcacccctagaaaaaagaagcacggaagcaggagacgaccaatagcaacgcgccggcggctcggcggcgtcgaacgattcgggcaatcgacaagcagccccaccaaaccaggaaactgcaaacctacccccggtcgccgactcgccggcctcgactctccgcccagactacaaatggagctctgcacctgcgtggcccgcagttctgcgcccccctcttctagctgccgcgcggcgccattcccgcgagttctctcccatcgcatttggagccgatcgggatactgcactgtctgctttaccccgtcaagccctgttgctaggagtcgattctctactctaatgacgactgcacacaagtatgatgcgacaagtctgtataactgaccctctgttttgctttgggaattgggacgatgcaccgccgctaagattaactagcaaaaaggcactgggaccccagatctagttgacttcaattgggatgatcttgggtttcaactgatcccaacggacttcatgtatttaatgagctgttcttcagacggggtgtttatgaatggtaaattagtgccatatgggtcaattgagctgaatccagcagccgccgtgctgaaatatggtcagggattggcttgaaagtctacgagcacatagaaaaagaggatggatcaatcccttcttttttcgtccacatggaaaatgcacggccggtatgggaaattgggtgccagaccgggtttatgcatgccctgcaacc

SEQ ID NO: 93297 - protein, 39 aa, Zea mays
  misc_feature: Ceres CLONE 1582515
  misc_feature: SWISSPROT Homolog: EC 2.6.1.42 Branched-chain-amino-acid transaminase
MYLMSCSSDGVFMNGKLVPYGSIELNPAAAVLKYGQGLA

SEQ ID NO: 93298 - DNA, 795 bp, Zea mays
  misc_feature: Ceres CLONE 1582516
  misc_feature (748)..(748): n is a, c, t, g, unknown, or other
  misc_feature (760)..(760): n is a, c, t, g, unknown, or other
ctccccgcggtggcggccgctctagaactagtggatcccccgggctgcaggaattcgtctcacccctagaaaaaaggctccgcgtctcgctgtccccactccgtctcctccggctccgtctcatcccgatgccgctccttctcatcgtcgtcgtcccagtcccggagtcgctcccctcctctggctaagcgcagccttgatgtgtcggcaactggagtatttggtacgagactgcttgatccagataattttattacacttcaggcgtggcttgtgtgttcagactactactgttgaatacagttacaattggtccttgtggccctcaacagtttggatgctgtcattcagcattgaacagagccagagtctggtaacagtttttaatcatgttcttgataggatggatacatctgttaaatgtgtgaccctgcattcagaattcagatcgacacctttgattggttccaattccctgctgctggcttattatttaactttcctttttgcagtttctataatagcagagacatgcgctaaccagcatttgctaacccaatcaatttgttggcatcattttattgatcgaatccatcccgcctcatgcttttgcttcgccctgttaacatgtttttattgctgccgtgggctcttcgcaatttaaagttctctcgtatatgaagtcacatagttacatgacgtacattctacttgaacatgggttgtttggtatttttctcatgaattngtaatggtttcntatgctggttctctttatcctgggtgcattacttt

SEQ ID NO: 93299 - DNA, 796 bp, Zea mays
  misc_feature: Ceres CLONE 1582519
  misc_feature: Encodes the peptide sequence at SEQ ID NO. 93300
gcggtggcggccgctctagaactagtggatcccccgggctgcaggaattcgtctcacccctagaaaaaactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcattaatgttatcggtgagccgattgatgagaagggtgatataacgacaaaccaccttcctccctatccatcgtgaagcccctgctttcgttgagcaagccactgagcagcaaattcttgttactggaatcaaggtcgtgaatt

SEQ ID NO: 93300 - protein, 190 aa, Zea mays
  misc_feature: Ceres CLONE 1582519
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIINVIGEPIDEKGDITTNHLPPYPS

SEQ ID NO: 93301 - DNA, 849 bp, Zea mays
  misc_feature: Ceres CLONE 1582520
  misc_feature (449)..(449): n is a, c, t, g, unknown, or other
  misc_feature (743)..(743): n is a, c, t, g, unknown, or other
  misc_feature (752)..(752): n is a, c, t, g, unknown, or other
ctccccgcggtggcggccgctctagaactagtggatcccccgggctgcaggaattcgtctcacccctagaaaaactcgtaggcatctcttgactactggatggagttcatttgtcaataaaaagaaattggtttcaggggatgctgtgttatttctccgaggtgatgacggtgaactaaggctgggtgtgcggagggctattcagcttaaaaatgaggccctttttgaagatttcaatagtgacagcacaaagcggcattctttgacggctgtagctgattccttgaagaacagaagtgtttttcacatttcttacaatccaagagctactgcttcagaatatattattccatacgctaagttcctgaagagcctcaatcatccagtctgtattggagcaaggatcaactttcagtgccataatgaagatgttagtgaaaggcgatctnggagtggttgttcgcattagtgaaatagatcccatgaaatggcctggctcgaagtggagaagcctgctggtaagatgggaggacggtgctgaatgtaatggccaagatagagtatctccatgggaaatcgagatagctggtggttctgtctctgtttctcattccctttctgcatctagttctaaaagaaccaagttgtgtcctcagggaaatttggacgttccagcaatgtatgttacaggggaatggttgtactgactccatggaaactggaaagttaccagggtcttgcanggtcagaanttgatgagttttaggactcgtccatgttccgtgtgctcctccaactgctgaggctgcaaaacttcatcttctggatgctagtaggtttccttagtaa

SEQ ID NO: 93302 - DNA, 876 bp, Zea mays
  misc_feature: Ceres CLONE 1582521
  misc_feature: Encodes the peptide sequence at SEQ ID NO. 93303
  misc_feature (707)..(707): n is a, c, t, g, unknown, or other
tggagctccccgcggtggcggccgctctagaactagtggatcccccgggctgcaggaattcgtctcacccctagaaaaaagcggaaaagcgccatctcattcttcttcctccatcttgtctctacttgccccgcgccggggagccgcgagcgtcgcgccactcccatcgcctgcccacaactccggcatggagccgtcggcgtgggccgtcgccttcgccgcactctgcatcgtcgcgctcgcgccgccggcctcagggttctacctccccggcgtcgcgcccaatgacttcgagaagaaagatccacttcctgtgaaagtcaacaagctgacctcaatcaagacacaacttccctactcctactattctctcccattctgcaagccggataccatagttgacagtgcagaaaatctcggtgaagttcttcgtggagatcgcattgaaaactctccctatacgtttgaaatgagggagcctcagatgtgtcaagtagtctgcaagatatctgtttggggagaaagaagcaaagcttctcaaggagaagattgaagatgaatacccgtgtaacatgatttcttgacacctacctttagtcgttcctattcaaagagtggatcaagaaggtgcatatttctatcaacatggattccatgttggggcccaaaggaaaaatattccgggagcaaagatggaaaaaaacttnttccacaaacatttatttttttacggggaaaattccccgggattaaccaaagggatgttttcccggaattgggggccctttgaaaaggaaaccctcccgcgtttaacccttaattttaaggggcaatgggaaattaaaaaaaaacccccctcgaaaacagtggtaaccc

SEQ ID NO: 93303 - protein, 121 aa, Zea mays
  misc_feature: Ceres CLONE 1582521
MEPSAWAVAFAALCIVALAPPASGFYLPGVAPNDFEKKDPLPVKVNKLTSIKTQLPYSYYSLPFCKPDTIVDSAENLGEVLRGDRIENSPYTFEMREPQMCQVVCKISVWGERSKASQGED

SEQ ID NO: 93304 - DNA, 765 bp, Zea mays
  misc_feature: Ceres CLONE 1582523
tggagctccccgcggtggcggccgctctagaactagtggatcccccgggctgcaggaattcgtctcacccctagaaaaagcccgaagctgagcagtgagcagagcaggcgtttcttcctccactggtctcggtctttgccgcaaatatccgctcgcccccccttctcggtctcgggctctcactcaccctcgaccctcctcgcgcagccgcacgcgcgcgccatggcggcgctctgctccgcctccccggccatctccgcggcgccgtccctcgggtcgcccgcgcgcgtggtcgcgtccttcctccgcctcccgcctccgccctccgccttgcgccctgcgcgcccgccaaagcggcttcctggcttcccaaggcgcccgggggccccgttctttgggccgggggcgccaaaacggccgccttttccggcggggctttccccccccggcccgggaaaaggcccggaaaaggaaaaattgccctcccggggggggggtgttggaaaaaaaaacccgcctttgaaatacccccccccgcccccgaaaaaaaatttattggcgggaaattgtccccccgcgggcccaaaacacaattttttttttttcaccccgggggggggttttttccccccttcgggggggttttcttgggggggggcaaaaaaaaaaaaaaaaaaaaccttttttttttcccggggggggagaaaatcccccccacccccctttttttttttgaaaaaaaatggggggggcgcgacccaacat

SEQ ID NO: 93305 - DNA, 800 bp, Zea mays
  misc_feature: Ceres CLONE 1582526
  misc_feature: Translation starting site: 342
  misc_feature: SWISSPROT Homolog: EC 6.3.4.2 CTP synthase
  misc_feature (517)..(517): n is a, c, t, g, unknown, or other
  misc_feature (739)..(739): n is a, c, t, g, unknown, or other
ctccccgcggtggcggccgctctagaactagtggatcccccgggctgcaggaattcgtctcacccctagaaaaaaaaccccaacctcccttggtttggctggcggctagcccctaaccaaaaaaaataaaataaaaccaactctcccattcggccatttgcccatttcccatctcgccttcgcttcccacgcccctccgtcccgcctcgccgcggcaaggcaccgccgccaaccgccctcgtccctcttcgactcgaccgcgtgagtgagacgaccgcgcgcgcccctcgcccgcccgccaggaggagatcgatccatacctcaacatcgatgccggaaccatgtctccgctcgagcatggcgaagtgtttgttttggacgacggcggtgaggtggacttggaccttggaaactacgaacgatttctggacatcaagctgactcgtgacaacaacataaccacgggggaagatctaccagtctgttattgacaaggaacgtagaggggattacctangaaaaactgttcaggttgtgccgcacatcacagatgaaatacaagagtggattgaacgtgtggcaatgaatccagttgatggcacagaagagccagctgatgtttgtgtcatagaaactggtggcactataggggacattgaatcaatgcctttcattgaagcattaggtcaaattttcataccgtgtaggggctggaaactttctgctggtgcatgtcagntctgtaccagttttaaatgtgggtggtgagcagaaaacaagcccaccccaaatagtggtcc

SEQ ID NO: 93306 - DNA, 817 bp, Zea mays
  misc_feature: Ceres CLONE 1582530
  misc_feature: Encodes the peptide sequence at SEQ ID NO. 93307
  misc_feature (688)..(688): n is a, c, t, g, unknown, or other
  misc_feature (740)..(740): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
gagctccccgcggtggcggccgctctagaactagtggatcccccgggctgcaggaattcgtctcacccctagaaaaaattcctcatcaccaagccgaaccacagagctcccccacacccacagcggggtgaagcgaatcgcatcaaattcgaccgaagaatcgcgccgctcggcccggccaccatgagcttctcgtccatgagcaagcagcaggtgctggacgccggtgacggggtagggggaggaggtcatggagctcatcccgggcctgccggaggaggtggccgagaagtgcctcctccacctgcccttcctctaccaccgcctcttccgcaccgtctcctccacctggaaccgcttcctcacggacgccctggccaagccactgctgttccctcacgcggcgggggcggggaccgcggccacggggtcggtgcccttcctcttcgccctcgcctttgaccccatgtcgcggcgcctccagtgccaggcgctcgaccgtttctcgaggaagtggctcctgctcccgccggtgcccggcggcgccgcggccgggtcgttcgctgtggtggggctcccccgccgcggcgagatctacgtgattgggggcgtcgaagagggcggcgacaggccgttacgagcgtggcggtgtacagcgccgcgcggaacgggtggggaagaaggcgcngcaatgcggacgccccgcggtaccatggcggccgggggagtgggaggggccnccgggtggggtggttnnnnccaagaaagaaccccccaggccgaaatgaattccaaacccccaaagcggggccgggaa

SEQ ID NO: 93307 - protein, 189 aa, Zea mays
  misc_feature: Ceres CLONE 1582530
  misc_feature (2)..(49): Pfam Name: F-box Pfam Description: F-box domain
  misc_feature (164)..(164): Xaa is any aa, unknown, or other
  misc_feature (169)..(169): Xaa is any aa, unknown, or other
  misc_feature (170)..(170): Xaa is any aa, unknown, or other
MELIPGLPEEVAEKCLLHLPFLYHRLFRTVSSTWNRFLTDALAKPLLFPHAAGAGTAATGSVPFLFALAFDPMSRRLQCQALDRFSRKWLLLPPVPGGAAAGSFAVVGLPRRGEIYVIGGVEEGGDRPLRAWRCTAPRGTGGEEGAAMRTPRGTMAAGGVGGAXGWGGXXQERTPQAEMNSKPPKRGRE

SEQ ID NO: 93308 - DNA, 902 bp, Zea mays
  misc_feature: Ceres CLONE 1582534
  misc_feature: Encodes the peptide sequence at SEQ ID NO. 93309
  misc_feature (688)..(688): n is a, c, t, g, unknown, or other
ctccccgcggtggcggccgctctagaactagtggatcccccgggctgcaggaattcgtctcacccctagaaaaaacacgaggctgaacgcttgaacctgaacctccaaagcagcaaccccagcagctttagctcctcctcatcgcagccgcagcgccgtcccctactcttccagcgaccaactgctgtctctccggcgacggcagaaccgtctctgcaggtgcagggagggacccgggagatgagtctggggctgctcaacacagagcgcaaccaccttctctccccgaagccgcagagccctcgggatgccgccgtgtcgtcgctgctgaggtcacccagagcgtcctgcggctcctgcagccagagccccaagccgaagcccaccaagatggcgcacggcggcctggagcgctcgctcagcttcaagaactgggaggcggacgacagccgggggcggatcaacgggagcgcgcccgggcgccccgggggctgcaacagcaggagagcccccggcgcgtgggtcttcgtgtccccgccagggcagggcctggatcgagtaaattttcccctcggcccccgcgtgggaactgggaaccaaggcgggcccccacgcctggcaaaaaaaggtaaaagggggcctgggcaaagcggccccaaaacctcccccgaaaggggccatcattcgnccaaagaagcctgtgggggggaaaaaagggccgaaccccgggggtacccccaaaatacaagggccaatctcccttttcttcaagaaagaaaaaggcggggagaaccccccccggtcccccctgggtccaagggcccggcaaaaaaggaatcccccaaagggcggccaagaggggctcctcccagggaaaaacagggggcgcataaaacccgccg

SEQ ID NO: 93309 - protein, 220 aa, Zea mays
  misc_feature: Ceres CLONE 1582534
  misc_feature (150)..(150): Xaa is any aa, unknown, or other
MSLGLLNTERNHLLSPKPQSPRDAAVSSLLRSPRASCGSCSQSPKPKPTKMAHGGLERSLSFKNWEADDSRGRINGSAPGRPGGCNSRRAPGAWVFVSPPGQGLDRVNFPLGPRVGTGNQGGPPRLAKKGKRGPGQSGPKTSPERGHHSXKEACGGEKRAEPRGYPQNTRANLPFLQERKRRGEPPPVPPGSKGPAKKESPKGRPRGAPPREKQGAHKTR

SEQ ID NO: 93310 - DNA, 851 bp, Zea mays
  misc_feature: Ceres CLONE 1582535
  misc_feature: Encodes the peptide sequence at SEQ ID NO. 93311
  misc_feature (567)..(567): n is a, c, t, g, unknown, or other
ctggagctccccgcggtggcggccgctctagaactagtggatcccccgggctgcaggaattcgtctcacccctagaaaaaatcctgtcatccaccctcgcccaaccgacggctaccggttgtaagattggaatcgtttgatggccgccgccgccgcttcgcctccggttcctttaggacccgatgcctccgatctactggacggggatctccgtctcaagcccgctgtggcaatctcatgggattccgaagcactacacagccatgcagaaaggtgtgagatagagtcaaaagtgtgtgtcattgatccttctctgcttccagctctagatgatttattgcaggacatctatgaatcattgcaaccacagccagtggactatgaacaccgaaaccttatggttaatgttttcaacaaaattgttggagaaatttttggtaaaaataatgagcttccaattgtggaaccatttggatctttcacaatggatctatttactccctcaagtgacctggacctctctgtgaacttcatactgatgcaaatgatcagtatcctcgcaagaancagatttctgctattaggaagcttgcacatgttctattttctcatcagcgtcatggtcgctgttatgggtgttcacctattgtgactgctagagttcctgtactgaaggttattgataagggaactggtgtaaagggtgaattttcagtaaaaaaacaagacgggatggcaagaatcgcccatttaaaatttatttctccaaatggaaaaaagatccccgaatcttttgtttctctgagaaaattcttggcctaagggaacttgaagggaacggcccccaaaaa

SEQ ID NO: 93311 - protein, 170 aa, Zea mays
  misc_feature: Ceres CLONE 1582535
  misc_feature (143)..(143): Xaa is any aa, unknown, or other
MAAAAASPPVPLGPDASDLLDGDLRLKPAVAISWDSEALHSHAERCEIESKVCVIDPSLLPALDDLLQDIYESLQPQPVDYEHRNLMVNVFNKIVGEIFGKNNELPIVEPFGSFTMDLFTPSSDLDLSVNFILMQMISILARXRFLLLGSLHMFYFLISVMVAVMGVHLL

SEQ ID NO: 93312 - DNA, 986 bp, Zea mays
  misc_feature: Ceres CLONE 1582536
  misc_feature: Translation starting site: 259
  misc_feature (825)..(825): n is a, c, t, g, unknown, or other
  misc_feature (986)..(986): n is a, c, t, g, unknown, or other
tccccttttcctttcccgctttccctttcttctctcctcgtcttttttttttgcttctttccctgtcgacctattttaaaactggagctcccccggtggcggccgctctagaatagtggatcccccgggctgcaggaattcgtctcacccctagaaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgcttctccatcaatcgacaggcgggcatcgggcattgaccaaagtccgaacccttggtcaaccaacctccgggtacccatcgccccagggtcccggggacccaaggggagtttccattgggaaaacccccctttgcctggccttgggcggcccttgaataggtggtccaaaatggaatttgggggcgccaaggtttccggggggggtccccggtgttttcccctaaaccttctgggcccctatacccctcccgttcaccccccgaaagaaagggggttcccgttccttttgggaccccccccccaagagccattaaaaccgcaaattgtaaccaaaagcncaggtttccccgttggtgtggggaaaaaatcccccacaggcccggggcgcgacggggtccccttttccccccggggttaaccccccgggggagacacccccttcttttgggagagaaacaaaaaccctctgggggaccagggggagaaaccatagagaaan

SEQ ID NO: 93313 - DNA, 1253 bp, Zea mays
  misc_feature: Ceres CLONE 1582539
  misc_feature (14)..(14): n is a, c, t, g, unknown, or other
  misc_feature (1253)..(1253): n is a, c, t, g, unknown, or other
gggtggttgtgggnggcggcggagggccgccgtcgggtttgttctctttcctttaaatatagaaagttactgacaagctgaactccccgcggtggcggccgctctagactagtggatcccccgggctgcaggaattcgtctcacccctagaaaaattacttattccgtgggtcggaagcggggcaccgcccctccttttggctccgaggcccggcctcgccgggccgatccgggcggaagacattgtcaggtggggagtttggctggggcggcacatctgttagaaccccccacccacctcggacctgctgctccctccactcaccacccccggccgagcgaattgaagaagctccccctctgaactgaagcaatggcaggcggcaatgccggtggcgccgctcgagtcctgttctccatcctccgcctggcgctggcgctgccgctactcatggccggcgacgaaccgtacccccatctttaggtggacggggaactaacggaacatctacccccctggctggtccagggagaatgggaactcctcattaaaaaacccaggtttcccggggggccgcaacattgtaaagccccttcctgcaaacgaaccaatccctccttcaggttaacatgaacttttcaaaccaaggctttgttactgagagcccggttttcccttccccttcttctccttggggaaagccggggggcctgtcccaggccctagatgtgcggccccgggagaaaaccttacgcttttatacccagagagcggaaaagcgcggtgattgattcgggggccccccccgggggggggtgaatccccagaacgcctttttgttccccaccacgtgtagatttccccctcggccaccccccggggagggccctaccctcccaaaaagccctagtttttatgggccctttatgtgagaatttccacctgtgtgccagcggggtgcccccctcagggggcaagagctgcagagaaatatcctcggggagcatcgcgccctaagtatatatataaagtacctattagaccaccaagacccgagcgacgagagcggtcattttttttacacaaaaaaaagagggtcagtttccccgtgagacagggtggtttctcgcggtggtgtgaagaaacccttgcatgcgggtgatatactctaaccacattccgcgcacacgtaagaaagatacctcacattcccccttttatccccgcaccagcccgggtgctgcgcctttan

SEQ ID NO: 93314 - DNA, 1243 bp, Zea mays
  misc_feature: Ceres CLONE 1582540
  misc_feature: Encodes the peptide sequence at SEQ ID NO. 93315
  misc_feature (68)..(68): n is a, c, t, g, unknown, or other
  misc_feature (69)..(69): n is a, c, t, g, unknown, or other
  misc_feature (435)..(435): n is a, c, t, g, unknown, or other
atcttctttataactattgtatctctttttcgcgacccctctcttccaaatacaagacgataaaaaannacacaaaactggactccccgcggtggcggccgctctagaactagtggatcccccgggctgcaggaattcgtctcacccctagaaaaaacgagacaaaagacgcccgccccggccggcgaccagtacctcgccattgctagtgctagccgccgtcgctggtgtcccctcctcccacttgcgccgcctgtccccgcgccctcgaaacctttttctcccaaaacagatttcgtcccggcgctctcctgcaaagggcggctagctgtcgccgatggatacgtttcacctctgtctcactgcttgggggggttcttgcttcttcccgctttcccaaagaaggccagcagcagacgaaacgagcaaaagggngcaagaaaccctgggtctggtgaatttaagggccccaccctcttgtttttttgttaggcgggaaaaaacaaaggctctctctccttcctgggtccctctttcccgccgggcttcctcccttggatcttgattccaaaaagggcaaaaacccctctcgggggtaggggaaaattggcttgatgggtgaaaacccctgagtaaaaaataatgcccattctcggccctattgggaagccaacctcccctcggggtggttctccaattaactttggcaatatggaagtttcaaaaaacctctcttcttgtggggggccgaaggccgaacaaacatatacctggtggggtgtttttctcagagcgccctataaaaatatactttgtctgagccctgagtggtacacctttgtggcgagtgggacacttgaaatatctccccctcaccgcggggtgtattggcgctctactcccctccaaattatgggcgtgggcgcccaacacaaatggggggggcaacaaaagggtctatcaaggggtcgggtggttctcacaaggacacgactcagatttgtttttctctagaagaggtgttgtaataataaacacactctcttgcacgggtgaggccccacctccatcctcgagagaaaccatagtgtttgctccaagataggggaatatatagtggggcgggttaccttaagagaatgttctcgtgatacttccccataaaatatggggccattcttggccccaggaaacgccctgccatattatatctgggaggaaccaatgcgcggtggtagggtgg

SEQ ID NO: 93315 - protein, 75 aa, Zea mays
  misc_feature: Ceres CLONE 1582540
  misc_feature (33)..(33): Xaa is any aa, unknown, or other
MDTFHLCLTAWGGSCFFPLSQRRPAADETSKRXQETLGLVNLRAPPSCFFVRREKTKALSPSWVPLSRRASSLGS

SEQ ID NO: 93316 - DNA, 961 bp, Zea mays
  misc_feature: Ceres CLONE 1582541
acccgcggtggcggccgctctagaactagtggatcccccgggctgcaggaattcgtctcacccctagaaaaaaactgccgcctagccctacagtcaaccgccgccaagcccggaaccggctgccgccacctgctagcactcgccacacgcgcggcgctggcgtgccctcgccgccgacagtgtcccgcccccgccgtcggccgacccctcgcggcctcgccctcgacgatcggccctcgccggctcgacgcgtgacgccggcgccgccacccaccgtccgacggcctagccggagtcggacgcccccgggctcgcgcctcgccttccaacagtccaagcgccgcattcgcgcgtggccaaccccaaagtctgaagttcgatccacatccaccgatccgcagaggcgcagactacaagtctctcctacagggttctcgttcttcagtgcgtgatatcaatccactgaggcgctgggtgcagttaattttcccaaactataatttggggggtgttcagcaaaaaaccggcgtcaattgcaccccgtgcggggtggaggggattacctaaaagggctgggacttccttgcctaaaagaatgggtggaaagggaaaaaaccaaaggggccccgcctaatgaagccttggaaccgcggtttttttggaggaggggttaaaaagaagaaagacccattggcttgaaatatattcaccaaaccagaacttccaacagaaggttttgtgggttaaatttaagggggccctcaaagaacccgaaataaaggttttttgggattttttcttggggaaagaagacttttctcttccaggcggccaaaggggatggagaaacttgggggcaaatttggaaaaattccttccgggggaaaatctttttgaaaattgtagagctttttgagccttcaaaacccaaaaggaaaccgtgctttctgccctttcgggg

SEQ ID NO: 93317 - DNA, 829 bp, Zea mays
  misc_feature: Ceres CLONE 1582550
  misc_feature: Encodes the peptide sequence at SEQ ID NO. 93318
  misc_feature (622)..(622): n is a, c, t, g, unknown, or other
  misc_feature (736)..(736): n is a, c, t, g, unknown, or other
ctccccgcggtggcggccgctctagaactagtggatcccccgggctgcaggaattcgtctcacccctagaaaaagcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacggnactgtcgtgctcacgccgcatcagggccaagaagcctcctcccacttgctgcccatcaacttcgatggactcgccaaggctttgacacaggtgcaacgatatttgtgggccaantactgttcactggtagcgagactacttcagttttggttggagggttctgaaagtaaaggagatgaatgtggttttgtatcatcaagaacacgt

SEQ ID NO: 93318 - protein, 183 aa, Zea mays
  misc_feature: Ceres CLONE 1582550
  misc_feature (30)..(178): Pfam Name: PK Pfam Description: Pyruvate kinase, barrel domain
  misc_feature: SWISSPROT Homolog: EC 2.7.1.40 Pyruvate kinase
  misc_feature (152)..(152): Xaa is any aa, unknown, or other
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSHLLPINFDGLAKALTQVQRYLWAXYCSLVARLLQFWLEGSESKGDECGFVSSRTR

SEQ ID NO: 93319 - DNA, 1894 bp, Zea mays
  misc_feature: Ceres CLONE 1582556
  misc_feature: Encodes the peptide sequence at SEQ ID NO. 93320
agatccgccagagcaaaccctagccaatggacgccgccgccgttcacaagcgcaagcgacctgaagaggccgacccaagcgcgggggagctcgacctctccgccgccgacgccgtcgaggtactcgacctccgggccgccaaacgcctccttctggccttcgagcgccgcctccgtgacaacctcgaggcgcgcatgaaataccccgacgaccctgcccgctttgcagactccgagatcgcgctccacgccgagaccgaccgcctccgcctccttgccggcgcgcctgagctcttccccgacctcgtccccatcggcctcgcctcttccctcgcctcccttctcacccacgacaatgtcgatctcgcagctgccgccgcatcactcctcgccgacctcaccgactccgaggacccctccgacctcgccgctgtccaggccctcgccgacgcgctcgtcgacgccaacgcgctcgacctcctcgtccacaatctctcccgcttttccgagaccgaccccgatgaggccgaggccgtgcacaacaccctcgccgtcctcgagaacctcctcgacctccgccccaacctcgccgacaaagtctgcggcggaaccaagcttctacgatggctcctctcgcgcgtcaaggcacgcgagttcgacgccaacaagcagtacgcctccgaaatcctcgcgatactcctgcagaacagccccgccaatcagaagcgcctcggccagatcaacggagtcgacgccctgcttcaggcggttgccatgtacaaatcaagggacccaaagacgtctgacgaggaggagatgctcgagaacctcttcgactgtctctgctgcgtgctcatgcccctggagaacaaggagaggtttgtcaaggctgaaggtgttgagctcatgatcatcattatgaaacagaagaagctggcatacagctctgcgacccgcaccctcgattttgccatgaccaagttcccgcctgcgtgcgaacgatttgttgatgtgcttggccttaagactgcttttgcggccttcatgggcaagattcccgtgaacaagaaaaacaagaaagagagttaccaggaggagctagaagagcgtatcatttcacttattgcttcattgtttggtggtattaccaaaggctcacgaaggatgaggctactaggaaaatttgttgagaatgaatgtgaaaagatagaccgccttatggagttatacacaaggtattcagacagagtgaaagaagagactgaaagacttgatagtcttgatttggaagatttagagatggacgatgatgagcggtataaccgaaaactcgaagctgggctttacacactgcagttaattgcgcttattctgggacacatctggcactctgggaattcccagatgagagcaagagtagaattacttcttaagcagaacaaacttacaaagcaagatgtgaagagcatacttgaggagtaccatgacaacattggagatttggatggacctgaagagaaggaaagagcacaagtgcggaccaaggaaattattgacgcgttgtgatgtgcatgggcctagggtagttggttgtggagcaagacagaggctggtagatattttgagtatgttgagtgaatttatatccgcagtcagcaaagctgtgtaacttactaggttgtagatgatggatgtcagaaacaagggtgcattaattagttctgttgtattctatttttgtgtaaacttgctagttactatttgtcgttatatgctttgggaaggaatttgtaacacctcaaaaacttaacttgggaatttagtaaaattctccaaaaaaaaaaaaaaaaaaaaaaaaaaaaaaaaaaaaaaaaaaagaaaaaaaaaaaaaaaaa

SEQ ID NO: 93320 - protein, 512 aa, Zea mays
  misc_feature: Ceres CLONE 1582556
  misc_feature (13)..(118): Pfam Name: DUF1716 Pfam Description: Eukaryotic domain of unknown function (DUF1716)
MDAAAVHKRKRPEEADPSAGELDLSAADAVEVLDLRAAKRLLLAFERRLRDNLEARMKYPDDPARFADSEIALHAETDRLRLLAGAPELFPDLVPIGLASSLASLLTHDNVDLAAAAASLLADLTDSEDPSDLAAVQALADALVDANALDLLVHNLSRFSETDPDEAEAVHNTLAVLENLLDLRPNLADKVCGGTKLLRWLLSRVKAREFDANKQYASEILAILLQNSPANQKRLGQINGVDALLQAVAMYKSRDPKTSDEEEMLENLFDCLCCVLMPLENKERFVKAEGVELMIIIMKQKKLAYSSATRTLDFAMTKFPPACERFVDVLGLKTAFAAFMGKIPVNKKNKKESYQEELEERIISLIASLFGGITKGSRRMRLLGKFVENECEKIDRLMELYTRYSDRVKEETERLDSLDLEDLEMDDDERYNRKLEAGLYTLQLIALILGHIWHSGNSQMRARVELLLKQNKLTKQDVKSILEEYHDNIGDLDGPEEKERAQVRTKEIIDAL

SEQ ID NO: 93321 - DNA, 845 bp, Zea mays
  misc_feature: Ceres CLONE 1582560
  misc_feature (794)..(794): n is a, c, t, g, unknown, or other
ctggagctccccgcggtggcggccgctctagaactagtggatcccccgggctgcaggaattcgtctcacccctagaaaaagccgccataatctcctccgctccgctccactccgcattgcaggattgcgccgagcacgagcaccctcctccccgaaacctcttcttggctctgctttcggtggtatggtgggatgatgagcagggcggcagtgctgctgtgtctcctctgctgcctcgccgccgccggcgaggcggcgtcagtggtgggcgagggcgaggcggcggagctggccgtgtcggtgagacccgtcgtggcggttccccagccagcggctgcgggacgcgtacgtcgcgctgcagacctggaagcagcaagccatcttctccgaccccaggggtttcaccgccgactgggtgggcccgggggtatgcaactacaccggggtcttctgcgcgccgctgccgcgcagggtgccgggcgccagggagctcgccgtcgcgggcctcgacctcaaccacagcgacatcgcgggctacctcccgccggagctcggcctcctcgctgacctctcgctgctccacctcaactccaaccgcttctgcggactcgtccccgccactctgcgccgcctccagcttctcgtcgagctcgacctcagctacaaccgcctcgtctgggcattcccggccgtcgtgctggagctcccggcgctcaagtgcatcgaactgcgcttcaacgacttcgaaggcggcatccagccggagctcttcgacgcccgctcgacgcatcttnctcagcagaatctgactcgctcgcgcttcccgacaacttcactactgcccg

SEQ ID NO: 93322 - DNA, 886 bp, Zea mays
  misc_feature: Ceres CLONE 1582561
  misc_feature (46)..(46): n is a, c, t, g, unknown, or other
  misc_feature (62)..(62): n is a, c, t, g, unknown, or other
  misc_feature (74)..(74): n is a, c, t, g, unknown, or other
  misc_feature (76)..(76): n is a, c, t, g, unknown, or other
  misc_feature (84)..(84): n is a, c, t, g, unknown, or other
tcacccgccggtgggcggcccgctctagaaactagtggatcccccngggctgcagggaattncgtctcaccccntngaaaaaanaaaaaaaaaaaaaaaaaaaaaaaaaaaaaaaacccaaaaaaaaaaaaaaaaaaaaaaaaaaaaaaaacctatttctggggctagctatggccgggtagcaacggaaactctgctgctcgcactccgaatcgtccttttctgccccctcccctccggggccaccaccttgctccctctcgtcaaaaggccatgcccctactccctgccaaaaaccatcctcgccgccaggggcctcaaccctcgcctcatctcctgcgcgaacaacggctcccccaaggcccacctgtcgaatggcaatggaggccacaacaaggccggtagcggcggcaggcccatagtcaccaacctgctgtcgtggggaaagcccccgcctccaatccaaggggttcccgcctttccgttgttgccccccaaccccggggtcaaacactgccgtccccaacttcagtttccccgacccagggaaagcccctcccgaaccgggaaacacaacccaagggggcccccggccccgaaaaacgttccccaaggaacccccccccccggggggcccctaaataaaggccctttccggaaattcgaaacccgccaatttttttaccaaaaagggcaaaaaatccacggggccctaaaggaaaccccgggggtaacccaaaaaggggggggcgccccgaaactccccccttaaaaaaccccttttttggggggggtttttttccccttttcaaacggggcctaaccttttattttttttaaaaaacgcttcgcggaaaaagtcccccgagggaacacccgcgttttc

SEQ ID NO: 93323 - DNA, 768 bp, Zea mays
  misc_feature: Ceres CLONE 1582565
  misc_feature: Encodes the peptide sequence at SEQ ID NO. 93324
ctccccgcggtggcggccgctctagaactagtggatcccccgggctgcaggaattcgtctcacccctagaaaaaaagcctccgattggatggcggctgtgttggcctgaggtacaccactccttccattgttagagtaccactactccattagtaccagcgtaccaccaccaccgaaaacgaatcccagaacagtaccgcagcggcagccatggtgctctcgcacgcgagctccggccgggacgacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagacagctattggggtcggaacagtgggatcctcggaagcgatcatgcttgcaggtctggcgttcaagaggatatggcagaacaagaggaaggagcaggtgaaaccgtgtgacagaccccacatcgtcaccggtgccaacgttcaagtctgctggggagaagtttgcaaagtattttgaggtggcagcctgaaggaggttaagcta

SEQ ID NO: 93324 - protein, 176 aa, Zea mays
  misc_feature: Ceres CLONE 1582565
  misc_feature (35)..(175): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRIWQNKRKEQVKPCDRPHIVTGANVQVCWGEVCKVF

SEQ ID NO: 93325 - DNA, 863 bp, Zea mays
  misc_feature: Ceres CLONE 1582566
  misc_feature: Encodes the peptide sequence at SEQ ID NO. 93326
  misc_feature (581)..(581): n is a, c, t, g, unknown, or other
  misc_feature (702)..(702): n is a, c, t, g, unknown, or other
  misc_feature (723)..(723): n is a, c, t, g, unknown, or other
  misc_feature (765)..(765): n is a, c, t, g, unknown, or other
  misc_feature (813)..(813): n is a, c, t, g, unknown, or other
  misc_feature (863)..(863): n is a, c, t, g, unknown, or other
gcggtggcggccgctctagaactagtggatcccccgggctgcaggaattcgtctcacccctagaaaaagcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccaccntctgtggtccttgctcaggggctgattgctgaggggtgttaggtcgtagcagctggtgctaatccctgtcagattactcgtggtattgagaaacagctaaagcactagttgaagaactacngaaagtgtctaaagaggttgnagatagtgagcttgcagatgttgctgcagttagtgctggcancaactatgaaatggtaacatgatagcagagccatgagcaggtcggtcngaaggcgtgtcaccctgaaagagggaagagtctgagacttccttcatgtn

SEQ ID NO: 93326 - protein, 135 aa, Zea mays; identical to SEQ ID NO: 89716
  misc_feature: Ceres CLONE 1582566
  misc_feature (126)..(126): Xaa is any aa, unknown, or other

SEQ ID NO: 93327 - DNA, 868 bp, Zea mays
  misc_feature: Ceres CLONE 1582569
  misc_feature: Translation starting site: 200
  misc_feature: SWISSPROT Homolog: EC 5.4.2.2 Phosphoglucomutase
ctccccgcggtggcggccgctctagaactagtggatcccccgggctgcaggaattcgtctcacccctagaaaaaacaccaccactccctcactgccctctcactcccgatccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaagatgctgttcagatcataacaaaaatggctgctgccaatggagtaaagacgtgttggggttggacaaaacagtctcatgtctactcctgctgtatctgctgtcatccgggaaagatgggtgcagatggatcaaggctactggtgctttcacttgaacgggagcttaaccaaggggttcttacggaggatttgggatcaaaaacaaatgggaaaagggggacttccccctaaacccctacccaaaaaattttcttaaaaaaccaaaatcctgaaaacccctttttgaaaacctcccaaatgtaattttttggtgggggggccccccctttgggacccaagggcccctttgggggggggctttcccccccgggggaaaccccagagggggggaaacattttttttcttaaaaaaaaaagaacgcgccccccccaaaaatattttttttggggggccggccgggg

SEQ ID NO: 93328 - DNA, 835 bp, Zea mays
  misc_feature: Ceres CLONE 1582572
  misc_feature: Translation starting site: 287
acccgcggtggcggccgctctagaactagtggatcccccgggctgcaggaattcgtctcacccctagaaaaaaagcgagcgcttccccccagatctcgacttctcgagcctgtcctccgccccccacaggctctgctggatccagaaccttctagaacccctgcactgcgcggtgcgcgccatcctcctccttccttccatccagatctcgacacccctcgccggcccagacctccggtcctgtcgtggccccggggttcgggcggctgccaaagaatcagtggccatgggatctgctatcctcaacagcattgcccccgaggagcctaaagtggtcgtgccagagtacggtgagacggctgatatccaggacaaggaagttagtatggaacagctctgctccataagcacctatgatcagtggacgccactctctgtttctggccagcttcccaaaccacgctataagcatggagctgtggtgattcagcagaagatgtatgtctttggtggaaaccacaatggccgttaccttggcgacattcaggttttggacttcaaaactttgtcatggtcaaagctgggagctaaatcacaagcagaaccatcagaatcagctgggagcagttcccgtttctgcatgtgctggccattcagtgattcaagggggaaatagatcctatgtcttgcaggacataccagagacctgcagaaagtctcagtggttaagagtttgatccccaaacctgcacttggtctaccttgcggtactatgggaaggcaccctagttcccgtggtgggtcagtccagggacccttggttgaagacactctg

SEQ ID NO: 93329 - DNA, 1047 bp, Zea mays
  misc_feature: Ceres CLONE 1582573
  misc_feature: Encodes the peptide sequence at SEQ ID NO. 93330
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (58)..(58): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (84)..(84): n is a, c, t, g, unknown, or other
  misc_feature (874)..(874): n is a, c, t, g, unknown, or other
naaaannnnnnnnnnnnnaaaagaaccaaaccaaacaacacagaaaacaagaggagangggggctccnnnnnnnnnnnnntggngttccccgcggtggcggccgctctagaactagtggatcccccgggctgcaggaattcgtctcacccctagaaaaactcctcgccagaggagagtctcgctagctagggtttccaccaatggcggcgcccaccacctcccgccgcggccccggcggcgcgcgcaacatggacgatgaaaacctcaccttcgagacctccccgggggtcgaggtcgtcagcagcttcgaccagatgggcatcaaggacgacctcctccgcggcatctacggctacggcttcgaaaagccctccgccatccagcagcgcgccgtcctccccatcatcaacggccgcgacgtcatcgcgcaggcccagtccggcaccggcaagacatccatgatctccctcaccgtatgccagatcgtcgacaccgccgtgcgcgagtaataatatctatttattactgttaccatcctccttcattccttgcatgtagattattggggcgagcaaagccattgttggttttttaagaaacactgggttgcctcccccgatttaaccgggaaaccaaatcagaaaaggggccttcttaatttatgcccccggttttggaaacccccctagaaaggtaaaaaatttagtgttgttaagggtttcccaaaacacccccctcagaataaaataccggcaatcctaaaattggttaaggccccccgtccacccagcgctaaaaaaatgtaggttccattaaagccggggctttaacccccaaacctcaaaaaattttatttaggccgggaaccaaacntaatttattctcccaagggggggtgccacaaaaaagggcgccctaaggacctggccgagccccgagcccggttgagaattttatccccacacggaaaaggagcgttatctgggcaaacccaccggagaatttaggggccaaagggtctagatttttgactccctcacaaattt

SEQ ID NO: 93330 - protein, 102 aa, Zea mays
  misc_feature: Ceres CLONE 1582573
MAAPTTSRRGPGGARNMDDENLTFETSPGVEVVSSFDQMGIKDDLLRGIYGYGFEKPSAIQQRAVLPIINGRDVIAQAQSGTGKTSMISLTVCQIVDTAVRE

SEQ ID NO: 93331 - DNA, 1271 bp, Zea mays
  misc_feature: Ceres CLONE 1582575
  misc_feature (66)..(66): n is a, c, t, g, unknown, or other
  misc_feature (67)..(67): n is a, c, t, g, unknown, or other
  misc_feature (71)..(71): n is a, c, t, g, unknown, or other
  misc_feature (73)..(73): n is a, c, t, g, unknown, or other
  misc_feature (76)..(76): n is a, c, t, g, unknown, or other
  misc_feature (789)..(789): n is a, c, t, g, unknown, or other
  misc_feature (917)..(917): n is a, c, t, g, unknown, or other
  misc_feature (1140)..(1140): n is a, c, t, g, unknown, or other
tttttttctttccccccccttttcgtttttggttttatgagatttgattgggattatttggttttnntgtntnttnttaataatggggctccccgcggtggcggccgctctagaactagtggatcccccgggctgcaggaattcgtctcacccctagaaaaaagaaaacagtccaaataaaactcgtggtcttgtccgtggccccgtgctacccttctccctccacctccgcggcacccaaggtaacctcgccacgtccacatctgcgtgcgagcaccaaccgtcaccggccctctaattaagctgcccgcgcggcgcgatccggtgtccacgcgctgcccctcctgaggaggaggaggaaagggggcggagagtggagcaattcgggtcagattctgggatcctcttgtggtttctcggcgaatcggcgagatcgggactcccggccggagaatcttccgtctgtttcgctaagtgtttggaacacccgacgtggaagaatgaatgcgaatagcgttcccttgaaagggaaaaaatatatggggcctgattctttggcatttttcatagggaaagatgttgaaaataatgaagaaaacacgcaccttcgaaaatcggccgccaagaaaccattccctgcgaggaaggataatcttggcgtagatgtttaacctatgaaactagatttatccgtttgtattttatctcaagaaggtgactggcccgcaacttcccttttttgtgggagcaatagagtaccaataaatgagtacccttatgagaaacacntttagtttctacaccttgctcccctctcctatgtggagtgaaaataaaaggaacaagacttgaatatatagcggcatgatgggtgggtcccacgataggagtgggtcggggtttttgattcttataanggaaaagagtgggaggcggagattctactatgagatcacaaggtgagaactaaatttgtggacacaccaatcaaactccgccgtaatgtattatatatatctcttctggcgtataatggaaatgactataaaacatgtgtgtaaagactatacatatttatgtttgtttcagataacatgcatattcactaacggggatagtgtaagcttgtgtttacagaanaaacgcaccccgatgagggagaggagaggagtatagtgtgggatgaaacatactggagcaggcctaatttgataggagtgagtatctctcgcgggttataagatagggcagcgagacgttagatcacatgg

SEQ ID NO: 93332 - DNA, 1148 bp, Zea mays
  misc_feature: Ceres CLONE 1582581
  misc_feature: Encodes the peptide sequence at SEQ ID NO. 93333
  misc_feature (18)..(18): n is a, c, t, g, unknown, or other
  misc_feature (46)..(46): n is a, c, t, g, unknown, or other
  misc_feature (72)..(72): n is a, c, t, g, unknown, or other
  misc_feature (1006)..(1006): n is a, c, t, g, unknown, or other
ttttcctttttttcgttncttaacatataccctattaaataaaatncaaaattaaaaataaaaaaataaagncaaactggagctccccgcggtggcggccgctctagaatagtggatcccccgggctgcaggaattcgtctcacccctagaaaaaacaccaccactccctcactgccctctcactcccgatccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaagatgctgttcagatcataacaaaaatggctgctgccaatggagtaagacgtgtttgggttggacacaacagtctcatgtctacctccctgctgtaatctgctggtccatccgtgaaaagaattggctgcaaaatgggatcaaagggctactggagtgccactttcatcgttggaagcctaggcccataaaccccaggtgggagccctcacgggaagggaacttttgggtcattcaaaattaccaactaatggggggaaaaactggtcgggtaaccctggacccccctggaaaatacccgatttacccccgaaacaaagaaaaatttttcccgccccaatataacagaccgtaccgaaaatctacccgcgaaagaaaaccctccacttctttacgggaaagaaaaccctttccccagaaataagaatcggacacaattttccacagattagcaacccgccgtattatacccaaaatcactttaacaggggaggagaacctccgagaaagggccccgcctntttgtgaatgggtgtggaatatttcattgttcgaaaccacctcatggagggtgaaacaatatttcatcattagaagcctctattatataatagacacaaaatgtattcttagagacgttttccagagaaacatacaatataa

SEQ ID NO: 93333 - protein, 100 aa, Zea mays
  misc_feature: Ceres CLONE 1582581
  misc_feature (16)..(100): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFEGQKPGTSGLRKKVTVFQQPHYLQNFVQSTFNALPADQVKGATIVVSGDGRYFSKDAVQIITKMAAANGVRRVWVGHNSLMSTSLL

SEQ ID NO: 93334 - DNA, 1119 bp, Zea mays
  misc_feature: Ceres CLONE 1582585
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (1056)..(1056): n is a, c, t, g, unknown, or other
  misc_feature (1119)..(1119): n is a, c, t, g, unknown, or other
nnnnnncccccccccccaaggagagggcggcaatggaggtcggagtgggaagatgaaagtatcagggtaagatttttttgtgctccccgcggtggcggccgctctagaatagtggatcccccgggctgcaggaattcgtctcacccctagaaaaatcgctcccttgttctctcccgagccgtccgcgaaccaacccgtgctacctccgattcttcgcctcgtcgttctttctagaacctccgctccgcctaatcccttgaccgggtcaagcccgaacgagactagggaggttccagcgccgccggtgggggagatggcgctggagctgagcctggcctcggcttcgccgccggcgggcggcggcttggtacaaacacctcccctccccccacgcgggaaggacctacaggggccggcgtggggaatccactgctatctccctgctcgtgctctaattaggtgtccgaacaacccctgtgacgcctcccgtttctagtagctgcccccaaggcaacaccctcgccttcttaattggacttaattgtttacgcggcccccggcaaaaaaatttgcaagtagggggggacgcccccacgaaggaccttgggaatcaagttttccgaacgaaaaaggtgccttttttcgcctggggtggcctcaatttaacctccccgaaacatatgaatcttcactctccgagaaggccttttttggcctatttataccttgcggcgaaaggaaaccctctttgccttggtgtggaggaaatcttttatagcgggggggaataaataacgggggaccaaaaagagtgtgtggatagttcaccttggggcgaaaaagatataaccaatgttccctgaacgggtggttataaaacaagaggggagttgcactgaaatgtctcatcgcctaaggagggggggacctccacacgcggtgggggatgggtattaagaagtgggtacaaggtgaggttcgagaggggctcgtccaggggcatggggagccctctctggagaatttggaaactagaatttaaaagaaataaaccgnccgagataaacaaggcgcccggaaactcgggatgtaaaacaggacgaatctccctactctaan

SEQ ID NO: 93335 - DNA, 1310 bp, Zea mays
  misc_feature: Ceres CLONE 1582589
  misc_feature: Encodes the peptide sequence at SEQ ID NO. 93336
  misc_feature (856)..(856): n is a, c, t, g, unknown, or other
  misc_feature (1027)..(1027): n is a, c, t, g, unknown, or other
  misc_feature (1177)..(1177): n is a, c, t, g, unknown, or other
  misc_feature (1181)..(1181): n is a, c, t, g, unknown, or other
  misc_feature (1289)..(1289): n is a, c, t, g, unknown, or other
  misc_feature (1310)..(1310): n is a, c, t, g, unknown, or other
cccggtgcgtaaaacgatgtttcttctattgccccccccgaccccccctacccaggcgtctcacaaatacccctcaccccgggcctccccgcggatggcgccgctctagaactagtggatcccccgggctgcaggaattcgtctcacccctagaaaaaaacacaccaccaaaggccaaagcgggacgggagccacagagatagttagcaagaagccacagatggcggcgatagcggcggccacccaagcggcggcgactgtgctactgctcgcggtgctagcgctggctgcgggaccgggcggggcgcgggcgcagtcggcgtcgccgtcaattcagtgcacgtctgcgctggtgagcctggtatccgtgcctcagctacttctctcggtaagtttcagtagccccgccgccgtgctgcaccctttttgtgtgggtgtgtcaaatgaacctagagaggtttgggggtggtgcccccgcgggggcggtggaggcaaggtttttcggtgtcgcgttttcccgccccgcctggttctctttcgcacgccttatatgtattctacccttccggatatttagacccccccgtaggtggtgggggttctttccagccctcggggggaggagaccctctcccggtatataattcccaatggaggtttaagaatagaatagtgctgtgtcactgaaggggtctacaagaaataaaaaccccgcttctctgtatcaagttggctgttcgcgcttgtgtgatacgcgcctccgcgactgtttccaacgcgggcactgagctatggatgttaccgcaccttagttgtatttatcgcgtcgcccgcttgattttgtacgttgaggtcnactgcgaccgcgcgcgcagtagtatacgagaggcagtatctactcattccaccacgacggattacctccatagacatctctgtgtcgcagtcccgctagtacgctacttattttgggttgacattcgatgatgagccgagcgctctcccttatggccggcgtccggggcgnggcggactaggtagttatattctcgctcgatttatacgactatgtagtgttgcgcatactctcagtgtgacctgcgccccgttacaccgtgaactgcctgtgaagatatgatatccgcgcccgataatacactaccttgtctgagcggtntagnatccgagacagtggtgtagcatgtgggcggggtgcggcgctcagctcacagatgttctcactacgacactcacttgtgtttgcgttctactgtgattgattgtagatncgtaacggaccggaggagagn

SEQ ID NO: 93336 - protein, 118 aa, Zea mays
  misc_feature: Ceres CLONE 1582589
MAAIAAATQAAATVLLLAVLALAAGPGGARAQSASPSIQCTSALVSLVSVPQLLLSVSFSSPAAVLHPFCVGVSNEPREVWGWCPRGGGGGKVFRCRVFPPRLVLFRTPYMYSTLPDI

SEQ ID NO: 93337 - DNA, 884 bp, Zea mays
  misc_feature: Ceres CLONE 1582593
  misc_feature: Encodes the peptide sequence at SEQ ID NO. 93338
ctccccgcggtggcggccgctctagaactagtggatcccccgggctgcaggaattcgtctcacccctagaaaaagagtgaacaaagagacgggggcacagtagtagaccgcggaatccgatctaaccctaaacccgaatcccaaacggaggagggcactcggcgaggcaggtggcgattctgcgattctcctgtcaccttccgtcgtctccatccccttccatttccggcgagggtcaaagcaggcctcttgctcttgggggtggtttgagagagggagagaacatggccgcggcggcggtgttggtggtgctcacggtgtcagcgctggcgggggcagcggccggcggtgatatcgtccaccacgatgacgaggcacccaagatccctggatgctccaacgattttatcctggtaaaagtgcaaagctgggtcaatggcaaagagggtggcgagtttgttggcgtcggtgctcggtttggtccaaaaatcgtctccaaggagaagcacgcaaaccgaactaaactcacgctggcagaccctatggactgctgctctcctccgaaacataaggttccctggagatgttctttttagtcaaaagggaaagtgcaaatttcccaagaaaagcaaagtttgctgaaggcttgctggtgccttctgctatagtaaatcataaaccatgtcccacgaattgtaacaagaggggcctgcgaaaaagaatgaaaccccacccttgaaaataaaatatacctggcagtttcttcctaccaaaaagaaggcagggtcccggcctttttacataccactttccttaaccaaatggggaaaacaaccggtttcttgggggcaagcttttacctcctccccgaatttcagaacctg

SEQ ID NO: 93338 - protein, 103 aa, Zea mays
  misc_feature: Ceres CLONE 1582593
MAAAAVLVVLTVSALAGAAAGGDIVHHDDEAPKIPGCSNDFILVKVQSWVNGKEGGEFVGVGARFGPKIVSKEKHANRTKLTLADPMDCCSPPKHKVPWRCSF

SEQ ID NO: 93339 - DNA, 1132 bp, Zea mays
  misc_feature: Ceres CLONE 1582595
  misc_feature (57)..(57): n is a, c, t, g, unknown, or other
  misc_feature (474)..(474): n is a, c, t, g, unknown, or other
  misc_feature (475)..(475): n is a, c, t, g, unknown, or other
acaaaaatataaaaaaaataaatttataagaagatcacaccaccccacccccaaaanaaaccccccccctaccaaaactggaactccccgcggtggcggccgctctacaacagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtccgnncccttttcttgcgactaagaacgacggagcggcgccggccagcgaccccgacaagctcttgagcctgctgccgtcgccgcccatgaagctccccatcatcgggcacctgcacctgaaggggggacatccccttacgtgtcccttcaccacgcctcgccaccaggttaccggccccggaccttgatggcttgctccgccctccggacccccgtgtccgaaccgtaggttgagtcctcgtttcgccgtccgcgtacacccaaaggcccgtttgctttccgccacccttaacgaaacaaatgggttctttcattcccttccccgatccctgcaggacttccccttggattgggactcgaacaaatcaatctatgtgttaacgggtgagcccaatccgaaataccttgtgcctttcaccgacccctttaacgggcggaaaccaacatttcccgacatgagtctctcgtaaaaagactggtgtacaccaggagcaagcttggcgcacaactgccaagtcaaggatgccgggtataccacccgtgaccccccctttcgaaagtaagaagattgtttcatgccgaacccactcaaagtattagcatattacgccgtgcctgtaatatagtataagtccctatgacttgaatcccatcctcgctc

SEQ ID NO: 93340 - DNA, 823 bp, Zea mays
  misc_feature: Ceres CLONE 1582596
  misc_feature: Encodes the peptide sequence at SEQ ID NO. 93341
  misc_feature (448)..(448): n is a, c, t, g, unknown, or other
  misc_feature (451)..(451): n is a, c, t, g, unknown, or other
acccgcggtggcggccgctctagaactagtggatcccccgggctgcaggaattcgtctcacccctagaaaaagcgctgcttcgctggctttcggcaacgccctttaccacatctgaatctcacccacccacccacccccgcgtcccccacctcatggcgccggcgatggggctgaagcggcctgcggcgggagcaggggcggcagcagcgcagaccgtcacgctgtccgcgcctgccgtgcgggacgcggtgcgcaccgccgtaagggaggccgaggccacggcgaaggctaccgccccggccgccagggtcccggcgacggcggcagtgccggcggagatcgctagggatggggtgctgtgccctgaggaagtcgacggggagcggtggagctatgtggtcgacgccgccggcgccgcggtcaaggccaagggaaggggcgtcgtcngcngcgccttcaaggccgtcccgctccagtccccgatgccgcccgtcaagaaatcatgtcccttatagaacatatggtgtgcccgaaggctttccagatatgtcacaccttcatagtgtccctacctgacatggagagcattgaaagcttttcttgggtgaacaaaggggggtgtttacaacaagaacctgctccaaccccgttgggaaccccccaaaacagggctgcctccgggggcctgggcattacaccggattccccaaggatgggggctgggcccttttaaaaaaaacccttttgccccccaagggaaaaaaatttttttttacccggaagcgcccccccttttcgggggaaactctgggggggagtaga

SEQ ID NO: 93341 - protein, 120 aa, Zea mays
  misc_feature: Ceres CLONE 1582596
  misc_feature (99)..(99): Xaa is any aa, unknown, or other
  misc_feature (100)..(100): Xaa is any aa, unknown, or other
MAPAMGLKRPAAGAGAAAAQTVTLSAPAVRDAVRTAVREAEATAKATAPAARVPATAAVPAEIARDGVLCPEEVDGERWSYVVDAAGAAVKAKGRGVVXXAFKAVPLQSPMPPVKKSCPL

SEQ ID NO: 93342 - DNA, 1333 bp, Zea mays
  misc_feature: Ceres CLONE 1582598
ataaaaactacaacaacgacatttagaaatttaaacccccaccccccccatgaagaccttaacccaccacacattttaaattggtactccccttagaggcggccgctctagaactagtggatcccccgggctgcaggaattcgtctcacccctagaaaaaacccctagaaaggaagcgcatccgctcgatacggggggtggcaggttggcgaggagacgaaaggcacggcgagcgagagcccaacgaccgtcctgttccagttccagcggcccgagcgagatcgatcgcccctccgcaatttcactaatttatacgcggcagtcgggaacaaggtgagttcttctgcaagcgcgggtagattacgcgagtccgttgcgctttgatgagaacaagattaagaaaaaataattgtcatggatgagggagttattattcccagaacttcaacccttcgctattggtggctgctttaattcctctcttcccccacccagcgaagggcattttcttttgtcccctatttcccgctggctatccagtgttattgttatcctcctttctccctgtcttgagatagaaggaacctgtttctccaggcaataacctcggcacctggtattcttatgattttttcccagaaatgcgaccgcacctacatggcctggagtcaccccgcaggctgatttcgcgaatcaccatgaagtcttcgcctgaagcgccaccacatgatgattgtcaacaacaggcttcccacttcatgcgacgtactattatttatgctgcgagtttcggcggagcacgctctagcgaatgctttcttgtgatttggcccgacaccccgtatgtgatattttggtgcatcatagctcgagagagctcaccgtatatgacatacaagtacatctaattactaagtgccatctatctattagcaagtctgcatagacagacaggcgtgaacacaagagtcattaaatctagaattacgtctctcacttacttgtctctcgaatccctgctccttgattatcatatctcataattttcactagtgcgactcgataatatatacgtcgataccgacccgcctttagtgagtgaagatcatgctactccatactagttgttacacgtctagttgtctggcgccccattagtgctgtataaatagattatccgcacgttggcgtgggagtatattattgtttacaatccgttatttcgcatatagcttaaatactctgtgcacggatattatgccaccgcgcctgctctctcctaaccgtagatatatagctgacccgtgatgtcctcatttctagatcgcactgc

SEQ ID NO: 93343 - DNA, 1930 bp, Zea mays
  misc_feature: Ceres CLONE 1582600
  misc_feature: Encodes the peptide sequence at SEQ ID NO. 93344
aacggaccgaccggcgaccgcacccaatgcaagcaatttttgcggacagggggaccttcctcttcttcttcctcgtccccggcccctgcccctctcccctgcggagacggagcgccaccttcctcaccttctagaaagaactagaaccctccctccagaaccttgaagaccagcccagaccagaccagccccgaagctctccgccggccccgcccttgacgacatgaagcaccagccgccgcgccgctggggcgtcgtggcggcggtcgtcgcactcgtcctcctcgcctgcctccagatccagtaccaccacctcaaggtggatctcggcaaggccggctttgcctctgccacgcaagagaataacgcgatccgcagccgcaatcgcattcgctggggccccgacaggaacggcgcccactccttgccgcgcgggattgtccaccgccactccgacatgtccctccgcccgctctgggaggacgacactgcttccacccacaagaataaaaacagtgactacagtgctctcctcgccatggcagtcggcatctcccaaataaaaaacattgacactatggcccgtaagtttctgaaggaaaactatgcagtcatgctcttccattatgatggaaatgtagatggatggcgtcatcttgagtggagtgataaggccatacacatccttgctcacaaccaaacaaaatggtggtttgctaagcgttttctgcatcctgatgtcatggctatctatgatttcatttttctatgggatgaagaccttggagtggagaacttcaaccctagaagatatcttgatataatggtgtccgaaggcttggaaataacacaacctgctctggaccctgatctatcaactgatatccaccatcgaatcacaatccgtaataagatggcaaaagttcacaggagaatatacgacaatcggcctagtatgaattgttctgacgagagcaaaggacctccatgtacagggtgggtagagggcatggcaccagttttttctcgcactgcttggaaatgtgtatggcatctaattcagaatgatcttattcatggatggggtcttgacatgaagcttggatattgcgctcagggtgatcgaacagagaaagttggtgttattgacagtgagtatgtagttcatcaagggataccatcattaggagggccatcacttagcagcaagacacctcgaagatcattggatttgaggacccacatacgaagacaatcatcggctgagctggagaagttcaaggagaggtggaacagggctgtaagggaagatgaaggatggagggatccttttgattcttgattacttggaaagcagagtgtgacacttctgataacaaaactggccagtggccacagtcacagcagtagagtttggaagcggagagcatcttctgcttcatgtcaaaaacacttgtttggttataggatgacgagacggttggttggttataggatgatgacttacatacacacacacacatcataactttatccacatgagttaaaagcgggaacattatcgtcaatacaaggagctgatggagaagttgaaactaacaaagtaacagggggtttccgaaagtgctgtaattttccgttggaaatatctgttcgggagagttgtatagtgtcatgatatacacacttgtgcagttatttgatgaggaaacttacatagcctagagcagatgtgtttcctatattattattgccttgtacaatgtaagatgaattccatgagtcagaaatagcatcaggtctctatgcttatacttggacaagttaagaggatggcacggcatattttttgtgtcaccgcaccgaggttgtcgctctctttatgtgtatcaaaaatataaaagctcttgtttaaaaaaaaaaaaaaaaa

SEQ ID NO: 93344 - protein, 372 aa, Zea mays
  misc_feature: Ceres CLONE 1582600
  misc_feature (55)..(370): Pfam Name: DUF707 Pfam Description: Protein of unknown function (DUF707)
MKHQPPRRWGVVAAVVALVLLACLQIQYHHLKVDLGKAGFASATQENNAIRSRNRIRWGPDRNGAHSLPRGIVHRHSDMSLRPLWEDDTASTHKNKNSDYSALLAMAVGISQIKNIDTMARKFLKENYAVMLFHYDGNVDGWRHLEWSDKAIHILAHNQTKWWFAKRFLHPDVMAIYDFIFLWDEDLGVENFNPRRYLDIMVSEGLEITQPALDPDLSTDIHHRITIRNKMAKVHRRIYDNRPSMNCSDESKGPPCTGWVEGMAPVFSRTAWKCVWHLIQNDLIHGWGLDMKLGYCAQGDRTEKVGVIDSEYVVHQGIPSLGGPSLSSKTPRRSLDLRTHIRRQSSAELEKFKERWNRAVREDEGWRDPFDS

SEQ ID NO: 93345 - DNA, 809 bp, Zea mays
  misc_feature: Ceres CLONE 1582601
  misc_feature (323)..(323): n is a, c, t, g, unknown, or other
  misc_feature (372)..(372): n is a, c, t, g, unknown, or other
gctccccgcggtggcggccgctctagaactagtggatcccccgggctgcaggaattcgtctcacccctagaaaaaccgtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggaagcccacccaggaactccgtccgctccggccgcgtccttctatatcgcatcggatctgatgggttttagtangagcagaaacgcttaggaatgcagaagattgctgcacgtcgagagctancttgtgagggacttggcaggaaaagcacgcatactcttcattctctgccacctcttgatgacttcgaagctcagaagacacgaatctccacctcgtgctttcgcacaatgggggttccgaggtgggggcttaaaccgttttctttaaaaaacccattcccggggggaaaaaggttgaaaagtttttaaacccctttcagaacctcttttggcgggccacaaatttttttttttaaccggccagggataaacaaaggggcccccttggtgggggtaccccccccccccccattggtgtggaaaaaaaagggggccaaaggggggaaaaaaaaaagggggaaaattttctttttccccaaattttaaaaagggggaaaaatttttttggccaaaaggcccttttttcaaaggggtttccaaggtttttaaaaaaggggg

SEQ ID NO: 93346 - DNA, 844 bp, Zea mays
  misc_feature: Ceres CLONE 1582607
  misc_feature: Encodes the peptide sequence at SEQ ID NO. 93347
  misc_feature (714)..(714): n is a, c, t, g, unknown, or other
gagctccccgcggtggcggccgctctagaactagtggatcccccgggctgcaggaattcgtctcacccctagaaaaagcacttgcagcaggaaagcaagctaggtgtggcgggtggcgcgcagcagggggcagggtgggtgcgtgctttcagttccctcttcattcaaagcgggcggagagtgcaacgagctactactactagagagcaaacagggcaaaggccagcaggaaagccttccgttccatcaaagggtttgctgctccctgccttcttcttcttggcatcttccgtcaaaggtattgcggcatctgaattggtgagcgacatcactgttcgtatagggactacaaagttttaccttcacaagtttccgctcctctccaagtgtgctcgctttcagaagttgattccaaccactggtgatgaaaatattgagatccacatccatgatattcctggtggcgcaaaggcttttggggtctgtgccaagttttgctacggcatgattgtcacactcaatgcctacaatgtgattgcagcccgctgtgctgcagagtacttggagatgaatgagactgttgacaagggcaatctgatctacaagattgatgtcttcctcagctcaagcatattccggagctggaaagactctatttattgttcttggtacaacaaaggctcatctaccttgggcagaggatcttaagctggntagccaatgcatttgactctgttgcttcaaaagcctctatcgacgtttcaaaaagtgaatggtcatacacatacaatcggaaagagctcccaactgagaatggtcatgattcgcccgtggaatgagtcaa

SEQ ID NO: 93347 - protein, 67 aa, Zea mays
  misc_feature: Ceres CLONE 1582607
MIVTLNAYNVIAARCAAEYLEMNETVDKGNLIYKIDVFLSSSIFRSWKDSIYCSWYNKGSSTLGRGS

SEQ ID NO: 93348 - DNA, 896 bp, Zea mays
  misc_feature: Ceres CLONE 1582612
  misc_feature: Encodes the peptide sequence at SEQ ID NO. 93349
  misc_feature (15)..(15): n is a, c, t, g, unknown, or other
  misc_feature (70)..(70): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
gtgtgtgggtggggncttcggggtctctctttccaccgaacgaactctccgagaaggagcggaggggttntgggggggggnnnnccaaactgggactccccgcggtggcggccgctctagaatagtggatcccccgggctgcaggaattcgtctcaccccctaaaaaaaaccaccgcttcctttcctcttcggctgctccgcctcgcctcccagttcacagcccctcccaggctccgaatcggcggccacttctcattcctcacttccgtcctcgcgcaccaccccctccatccgttccagatggtgccttcaaaatcccgtccagcgccctagcgtagctcgggctcggccaggctccaggcccgccgcgccgttccgcagtccagctccacctccagatcttttcttgagtttaaggaagatgcttgcctttatttagaaggccctttttggtacgtcagcagtgttctttcctataggagtaaatgccattccgtagcatcgtgcgtgatgtaagggatggtttcaggagcttgtctaggaggggatttgaggtcaggtttctgagtcatcgcagagggaaatctcatggtgctgtccatgagctgcaccacccagtgcttgtggtacagagtaacctgctgggcataacttagcctcctgaattacttcgaaatgtgatttgagaggttagagaccaggtgaggatacatgggcctttctagaaaacatggtagtttgcttttgggcacctggtctgccagaaacattggaaaaaaagaagtgttattagaagaatgttcaagaaagccccaaaagttttccctgggaaaaaaataaactttgttccctgggtttccccttgaataaccacgccctgggggccctccaaaat

SEQ ID NO: 93349 - protein, 56 aa, Zea mays
  misc_feature: Ceres CLONE 1582612
MPFRSIVRDVRDGFRSLSRRGFEVRFLSHRRGKSHGAVHELHHPVLVVQSNLLGIT

SEQ ID NO: 93350 - DNA, 949 bp, Zea mays
  misc_feature: Ceres CLONE 1582620
  misc_feature: Encodes the peptide sequence at SEQ ID NO. 93351
  misc_feature (949)..(949): n is a, c, t, g, unknown, or other
tccccgcggtggcggccgctctagaactagtggatcccccgggctgcaggaattcgtctcacccctagaaaaaaactccgtttcgaattctagggttttgctgctctccgaccccgagctccgaaggccgcagcatcaggcgaggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaaagaaaatttggtggcctccgggatggatactatatccatgggccgtgtgcgataatcatgtttgatggaacctccagggtttacttccaagaatgttcctacttcggcttagggattctgtggaagggtttctttaaaaaactttcccccttggtcctctcgcggtgatttacggttggatcctgaaaatatcacggcaggtctctaattcacacacaaggttaaacttttcgcactcgggagggcaaaaaccgcgtcagcgtcctcctacaaaacttttcttcgcccatatagcgaacccacccgttctcgtgcgaagaccctgaacgccggtttccctttgcacagggaaaacgtgggatgagaggctctataaacggtataacgttagtatgtggagagccggagtatattttaatacccccacataaaaccgccctactgacgctgggggttccggcggtctcagctccttgtgggcagtgaggctgtacctggtatctatctacatgcgcggttcgtcggcacgcatccgatatgacatggacgtggcactgtcatgtggan

SEQ ID NO: 93351 - protein, 127 aa, Zea mays
  misc_feature: Ceres CLONE 1582620
  misc_feature (15)..(126): Pfam Name: Ras Pfam Description: Ras family
MALPNQGTVDYPSFKLVIVGDGGTGKTTFVKRHLTGEFEKKYEPTIGVEVHPLDFTTNCGKIRFYCWDTAGQRKFGGLRDGYYIHGPCAIIMFDGTSRVYFQECSYFGLGILWKGFFKKLSPLVLSR

SEQ ID NO: 93352 - DNA, 916 bp, Zea mays
  misc_feature: Ceres CLONE 1582623
  misc_feature: Encodes the peptide sequence at SEQ ID NO. 93353
  misc_feature (45)..(45): n is a, c, t, g, unknown, or other
ggggggggggttgggggtttatggcggcgggtttgtcggtggccntcccaccggtagggtagtttaaatagttttttgattaaaaactgggactcaccgcggtggcggccgctctagaactagtggatcccccgggctgcaggaattcgtctcacccctagaaaaagtgagtctggcccaagcctctcgagtccacgagacctcactccactgtcgactccgccgagccgaccactgcaccccgcggccccgccgctccgctcgtctgccctggcgtcgccatcggccattcaacggccgcggaattcgaattcattcatacgcattccagagtccagactcatttcgaactaccccgccgctccgcctcgaccctcacctcctccccaatcccgcgcccttccaccctcccgccgaaagcccagcccggatggcgtctctagaaggcgaccggtggtcggagatcgtggccagcggccgtgcccggccgccccgcgtcggcgtcgtgtacggtcgtcgcctggtcgaggaatcgtccggcagggctaacatggagacgagagccagcttcagtggcctgcggcgcccgagcttcgtgccgcgcaagcgaaccagctggaaccggtcgctttccatcagagggagagagagtatcttcgtcgcacctggtgcaaatcttcaacagaaaccatgtgaagcaatgaaacgaccaccgaaaccgtgcaaccgagtgctgactctactatttttacatgccatttttttctgaaatttgttgaagtaaagtttttttgtttaagctttgtccatgttggtttaacagaagaaaaacggtctgggatgggcccctcccttaattttgaagccaaaggaaaaaaggccaatattttttggaaagaagatccgaattgccttt

SEQ ID NO: 93353 - protein, 112 aa, Zea mays
  misc_feature: Ceres CLONE 1582623
MASLEGDRWSEIVASGRARPPRVGVVYGRRLVEESSGRANMETRASFSGLRRPSFVPRKRTSWNRSLSIRGRESIFVAPGANLQQKPCEAMKRPPKPCNRVLTLLFLHAIFF

SEQ ID NO: 93354 - DNA, 909 bp, Zea mays
  misc_feature: Ceres CLONE 1582625
  misc_feature: Encodes the peptide sequence at SEQ ID NO. 93355
gagctccctgcggtggcggccgcactcgaactagtggatcccccgggctgcagtcctctcgtctcacccctagaaaaaatcccagcacgtctcgtctcccggccctcccacaaaaaaaaactgctcggttgctgctcctgctccgccgcgccggcatcatgtgtggcatcttagccgtgctcggttgctccgactggtctcaggcaaagagggctcgcatcctcgcctgctccagaaggttgaagcacaggggccccgactggtcgggcctttaccagcacgagggcaacttcctggcgcagcagcggctcgccgtcgtctccccgctgtccggcgaccagccgctgttcaacgaggaccgcaccgtctgtggtggtggccaatgggagagatctacaaccacaagaacgtcccggaagcagttcaccggcacacacaacttcagcacgggcagtgactgcgaggtcatcatgcccctggtacgagaagtacggcgagaacttcgtggacatgctgggacgggggtgttcgcgttcgtgctctaacaacacccgcgacaaggacctaacgtggcgggcgcgcggacgccaatcggcgttaaacccgctctacatcgggttgggggaagtgaacggtttccgtctgggatcggctccccaaaaaaaagggccctgaaacaaggaacggctgtgcccctatcagaatctttcccggccggggccaacctctatttccaaggccccgggggggggggttttccggcgggttgggtaacacccccgaaacatgggtttccagggaaacacagggtgccccggaaaacccctaatacacacccgctttgttctttcaaaaaaagggcccttttaaaaaaagggcggttcctatccaaaaggtgctcattcaacc

SEQ ID NO: 93355 - protein, 128 aa, Zea mays
  misc_feature: Ceres CLONE 1582625
  misc_feature: SWISSPROT Homolog: EC 6.3.5.4 Asparagine synthase (glutamine-hydrolyzing)
MCGILAVLGCSDWSQAKRARILACSRRLKHRGPDWSGLYQHEGNFLAQQRLAVVSPLSGDQPLFNEDRTVCGGGQWERSTTTRTSRKQFTGTHNFSTGSDCEVIMPLVREVRRELRGHAGTGVFAFVL

SEQ ID NO: 93356 - DNA, 975 bp, Zea mays
  misc_feature: Ceres CLONE 1582626
  misc_feature: Encodes the peptide sequence at SEQ ID NO. 93357
  misc_feature (445)..(445): n is a, c, t, g, unknown, or other
gcggtggcggccgctctagaactagtggatcccccgggctgcaggaattcgtctcacccctagaaaatatcgtcgatgggataatggcacattatgatgagatattcaggctgaagggtattgctgcaaaggctgatgtgttccatatactttcaggcatgtggaaaacacctgctgaaaggtgcttcttgtggcttgggggtttccgttcgtctgagcttctaaagctccttgtgaatcagctttgaagcctctaactgagcagcaattgatggggctatccaatctcccgcaatcctcccagcaggcttgaggatgccttgtcccaagggcatggaagcattggcagcaaatccttgggaaaaaaacccctgggttgggggtcccctttgggtcccatccaggaaacttttttcccgggggggagaaaaaaaaaaccacctgntcttgtttttggttttttttcactcttactctgaggagcgtgtctggtgcggggcgggcatagatagaagacgaatcatcctctcttctagtcccggtttctaccgctgactattctattcttttcctgcggtggtcttgtaccaacccgtattttttcttccttctttattgagctactctggcgtgacctacgcgcgcagggtgttatataataccatatacatattatgtattcccagtgcgatataggctaggtgtttctttcgttgggatccgcctcaactgtactctcttttctctcgcgctgcgcctggggagtgcggcttggcggcgtttgttagttaagataactccccctagtgccacacttacggccttttcgtgctttgagatgatttatatttgtctctgtttcttatctcaacttctctccacgaagaaccgttgcggtttccctttgcctggtgagggggtgattatttgtgggtcggtaacaagattgatgtgctacctgtccgtttcggtggg

SEQ ID NO: 93357 - protein, 81 aa, Zea mays
  misc_feature: Ceres CLONE 1582626
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
GGGRSRTSGSPGLQEFVSPLENIVDGIMAHYDEIFRLKGIAAKADVFHILSGMWKTPAERCFLWLGGFRSSELLKLLVNQL

SEQ ID NO: 93358 - DNA, 841 bp, Zea mays
  misc_feature: Ceres CLONE 1582628
  misc_feature: Encodes the peptide sequence at SEQ ID NO. 93359
  misc_feature (606)..(606): n is a, c, t, g, unknown, or other
  misc_feature (657)..(657): n is a, c, t, g, unknown, or other
tccccgcggtggcggccgctctagaactagtggatcccccgggctgcaggaattcgtctcacccctagaaaaaatccatccatgatccatcccccgcttcctcctcatccacactccgcagtgtcggggtcgctcaactcccacaacactctgcagccagcgatgcaggccctcacagcgaggtcccctgcttcttcgtcctgcccttctgcctccaccgtacaccgccgcggcggcacgcgcacgcgcagcaccgcccgcttcgccccgccccgcgccgcagcggcagcggccaactcggtcttcagcgcgccgcccgcagccgtgcgctacgccgcgccgcccaagccggcggcgcccattgcgccagtgcccgctccggcgccggcggcgggcggcgagaaaggcctgagcttcctgcagcgcgcggcgtcggcggcgctggacgcgttcgaatccggcgtgatcgcgggcctcctggagcgtccccgcgcgctgccccggtcggcggacccggccgtgcagatcgccggcaacttcgcccccgtcggcgagcagccgcccgtgcggtcgctgcccgtgtcgggccgcatcccgcccttcatnctcggcgtgtacgcgcgcaacggcgccaacccctgcttcgaacccgccgcngggcaccaactgttcgaacgcgacggcatggtgcacgcggtccgcatccgcacggcgccgccgaagtcgtacgcgtgcgctttcaacgagacggcgcgggctctgcaggagcgcggcctgggggccgggccgtgtttccccaaggcatcggcgagctgcacgggccactccggaatcgcccgcg

SEQ ID NO: 93359 - protein, 226 aa, Zea mays
  misc_feature: Ceres CLONE 1582628
  misc_feature: SWISSPROT Homolog: EC 1.13.11.51 9-cis-epoxycarotenoid dioxygenase
  misc_feature (148)..(148): Xaa is any aa, unknown, or other
MQALTARSPASSSCPSASTVHRRGGTRTRSTARFAPPRAAAAAANSVFSAPPAAVRYAAPPKPAAPIAPVPAPAPAAGGEKGLSFLQRAASAALDAFESGVIAGLLERPRALPRSADPAVQIAGNFAPVGEQPPVRSLPVSGRIPPFXLGVYARNGANPCFEPAAGHQLFERDGMVHAVRIRTAPPKSYACAFNETARALQERGLGAGPCFPKASASCTGHSGIAR

SEQ ID NO: 93360 - DNA, 840 bp, Zea mays
  misc_feature: Ceres CLONE 1582630
  misc_feature: Translation starting site: 153
  misc_feature (767)..(767): n is a, c, t, g, unknown, or other
  misc_feature (832)..(832): n is a, c, t, g, unknown, or other
ctccccgcggtggcggccgctctagaactagtggatcccccgggctgcaggaattcgtctcacccctagaaaaaattctccatttctccttccgccgccgcacttgtcccctgaccctaggtcaaagtatcgccgacttcgccagccggatcatgtcgaccagcgccaacccgaaactgaagcggcggcgggggggcttgcggaagcagggtcctgggtaccccacggtggccaccacgggggcaatgtttgcccatgaggtgggcgccgaagggccacggagggacacgaggcaaggacccgcgttgcctagggtggttgccacctcgaccaggggaggaggtgccattgagcagggcgctgacggaatggaaggttcggcgtcgaaaactgataggagcgttcacgaggcagttggcgtcgatggcacgtacctcaccgagacacggtttgatcaatgtgccatttctccactgtcactgaaagccatcaaagatgctggatatgagaggatgactcgggtgcaggaggctactctgccaataattcttcaaggaaaggatgttcttgcaaaagcgaagacaggaacagggaaaacagttgcctttttgggagcttgcaaaccaattggctgctgaggccaggaagcttctcaagtatcatcgctcactgggtgtgcaggttgtaataggtggcacacggttacctcaagagcaacggagcatgcaagctaacccatgtcagaatcttggtgctactcctggaanggctaaggatcatcttgagaacacgcctggattctcacccgaattagaagtgtcaaaggtcttgnttctagac

SEQ ID NO: 93361 - DNA, 875 bp, Zea mays
  misc_feature: Ceres CLONE 1582632
  misc_feature: Encodes the peptide sequence at SEQ ID NO. 93362
ctccccgcggtggcggccgctctagaactagtggatcccccgggctgcaggaattcgtctcacccctagaaaaaatccagcctcgagcaccgggacctgccgcgtgcttcttactggcaacttggcaagtggcacggccgcacggatccatctccatcgtcgaggcgaggacgaggaagcagatcgaagcacccaaccacaccacactggtggtgagtggttgctggcgatggccatggaagcgatgatgagcgggctcaactccggcgtggtgctcagcctgatcgccgtgctgtggacggtggtgtggcagaacctgcagcacctgcagctgcagcagttcttcgcgcggcagctgagccggcgcgcgcggcggctggcggcgatggtggacccgtacctgtcggtcaccatcgccgagtacgagggcgggcggatgaagcgcagcgacgcgtacgaggaggtcaaggcctacctcagcgacgccagcgcccacggcgtgcgccacctccgggccgagtccgccaaggacgccgacaagctcgtgctcagcatgtcggacggcgaggaggtggaggacgacttcgagggcgcgagggtctggtggtgggcctactccaagcagccgccgcgctcggacggcgccccagcttgtgtggaaccggcgggcggcgccttccgcgcaagtaggagcgccaccttctaccgccctcttcttccctggagcaaccaacggttcgcctggtggctggaaaccgtaacctccccggggcttcccgccagcttggggcccgccgcccgtccttggggggaagtaacccgccccagcggaaagcctgtttccaccaaaaaaattcttcccagcgcgacccaag

SEQ ID NO: 93362 - protein, 215 aa, Zea mays
  misc_feature: Ceres CLONE 1582632
MAMEAMMSGLNSGVVLSLIAVLWTVVWQNLQHLQLQQFFARQLSRRARRLAAMVDPYLSVTIAEYEGGRMKRSDAYEEVKAYLSDASAHGVRHLRAESAKDADKLVLSMSDGEEVEDDFEGARVWWWAYSKQPPRSDGAPACVEPAGGAFRASRSATFYRPLLPWSNQRFAWWLETVTSPGLPASLGPAARPWGEVTRPSGKPVSTKKILPSATQ

SEQ ID NO: 93363 - DNA, 807 bp, Zea mays
  misc_feature: Ceres CLONE 1582633
  misc_feature: Encodes the peptide sequence at SEQ ID NO. 93364
  misc_feature (637)..(637): n is a, c, t, g, unknown, or other
ggagctccccgcggtggcggccgctctagaactagtggatcccccgggctgcaggaattcgtctcacccctagaaaaaagagagagagagagactctcccggctcccctgcctgcgcgccgtctcctccaggctccagcgcctcgcggccaccccgtacgtaccacggctgcacggccgatggcgtaccccgcggcgccgcacacgagcgcggccttcctcgccagcttcgcgacgccgctccccgcgcgctgcgcctcgcccccgacccggcgccgcgcggtgtcggccgccgccatcgccaccaccaccacctgcgtcttcgccgacgccccccgggggatcaaggaggagcaggcggacgcgggcgcccaggcggcggcggcggctgcggctgcgcgaagggacgtcagcccggacaccgtggcctccatcatcctcggcggtggcgccgccacgcgcctcttcccgctcacgcgtacaagggccaaacccgcggtgcccgtcgggggatgctacaggctcatcgacatcccgatgagcaactgcataaacagcaagatcaacaagatctacgtcctcacccagttcaattcccagtctctcaatcgccacatcgcaaggacatacaactttgngtgaagggagttggattcagtggcggggtctgtggaggtgctggcagctacccaaacagctggggaatccggaaagaaatggttccagggaacagcagatgctgtcaggcagttcctctggctttttgaggagcaagactcaaatgtatagaaaaatactgattctgtcg

SEQ ID NO: 93364 - protein, 152 aa, Zea mays
  misc_feature: Ceres CLONE 1582633
  misc_feature: SWISSPROT Homolog: EC 2.7.7.27 Glucose-1-phosphate adenylyltransferase
MAYPAAPHTSAAFLASFATPLPARCASPPTRRRAVSAAAIATTTTCVFADAPRGIKEEQADAGAQAAAAAAAARRDVSPDTVASIILGGGAATRLFPLTRTRAKPAVPVGGCYRLIDIPMSNCINSKINKIYVLTQFNSQSLNRHIARTYNF

SEQ ID NO: 93365 - DNA, 827 bp, Zea mays
  misc_feature: Ceres CLONE 1582644
  misc_feature: Translation starting site: 245
ccccgcggtggcggccgctctagaactagtggatcccccgggctgcaggaattcgtctcacccctagaaaaagtacgcgctctccctcggtctctccctccctccctccctctcgctcgtggccacgactgggcgactgcctccgccgcatttcgctaggcgccacacggcccttggccggcgacgagcacccacagaaaaaagtgttgctcctacgactagttctttttatgtgtaaccttcaatgaaggattctcaggatattcagagcacgacagagttgcagtcaccagtgcaaggtactaatgaagtgcaaagtcagcaaccaaactcaatggccgctgatgctcctgctggaaattcgggttccttgtctgtagctagtaatgacaataagaaggtgtctcgcgaagatattgaacttgtaagctttctagctatctagtggcatcccttctagggtagacccagtgcctgaggctcccacatgagtggtgtctggggaagggataaaccgaggcaggcttttcccttgcaaatgcggagaggctgcttcgaacccgcaacctggttcagaatttgatagagcgttgtctacagctctacatgaacaaaggagaagttgttagaactctttctactcgtgctagaatagaacctggcttcactactttagtatggcagaaacttgaagaagaaaactccgagttctttagggcttactatattacggttgaaagtgaaaaggcagatcatcttgttcaatcatttattgcaacacagtacaatttgatgaaatatccagcacctcccgaatatccattggc

SEQ ID NO: 93366 - DNA, 812 bp, Zea mays
  misc_feature: Ceres CLONE 1582645
  misc_feature: Encodes the peptide sequence at SEQ ID NO. 93367
  misc_feature (628)..(628): n is a, c, t, g, unknown, or other
ggagctccccgcggtggcggccgctctagaactagtggatcccccgggctgcaggaattcgtctcacccctagaaaaagagagagcgcaagtattactgcgcaccgcctcgcccgcgggcgtcagcgtgaagctgccgcacagctaccccgcgaggcatggggatggacgccggcggcgggaagctgccgtacagctaccccgcccaccaggacggcaagctggtgaagagcttcagccgcgtggagccccgcaagttcggcctcgccctcgtcgcgggcttcctgctcgtcacctgcgcctacttctccaccgccaagttcgacgccatccacgtcgccatgatcagccccgtctccggcaatgcggctgggatcggcccgctagtgggcgccgccaacgccgacacctccgactccaagcagcgattagatttgggcaagcaagacccggacgacgcgctgtccaggtccgaggaggaggaggggagcagggccgacgaggtgctggagaaggacgacggcaaggcatcctcgtcgtcggggacagattccggcagcaatgcgcccctggaggacaccaggagagacgagacctttgtggggggacagcggtggtgcatctttccncggcggggcgccaggagtgaaggcggtttcctggccgggcaggagccacgaagaagtaagcccccccgctggccgcccctggcttcctccccctgaaggttcgaagggagccccccaaacgccaggccaaggtatcagggaattcttgaaggaacaagggagccttcagggggccaggaaacca

SEQ ID NO: 93367 - protein, 188 aa, Zea mays
  misc_feature: Ceres CLONE 1582645
MGMDAGGGKLPYSYPAHQDGKLVKSFSRVEPRKFGLALVAGFLLVTCAYFSTAKFDAIHVAMISPVSGNAAGIGPLVGAANADTSDSKQRLDLGKQDPDDALSRSEEEEGSRADEVLEKDDGKASSSSGTDSGSNAPLEDTRRDETFVGGQRWCIFPRRGARSEGGFLAGQEPRRSKPPRWPPLASSP

SEQ ID NO: 93368 - DNA, 870 bp, Zea mays
  misc_feature: Ceres CLONE 1582650
  misc_feature: Translation starting site: 193
  misc_feature: SWISSPROT Homolog: EC 6.2.1.3 Long-chain-fatty-acid--CoA ligase
ctccccgcggtggcggccgctctagaactagtggatcccccgggctgcaggaattcgtctcacccctagaaaaacccatcgccagggcgtcggatcggagcgagctcattctcaactcgactcaagagctctgcctcctccatcttcccttctctttctggacgttgagggcctccggggccacgctgagagatggaggcgaatccgaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttcagggtagcagcagtcaagtatgccgacaaccggatgctcggatggcgtccgttcaaagatggagtgccagggccctacttgtggaaatcatacaaggagatctacgacgaagtgctgcaagcaggctctgcgttgcagaagctgggagtgcagccaggttcccgggttggggatctacggagcgaactgtcctcagtggatagtggccatgcaggcttgcatgggctttagcctagcctggggcccacggaacaatactttaggtgcgggacccggcaactacctcttcatcatgcccaaattcaatgttgtcctcctaccgggaaaaaaaataaaaaaaaattggtccccaaattggaattctgcccaaaaaaagaaaaactttgggggggcttccttttgggaaaaattggaaaaaaaaaaaaggggacaaattgggggaaaaaaagtggcgcggggaaattttcttgaaaggggggaaagaaaattccctgaaaaactccgccccccccaaaaaag

SEQ ID NO: 93369 - DNA, 837 bp, Zea mays
  misc_feature: Ceres CLONE 1582651
  misc_feature: Translation starting site: 120
  misc_feature: SWISSPROT Homolog: EC 1.1.1.86 Ketol-acid reductoisomerase
  misc_feature (406)..(406): n is a, c, t, g, unknown, or other
  misc_feature (607)..(607): n is a, c, t, g, unknown, or other
ctccccgcggtggcggccgctctagaactagtggatcccccgggctgcaggaattcgtctcacccctagaaaaactctttccagccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggttggggaanggaatctgttcccgctgttaccggaggccttcaagggaatcaaacagatcggtgtaatcggctggggctcgcagggtcctgcgcaagctcagaacttgagagactcacttgttgaggcaaagtcagatattgttgttaagaatggtctccggaaaggttctaaatctttttgagaagcccgagcagcaggattcaccgaangagagtgggacgctgggtgatatatgggagactgtatccaaacagtgatcttgttttgctactgatatctgattctgctcagggtgataaatacgagaaaattttctcgcccatggaaccaaacaggtattcctggttttgtcacaggaatttctccttgggacattgcaaccccctggggttttgatttccctaaaaacatcaagggggatggctggatgcccccaagg

SEQ ID NO: 93370 - DNA, 1210 bp, Zea mays
  misc_feature: Ceres CLONE 1582653
  misc_feature: Encodes the peptide sequence at SEQ ID NO. 93371
  misc_feature (13)..(13): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (64)..(64): n is a, c, t, g, unknown, or other
  misc_feature (517)..(517): n is a, c, t, g, unknown, or other
ttttttttttttncngnnggagagccgggctcaacaattttcgttttgggaacacaccacaaangaggtgttaaaaaaaatggagctccccgcggtggcggccgctctagaactagtggatccaccgggctgcaggaattcgtctcacccctagaaaaacccatcaccttctcaccgcatgctcacccgccgcgaaatccgtctggctgaacaccaacctcccctcttctcaccccctccaccagcgccgcaagtgcgccgcccgagctccaacaacggcagcgcggtgaccgtacgatcgacgtcccggccctcgtcaacgcagctctcgagccgggcaggaaggttccctacccggcaaggaatgatatcccaggaaccgaccccgtttcggtgcgcctccctgggggaagggtcctgtcccggacttccccgacccccacccctgggcggtccacccccgtcttgaaagtatgttgggacaagaacttatcccggccccccacgctcccttttntaacatatttaggggaaagggtcccccctcttggttggacaccccccgggggaaaaattcgagcaacgaacttggggggcccccctcccctccttaaaaagctaggcaaaaaaggggcgttgaaacccccgcaaaggccgtttcctgggtatgtgcgaaacccttcggtagaagccaggagtttctaacctcagggggggggacccccccccccgttaacccaggttccttgcacaaagttttttcatgtggcgggccaaaagggtgggggagagaagaacaccccccccggggaaactcctccggcgaataaactaagatcacgttacattttcttacacaaaattactcccgttttggaacacattaagcgccgcacgcggaaagaggagtgggggtccagacaccccacccccacatgagagaaacctccgaggtccccccactttttatctaccctcccgtgtttattgccacgatccccgccttgtggggggatagtatgggggggccgcccagatcgctcgcaggaggggtagatacctctttgcggggtggtggaggtttacagaccctcgctcgctcctgttgtctatatatagtaaacacacagacacatttaacctcgcgcgcgcctggcacacccaaaatagtggggataatctcgtagatatttacacctgaaaaaatttg

SEQ ID NO: 93371 - protein, 46 aa, Zea mays
  misc_feature: Ceres CLONE 1582653
  misc_feature (15)..(15): Xaa is any aa, unknown, or other
MLGQELIPAPHAPFXNIFRGKGPPSWLDTPRGKNSSNELGGPPSPP

SEQ ID NO: 93372 - DNA, 870 bp, Zea mays
  misc_feature: Ceres CLONE 1582658
ggagctccccgcggtggcggccgctctagaactagtggatcccccgggctgcaggaattcgtctcacccctagaaaaactcccgattcagcgtgaggggccagggccagatgcggggcctcccttcccttcccttccgtccggtccccatgggccatggcgtcgcccgctatgatttcttggcaaaccactcgcgccgttgcctcttaagccggggtcgccccctctctccagtctccacagagtccacacgcacggcttcccatctcctcgccgccggaggcgcgccgcggaagacgccacaatgagtttcgtcccgtccgttggcgcactagaggatgccctgcctgaccctgcactgcaatccgtcgccgggtgctgaccaggagagctcctgattcggagccgattttagcggggttcttttggggggccccattgccgtgcttcgtttccctgcccgccttggccgtgcattaataaccgcttccttgtgatagtcctctccctacctccctcccttcgccctcacttcccactcacctcgcgctcgtcgcctcggctgggtcgggtcttgggagtgacagtcagtgctgccagtttgcgcgaacggcacccgttacgcgcaatttctcggaaaacatctgacttgcgccgtttcctatgggttgctttcgggtgctttcgcgccggaaggcggaacaaggacccccaggccttccaagcaacaaacaaattcttcagggggctgaattccaaggaaggaaaggttccccccccgaaatgtggccaggggggtttaagcgccaaaaagttttccccttataagaaaaacctggcttttgtggggaaaaatggggcttaactttca

SEQ ID NO: 93373 - DNA, 832 bp, Zea mays
  misc_feature: Ceres CLONE 1582660
  misc_feature: Encodes the peptide sequence at SEQ ID NO. 93374
acccgcggtggcggccgctctagaactagtggatcccccgggctgcaggaattcgtctcacccctagaaaaagtcggatcctcatactgcaagaaccctctctctctctctctctctctctctctctctctctctctctctctctctctctctcagagagaggcgcggaggagagtgtgtgtggcaagaagagagaaggaggaagggagccacgagggagagcccggggggatagctgctgcagcatgcgcgaatcctaactgaggagtaggccaacaagagatggcaatgaagaacatgaagctcgggtgaaaacgtgatacgatctatacagaaggaacagacaggtcagtcgtatgagacagagagggcgatctgagtatgcatggagataacaccaaggagaaggtacacaagtaccgagtgcagataaagagaggggtcatgaagggcgtgtgcgcggacaccgacgagagagatgaggaggggggggcgggggagctgcacgacatccctggcggcgagcaggcctttgagctgtgcgccaagttctgctagggggtctccatgagcatcagcgcggggaacctggtgcacgcgaggctggcggggcgctatctccggatgaaggagaggcgaccctagggcaacctggtggccaagctcgagaactttctcgactcctgcggcctgcaggggggggaaggactacagtcgtcgagatacaggacggcgtggcggaatctccgggctgggaaagagaggcggaatcggaacaggccggggaggggattccagagggggaagaaagatgacttctgccaaacggaga

SEQ ID NO: 93374 - protein, 58 aa, Zea mays
  misc_feature: Ceres CLONE 1582660
MHGDNTKEKVHKYRVQIKRGVMKGVCADTDERDEEGGAGELHDIPGGEQAFELCAKFC

SEQ ID NO: 93375 - DNA, 1086 bp, Zea mays
  misc_feature: Ceres CLONE 1582662
  misc_feature: Encodes the peptide sequence at SEQ ID NO. 93376
  misc_feature (748)..(748): n is a, c, t, g, unknown, or other
aaaaggagggaataattaaagcgtcggtaacccgcacccccggcggcaaaaaaactaatccaaccaaaatcttcaaaactggaactccccgcggtggcggccgctctagaactagtggatcccccgggctgcaggaattcgtctcacccctagaaaaagagtccccgtcttcgtcgtcttgtagtagcactgagtgcgggagtactggccggccggcggcgaggctcctccactttctctgcacccatacatacgtatatgcttgttctccgccgtctccgcctccgcctcccactgccacgccctcttctcgtctcctccttctcctccacctccccctcctcctcaccctcgacctctagctcctcctcctgttggtcgtcgacaggcgaaagtagaagggccatggcgtcatctccttctcccgattcggccgcggtcgttgccgagggctccgcggctcgccgcttcccaatcgctgcctccacgcgcgaggccgccttcgccgcatacacgcccttcctcctctccctcgccgccggcaatctgcggctcaacgtgtttcgccactacatcgcgcagggacgcgcacttccttcacgcctttcgctcgcggcgtacgaaaatggcccgaggaactgcggctgaatgatgaacgaccgaccatggcccatccataagcccgcccctcaggggaagggccaattccctccaaagaaggctcaaaccttcccacctcccttccggntttcctgaaaaggaagtgggggggaattttgaatccttacccaaaaagaagattaccctttcaaaagtggcagcctttacaacccaaagatataacttggattttcccttacctttgcacaactggccgggctgtggaaaaaatttgtaatggcccccaaaaaaggtttcttggaccacaaaaatgggttacctccccacttttgagaaaagaacataaaaaattgcctggcataacaccctggttgggggggccactgaacttcccattgcatggaagggctttattggccttaatcatagggccaaagaaaccccatggggtttttcccttaaaat

SEQ ID NO: 93376 - protein, 129 aa, Zea mays
  misc_feature: Ceres CLONE 1582662
MLVLRRLRLRLPLPRPLLVSSFSSTSPSSSPSTSSSSSCWSSTGESRRAMASSPSPDSAAVVAEGSAARRFPIAASTREAAFAAYTPFLLSLAAGNLRLNVFRHYIAQGRALPSRLSLAAYENGPRNCG

SEQ ID NO: 93377 - DNA, 840 bp, Zea mays
  misc_feature: Ceres CLONE 1582663
  misc_feature: Encodes the peptide sequence at SEQ ID NO. 93378
  misc_feature (649)..(649): n is a, c, t, g, unknown, or other
ccccgcggtggcggccgctctagaactagtggatcccccgggctgcaggaattcgtctcacccctagaaaaattccccgaggccgcccgcgtcccgaggagtggaggaggtcaccccgagacagtcgcttcaccgccggtctctcctccccacctccacgcggctcgcggccggccatacaccgcagcactaccttggtgggggcttgcgccagagctcgcgaccactgcccgtgacgcctgtctttgactcgttgaccgcggagtgagcgcgcgcgccggagccggccagccatggaagtgcgcggcggagtggggcagggttcggcggcccggcacccgcccgcgccggagccgtcccgggcggcggcgcgggttcaggcgggggacgcgctgccgctgccgatacggcacacgaacctcatcttctcggccctgttcgcggcgtcgctggcgtacctcatgcggcggtggcgcgagaagatccgctcgtccacgccgctccacgccgttgggctcgccgagatgctcgccatattcggcctcgtcgcctcgctcatctacctgctcagcttcttcggcatcgccttcgtccagtccatcgtctcgtccggcgacgacgacgaggacttcctggtcgggtcgggagntccgggggctcggcggcgcgccttcccgggagcatgcgcaggcggcggccccgtgcgagctgctcggggaggcccgccgcggcgcctgagaaaaatgcggaagacaaacgaggagatcgttcccctcggtcgtcgccgggaaggggttccgtccctacccgctcaaaggccaggctcggggcaacggccgc

SEQ ID NO: 93378 - protein, 182 aa, Zea mays
  misc_feature: Ceres CLONE 1582663
  misc_feature: SWISSPROT Homolog: EC 1.1.1.34 Hydroxymethylglutaryl-CoA reductase (NADPH)
  misc_feature (119)..(119): Xaa is any aa, unknown, or other
MEVRGGVGQGSAARHPPAPEPSRAAARVQAGDALPLPIRHTNLIFSALFAASLAYLMRRWREKIRSSTPLHAVGLAEMLAIFGLVASLIYLLSFFGIAFVQSIVSSGDDDEDFLVGSGXPGARRRAFPGACAGGGPVRAARGGPPRRLRKMRKTNEEIVPLGRRREGVPSLPAQRPGSGQRP

SEQ ID NO: 93379 - DNA, 975 bp, Zea mays
  misc_feature: Ceres CLONE 1582664
  misc_feature: Encodes the peptide sequence at SEQ ID NO. 93380
ctccccgcggtggcggccgctctagaactagtggatcccccgggctgcaggaattcgtctcacccctagaaaaagactcactcacttagccactcttcttcctcctgatcaatccgctctccagcacttgttcggaagaaaaagaaggtagaacacgctaacgagacaacaaggatcatggggcgcgggcgcggccacctcctgctgccggcagcagccgcctgcctgtgggcgctgtcgtgcgcgctgctgctgcgcgcgtcccctcaccgcgctggcgccggcgccggcgggctgctgagggtcgggctcagcaggcgcggcggcgggctcgaccagcgcgcgctggcggcggccaaagccgcgaggcagcaggaggcaagccttctcccggcctccggcggcggcgaacgttccctcttcggcgactaccttcaacacccagtactacgggggtcgtcggcatccgcaacgccgccgcaaaaatttcaccggtcatctttcaaaccgggaagcttccaaaccctctgggggccccctccctccaaaaaggcaattttcttgattgggctgggtaacctggcaccaaaaaataaaaaattgggccaaaattttaaaccatttaaaaaggggggaaagggcaaaacaccctttaaaaataaaccctaagggggttcccgggtttcaaaattcccggggtgttttctaaaaaaaaaaaaaaaattttttggttggggggaaccttcacccctcaaaaacaaaaaatattttttttaaaaaacacgcgcgaaagaagcctgtatacttttttaataggcggaatatttggggggcctcctcggttgtgaaaaaaccaagaaattcttcggggagggggttcccttttttttgaaaaaataaagaaaaaaaaatttctcggagaaaaaatttttctttttttgaaaaaaaacaccgagaaagacttctttgggggga

SEQ ID NO: 93380 - protein, 163 aa, Zea mays
  misc_feature: Ceres CLONE 1582664
MGRGRGHLLLPAAAACLWALSCALLLRASPHRAGAGAGGLLRVGLSRRGGGLDQRALAAAKAARQQEASLLPASGGGERSLFGDYLQHPVLRGSSASATPPQKFHRSSFKPGSFQTLWGPPPSKKAIFLIGLGNLAPKNKKLGQNFKPFKKGGKGKTPFKNKP

SEQ ID NO: 93381 - DNA, 833 bp, Zea mays
  misc_feature: Ceres CLONE 1582665
  misc_feature: Translation starting site: 375
gcggtggcggccgctctagaactagtggatcccccgggctgcaggaattcgtctcacccctagaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggtagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacgacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgactggcaaaactatcaccctcgaggtggagtcttcagacaccatcgacaacgtcaagggccagatccaagacaaggagggcattcccccagaccagcagcggctcatctttgctggaaagcagcttgtagacgggcgcacgctggccgactacacatccagaaggagagcaccctccacttggtgctgcgcctcaggggaggatgct

SEQ ID NO: 93382 - DNA, 1279 bp, Zea mays
  misc_feature: Ceres CLONE 1582667
  misc_feature: Encodes the peptide sequence at SEQ ID NO. 93383
caccacacaatataagaatgttgtgaggggagcgccccaccccccccccccccccccttccacccaaggaccaacaaacatggactccccgcggtggcggccgctctagaactagtggatcccccgggctgcaggaattcgtctcacccctagaaaaaagaggcgccgccgcatcccattcccatccggtaacggcatcccgcgtcactcggctcggatcgccgccgcccaacggagcaggagcagcgatccatcctatcctaggagccaaaccctagccagctatggagccgcccgccgcctcctcctcgtctgatccccactccccgtctccgtctccttctccctccgcctccccggccaagcgctccgcctggaagcaccccgcccccaacgacaccgccgtcatggacgccaacaactggcccgcgctctctgacgccgccaagggcaacaagctcccggactcctcccctccatcacctgcacccgtagtcgcaccatccggccgtatgcaacctccctcctaatttcacaaaagcgccggcgtcccaatcaccggcctcccacaatatccgccccgggcgccacttgggcgggtgggtgggcgaaccaattccctttgcggagcagcccttctcttgtaccgggaaaactttatgtcccgcttggggcttggggaaacccatggccttagcctagatcaaagccggatcgggggggtgaccaaaggggtgttttcgcaccttagaacggccaacccccacttgcattttcacacccccgccaagggcatgctggccaaaggggaaaagggggggcgccaaagattgaggaggtagacctaatgacccatgagcgccattttcctgttcaccaacaacaggtgggcgggccacagttattctattcaataccccaggatggaggacttcctagcggtgattgccctccggatgagcggatcctcgacataaactcgcggaaacgtgaaaaggggacccttgtctggacagggctctatatgggcccgaaaaaataaaggggggcgataagttaccggaaacgtccgaccccaaatttagccgctttacgtggggtacgcgcatctcgcacatacaatcacagagagggaagctaacttgggcgccttaccctacattcgccggcaagggaggttgcggtccgtatcgctccccacgatgcctctcaatgaaccaggtacgccaacaacccccatgctcgagtggaggacatatacggacagtctagaagagtg

SEQ ID NO: 93383 - protein, 81 aa, Zea mays
  misc_feature: Ceres CLONE 1582667
MEPPAASSSSDPHSPSPSPSPSASPAKRSAWKHPAPNDTAVMDANNWPALSDAAKGNKLPDSSPPSPAPVVAPSGRMQPPS

SEQ ID NO: 93384 - DNA, 825 bp, Zea mays
  misc_feature: Ceres CLONE 1582670
  misc_feature: Encodes the peptide sequence at SEQ ID NO. 93385
ctccccgcggtggcggccgctctagaactagtggatcccccgggctgcaggaattcgtctcacccctagaaaaagtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccagctccctcctcacggcccccaagccctccgccgcggcctccgacctccccgagggcgctcagtggcgctacagcgagttcctctccgccgtcaagcgcggcaaggtcgagcgcgtgcgcttttccaaggaacggggtctgctccagctcaccgccgttgaacgccgccgcggcaccgtcgtcgtccccaacgaccccgaactcatagacatcctcgccaacaacggcgtcgacatctccgtctcccaaggcgagtcggcggggccggggcggcttccttcgctttcgtcggcaaactccctccttccttttttatcggcgttcgctgggcttctttcttcctctttccgcccccgcgacagggggggggcccgggcccccggggccctgggtgacccttccgggggcccccaatgggactttcgggccgct

SEQ ID NO: 93385 - protein, 227 aa, Zea mays
  misc_feature: Ceres CLONE 1582670
MAPPSVSASHLLITASLPKPKPSSLRPPRLPLAKPLPASAALLALAASPALAADAPAPAPAPTPAPAPELQAEAPTPTVNPFSSSLLTAPKPSAAASDLPEGAQWRYSEFLSAVKRGKVERVRFSKERGLLQLTAVERRRGTVVVPNDPELIDILANNGVDISVSQGESAGPGRLPSLSSANSLLPFLSAFAGLLSSSFRPRDRGGARAPGALGDPSGGPQWDFRAA

SEQ ID NO: 93386 - DNA, 1002 bp, Zea mays
  misc_feature: Ceres CLONE 1582677
aaagagaggtgacttataggagatgtggatgtccacacccccccccccccccccccacccacacccaaaaaacaaaaaactggagctccccgcggtggcggccgctctagaactagtggatcccccgggctgcaggaattcgtctcacccctagaaaaagtcccctccaccaaaaccgacgacgacgtcgctctcctccaccggtgctcggcgctctccctccaccagcggcggtccacagacgctcggcgagctccaccggcgggcgctggcggctggtcagatccgctcggcagtcatccacctggcacatcgggtagctcgcgcctccgttggcagtcccaccgccgcccggccctcccccagcgcccccggtgatccggaccgcacccgcttgctcggcctaacgaccggctcctgccccgccgcagccgaagctcccagcgtcctcctgcaggccgagctgaaggttcaccccccccctggagttcgacgacgaaactccgtcacgtcatacctctccgcctcccgtcttccagacgtctctaatcggggtcccagcgtctcggagaagaggagcagcacggcacggcagctgtggcgaggaaggctcctgtcccatcccaacccagttagcagccgcccaaggaggaggagatccaatccgcgtgcgggcgtccggcggtccatccatcgatccaatttccaatctgcagggagtacacttgggtcaaaatctggttggtctcttagagcgaacgaacaccaatcttttgggggtttggccccttttcgtcaggggagaaagccatcccttctgggaacggggggtattgtaatttttgaagtcaccaaaaggatattggaaacccagccctcttgggttcctcacacacccgttttttaaagaaagtccctcagggaaatgggtgggggggccgcggaaaactccatgggaatatgggggggcgtgcgtctatccctcggggggacaagacttgt

SEQ ID NO: 93387 - DNA, 874 bp, Zea mays
  misc_feature: Ceres CLONE 1582679
  misc_feature: Encodes the peptide sequence at SEQ ID NO. 93388
ggagctccccgcggtggcggccgctctagaactagtggatcccccgggctgcaggaattcgtctcacccctagaaaaaaccgtgctcatcatcaccagttcaccacccacctcccactcccagttcaccccgtcgtcctcggcgccaccactcctcgtcccccggcgctactcccccgctccacggtccaaggaaagatggcgtcccatattgttggataccctcgcatgggccccaagagggagctcaagtttgccttggagtctttctgggatgggaagagcagcgccgaggatttggagaaagttgccactgacctgaggtctagcatctggaagcaaatgtcagaagctgggatcaagtacattcccagcaataccttctcgtactacgaccaggttcttgataccacggccatgcttggcgctgtcccagagcgctactcttggactggaggcgagattggcttgagcacctacttctctatggccaggggaaatgccactgtccctgccatggagatgaccaagtggtttgatacaaactaccactttattgtccctgaacttggtccaagcaccaagttcacatacgcttttcacaaggctgtttctgagtacaaggaggcaaaggcgctcggcattgatacagtcccagtgcttgttggaccagtctcatacttgctcctctctagccctgccagggttgtggagaatctttctctcttctttcacttcttggtagcattcttccatctacaaggaggtgttgctgagctgaaagcagctggtgcttcatggatcagcttgatgagcctaccttggtaaagacttgatgctcacgattgggcgcatttctctcagcaatggcgaaa

SEQ ID NO: 93388 - protein, 209 aa, Zea mays
  misc_feature: Ceres CLONE 1582679
  misc_feature (2)..(208): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSSAEDLEKVATDLRSSIWKQMSEAGIKYIPSNTFSYYDQVLDTTAMLGAVPERYSWTGGEIGLSTYFSMARGNATVPAMEMTKWFDTNYHFIVPELGPSTKFTYAFHKAVSEYKEAKALGIDTVPVLVGPVSYLLLSSPARVVENLSLFFHFLVAFFHLQGGVAELKAAGASWISLMSLPW

SEQ ID NO: 93389 - DNA, 1260 bp, Zea mays
  misc_feature: Ceres CLONE 1582680
  misc_feature: Encodes the peptide sequence at SEQ ID NO. 93390
  misc_feature (75)..(75): n is a, c, t, g, unknown, or other
  misc_feature (481)..(481): n is a, c, t, g, unknown, or other
  misc_feature (662)..(662): n is a, c, t, g, unknown, or other
ttttttttttctttttcggcccaccaaaacaggaatgaggaggttggtctcgttgtttcacattcaataaaaaanataaaatggaactccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaaacagcagcagcgcaacgagcgctgctgatcgcgatccccttctccctgctgctcctgccgctcctgctccgctacctcgcggcgtcgggcgtcggcgtcggccncccgcgaacaaaaaacgaccggaccggccggcggtgggcggccaacaaacccccaaaaagcttcttggaaacccctgctggccctcccccccccccaatggaaaagctctccccttctaatcgggggcaaccctggccaccccggaatgggggggggaaacattccccccctaagggtggntccccccttcaggtccagacggctttcgagccacaaaccaaagggttaagcggggcccctcgcgcgaacacccccggaaaatgtgtcgtggggcttacccacaggcaccctttcagaggagcgcgccccccacttgggtcccccctaaaaaacaacccccagaagaaaagaggagattattccctcactagataggataacccgacacgggagccgggtgtatattcaccaataaaaagtgaccccactttgatgcttctcccccgcgcacacatcttataaagaaaaacacacaaacggtggcttgattatttaagcccgtcggccgcgggacccgggagaggggctacacaccgagtgggggggtgtcccgcaaaaaaaacaaatatactatgtgttatagaggggggaacacaaagcgcaaaaaatcctctgaggcttttctccacccgcccccatagagggggggataacccctctttcccgccaaagaggagaggcggggaaaaaatatgtgggtttaacgccgtggaaaccctggcttccaaaaacacacagatataagggttgcgggtctcccaatagtgagcccacgtcg

SEQ ID NO: 93390 - protein, 174 aa, Zea mays
  misc_feature: Ceres CLONE 1582680
  misc_feature (50)..(50): Xaa is any aa, unknown, or other
MAAQLHHALYELLHETAAAQRALLIAIPFSLLLLPLLLRYLAASGVGVGXPRTKNDRTGRRWAANKPPKSFLETPAGPPPPPMEKLSPSNRGQPWPPRNGGGKHSPPKGGSPLQVQTAFEPQTKGLSGAPRANTPGKCVVGLTHRHPFRGARPPLGSPLKNNPQKKRGDYSLTR

SEQ ID NO: 93391 - DNA, 1237 bp, Zea mays
  misc_feature: Ceres CLONE 1582684
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (1058)..(1058): n is a, c, t, g, unknown, or other
gggggtgggggnnnnttttatgttatgttggtttgtgnaattnnnnatntatgtgatgtagggcgagaggggaaaaataaactccccgcggtggcggccgctcttaaacagtggatcccccgggctgctgtattcgtctcacccctagaaaaacctcgccttcacctcagctcacggcctctcccgtccacccacccacccgcctcgcctccatccacagcgaccacgcccatctatcgctctgtccgctcacccccacctctccgcccccgtctccgtccgccacccggcccgcctccgaactccccccgtgggcccagcccgggatccgggagcccaaaactccaaccttgggtcaaggaagggagaagccccgaaaacgtcagacagggaaggggagaggcgtccttttttaagcctgggcccccggccctgaagggccacggccggccccccatgggggaccaggtccgccctggaaaggagtgataaaagggaacgcagctccccacaaaaccgggggggggaaagggcgagaacacactaccgcagtagcaaactgactgagggggccgaggcaaaaaactataattaaagcacaaaaaataggggttttggggggaaaaaaaggggataatttgaaagaagacatccccaccccatttagaaagagagaaaacgtctgcagaaaaacgcatagccctggttacaaaacctgaggagttggatcgtagaagattgaaatgttgttattctacaaaaaagagggaggaaaaagtacaaagccgtcggcgctccccacaaacgacagcccaaatactcacagtatgaggttatgttatatcacactgtggcggtagatgcaacaaatttataaaaaaaccgcgcccgcgttagaggaacaagacccctctcaatacatatactaaaatagtggagctacatgtgtccgtaagatttgtgatccgctcgctacttcacgtgggagggcaccacctgccaggggtagaaaaaactaaacgatgcgcgaagatagagaggtatcctgaaattccacnctgcccggagaagcacacccaagaacaacaacaccccaataacaatatatcgagtctaccacaacaccgccttttcggtggccgcagagcagcgaagagattccccccgcgtgcgagggacgaaaatcaattgtcgacctcgccaagataatgcataattgttactttgactgaaaaaa

SEQ ID NO: 93392 - DNA, 849 bp, Zea mays
  misc_feature: Ceres CLONE 1582686
  misc_feature: Encodes the peptide sequence at SEQ ID NO. 93393
ccccgcggtggcggccgctctagaactagtggatcccccgggctgcaggaattcgtctcacccctagaaaaataatattgtgatgggcggcagtgtgggcagtgacccactaggtagtttctacagggcaaagttgcgccgtgctaatgtgcacttcctgtctaagccggtcaaagatggaacaactggaactgtcattgttctaacaacgccggatgcacagcgtactatgcttgcgtatcagggtacttcgtcaactctgagttacgattcagacttggccagtttagtgtctaaatcaaatgtactaattgtggaaggttatctatttgagctgcctcacacaattgaagctatcaagcaagcgtgtgaagatgctcacaagaatggtgcaatcattgctgttactgcatcagatgtatcttgcatcaagcgttgctacaatgactttcgggacattgtaagaaactatgcagatatactgttcgccaacgccaatgaagcaagggcgttgtgcgagctaccctcaacagacagtcccatgtcagccacaagatacttaagccactctgttcccctagtatctgtgactgaccgcatgcatggctcctaccttggggtgaaaagtgaagcaatatacatccccccaccacaaagcgtggctgtgggacacttgtgggcgctggcggaaccaaaacccttctggggattctgtacggcggtcctcccggggtgccttctggacctgaaaaagcaatagggactccctgggcgttccccggggtaacctggctgtatcctccttcggggcaaccacagccaaccgccaactgtccgggtcccaggaaa

SEQ ID NO: 93393 - protein, 225 aa, Zea mays
  misc_feature: Ceres CLONE 1582686
MGGSVGSDPLGSFYRAKLRRANVHFLSKPVKDGTTGTVIVLTTPDAQRTMLAYQGTSSTLSYDSDLASLVSKSNVLIVEGYLFELPHTIEAIKQACEDAHKNGAIIAVTASDVSCIKRCYNDFRDIVRNYADILFANANEARALCELPSTDSPMSATRYLSHSVPLVSVTDRMHGSYLGVKSEAIYIPPPQSVAVGHLWALAEPKPFWGFCTAVLPGCLLDLKKQ

SEQ ID NO: 93394 - DNA, 784 bp, Zea mays
  misc_feature: Ceres CLONE 1582688
  misc_feature: Translation starting site: 202
  misc_feature: SWISSPROT Homolog: EC 1.4.1.2 Glutamate dehydrogenase
  misc_feature (772)..(772): n is a, c, t, g, unknown, or other
ctccccgcggtggcggccgctctagaactagtggatcccccgggctgcaggaattcgtctcacccctagaaaaaccctagaaaaaaaaatctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcaatgtgctgcgtatcatcaatgagccaaccgctgctgctattgcctatggtcttgacnagaaggcaacca

SEQ ID NO: 93395 - DNA, 845 bp, Zea mays
  misc_feature: Ceres CLONE 1582689
  misc_feature: Encodes the peptide sequence at SEQ ID NO. 93396
  misc_feature (569)..(569): n is a, c, t, g, unknown, or other
ccccgcggtggcggccgctctagaactagtggatcccccgggctgcaggaattcgtctcacccctagaaaaagacggcaatccgggcgtcggagtcacggcggacccgaggcgggcacatgtgatgcgatcatggcaacgtgaataccccgtcccggccatcgtcgtccctcccccttgcaagcaagcagctgctctcgtgtgacctctagtcgtcgccagtcagtcacctctccagcctccagcaccaaccatccaccaccgagctagcagctgtctgctcgcctcccccacctaggctaggactaggagccaccaaactctgccccgccatgccgggcctcgccgcctcaggcaactcgcccccgggcgggcggcgccggccccgcgccgtctctcgtcgccgctgccccgccgcgcgccgccgtccccgtcgccctccgcctccacgcgcgccaagccgcgcccccctcccgcccccaccgacgactcgctggacaacccggatctggggcccttcctcctgaagcaggcgcgcgacgccatgctgtcgggcgaagggcgggcggnccccccccctcgctggaattcgcccaacgcgcccccagggcgcttcaacgccccgagcaagggccccgaagtcgagctcgccatgaagccccacggcgccagcggcattcaacttggagcctcgggacgaaagcctaaacccaaccccggtcttaaaagcgggaatttgccgattatttgaaccccctacaaaaaaaactcgtccaccctttgtcctaagccaaaaaaaccagggtattgcaagggcgaaaaaacaagatattgggcaagaaaata

SEQ ID NO: 93396 - protein, 68 aa, Zea mays
  misc_feature: Ceres CLONE 1582689
  misc_feature (9)..(9): Xaa is any aa, unknown, or other
MLSGEGRAXPPPRWNSPNAPPGRFNAPSKGPEVELAMKPHGASGIQLGASGRKPKPNPGLKSGNLPII

SEQ ID NO: 93397 - DNA, 842 bp, Zea mays
  misc_feature: Ceres CLONE 1582690
  misc_feature: Encodes the peptide sequence at SEQ ID NO. 93398
  misc_feature (680)..(680): n is a, c, t, g, unknown, or other
ctccccgcggtggcggccgctctagaactagtggatcccccgggctgcaggaattcgtctcacccctagaaaaaaacgagcatatctgctttttttttggtaaaagaatttgtttttgcaaagctagctcctacgctgccgccgccatgcaccgcttcgccgccgacagggcgcgccgcgcggtggccgcgtccctgcgcggcgcagcttccagagcagcagcagcgccgtcgcgtcacgctccggcgcctcgccatccaacctccccagtcggggcggcggcgccggttgctgccgccgccatggcgagggccgccatgtccacggcggtcgcgggcgtgccaccaccggtgtcgctcgacaccatcagccccaaggtgccgccagtgtcgctcgacaccatcaaccccaaggtcttgaagtgtcaatttgcagtccggggagagattgtcacacgtgctcagaaattgcaacaagaactgcagagaaatccagaatcgcttccttttgatgagatactctactgtaacattggaaatccccattccattggccaacagccagttacctacttcagagaagttctatctttatgtgagaatccagctctcctggacaaaagtgaaacgcatgctttatacaggtcagatgctatagagagagcacggaaaattctagancagataccaggaagagctacaggagcatatagccacagtcagggtataaaaagtttacgtgatgaaattgctgccggaaatgctgcccgtgatgggttcatgcaagcgcagatacatcttcctaacggaggaagcagcccagcgtgaccatgaatctgcagt

SEQ ID NO: 93398 - protein, 174 aa, Zea mays
  misc_feature: Ceres CLONE 1582690
  misc_feature: SWISSPROT Homolog: EC 2.6.1.2 Alanine transaminase
  misc_feature (126)..(126): Xaa is any aa, unknown, or other
MARAAMSTAVAGVPPPVSLDTISPKVPPVSLDTINPKVLKCQFAVRGEIVTRAQKLQQELQRNPESLPFDEILYCNIGNPHSIGQQPVTYFREVLSLCENPALLDKSETHALYRSDAIERARKILXQIPGRATGAYSHSQGIKSLRDEIAAGNAARDGFMQAQIHLPNGGSSPA

SEQ ID NO: 93399 - DNA, 884 bp, Zea mays
  misc_feature: Ceres CLONE 1582696
  misc_feature: Encodes the peptide sequence at SEQ ID NO. 93400
gcggtggcggccgctctagaactagtggatcccccgggctgcaggaattcgtctcacccctagaaaaagcttcctcgtgcagctccgaccacggtgagcgtagccacgccgcttgcccgcttccgatccccgcgccgcccccacaaaattccaggccggcacgcctcctcgtccacttgtgcaccgtggctaccgtttccctttcctggatctgaatttcgtcccgcgtagcgcagatgccgctcggacgggaggattaatctcgtggcccatgagcttaccggggaggaaggccccagcgggggcctccggagtccggcggtggctcgtcaccgtcgtcgtgtcggtgctggcgctggtgctgaccctcgttgtgatatcgctgtcccagggctcgtccctgcctcggacgtcgctgcacggttacctccccatcggagctactgacctggggaagcgttcgtcgtcggagcatgctgatgaaaacaagagtggcgctgcaattggggaggaattgtcgcaaggtgaagcgggagtccctagtggaagcagaaatggtcagggggggcgaacttgaattcaaagcccaaacctctggccgctttcaggaaaagaagggatgaacaaaccaagccgggaatccagtttttcttctccgtgaacaccccccaaccaatttccggaaagaaggaaaaccattcttaatggaaatccccaaaaaggctgaagcaaaaaaaaaattgggaatcctaataatcccgggaaaaaaagggggtttacttgaatttttttctgggggccccttttttgtccaagaaaaacttcctggcccctattttatcatcccccagaagtcagaaaatttgcccaggggggaaaatggg

SEQ ID NO: 93400 - protein, 101 aa, Zea mays
  misc_feature: Ceres CLONE 1582696
MSLPGRKAPAGASGVRRWLVTVVVSVLALVLTLVVISLSQGSSLPRTSLHGYLPIGATDLGKRSSSEHADENKSGAAIGEELSQGEAGVPSGSRNGQGGRT

SEQ ID NO: 93401 - DNA, 879 bp, Zea mays
  misc_feature: Ceres CLONE 1582698
  misc_feature: Encodes the peptide sequence at SEQ ID NO. 93402
ggagctccccgcggtggcggccgctctagaactagtggatcccccgggctgcaggaattcgtctcacccctagaaaaagttgcggatgatttcctctcgtctcgtctcgtcccatactccagtcccgtccgtcttcacctgcgttccccgggtcccgacaagccgctgtaccagtcccgcccgcctgcgcacttctcccacccccgcgccgccttcggcgccggcgagccctcccgacgctcctcgagcgatccgtccctctcgcggcccttctctcagccgcttccagcccaaggggaggagagggagaggatgtggtcgtcgagccaggcgagcacgaggggcgtcgtggagatggggaagggtggaggccgggccgtcgcatttccctaagagacccgcgcctcagaactccgccagggtcaatctgtcaaggacacacacagttaaacctacctctgctggcaaccgttcaggaaattctgttaaatgcaacttgggggtggtcttcctcaacaatcgcctgaattgaggcattcactttagaggaaactcatcagcatcaaaggcagttcttacttcccaaatttaatgtgaaaaaaacggtttgttgggaaagaaaaaaatcggggttcctcttgcctgaatcttggggggccccaaaaaccccttgaacaatttgccgcccttttctgggtttaaactctttttacaaaatcgggaaacattaacccgtccttcctaaggggccttttctccctttcctgcaaaaagcccatttggaaaaaattccattatggctgaaagggggaggacccccccaaaaagttgagggaaaaggttttttcacccacttagaaggggggggggtttgctccc

SEQ ID NO: 93402 - protein, 148 aa, Zea mays
  misc_feature: Ceres CLONE 1582698
  misc_feature: SWISSPROT Homolog: EC 4.99.1.1 Ferrochelatase
MISSRLVSSHTPVPSVFTCVPRVPTSRCTSPARLRTSPTPAPPSAPASPPDAPRAIRPSRGPSLSRFQPKGRRGRGCGRRARRARGASWRWGRVEAGPSHFPKRPAPQNSARVNLSRTHTVKPTSAGNRSGNSVKCNLGVVFLNNRLN

SEQ ID NO: 93403 - DNA, 835 bp, Zea mays
  misc_feature: Ceres CLONE 1582699
  misc_feature: Encodes the peptide sequence at SEQ ID NO. 93404
tccccgcggtggcggccgctctagaactagtggatcccccgggctgcaggaattcgtctcacccctagaaaaaaatgccgctcctgttttctttggttactaggagattctctcatacctgtagctagtgcttgccgttctgcatcctaaccccacggaactgccgttcgtttcccacgaatcagatgatggatctcgccgacagccagcaacagcggctcatcgccggcgcggctctgctggtcgccaccgtcgccttcttcaggttcctcctgcgctctcgctccgggggcaagcgcctgccgcccaccatcccgggggcgccggtggtcggcggcctcgtcaagttcatgcgcgggcctatcccgatgatccgggagcagtacgcccgcctcggcagcgtcttcaccgtccccatcatcagccgcaagatcacgttcctcgtcgggcccgaggtgtccgcgcacttcttcaagggcaacgaggccgagatgagccagcaggaggtgtacaggttcaacgtgcccaccttcggcccccggggtcgtctttgacgtcgactactccatcaggcaggagcagttcagggttctcacactagcgctccgggccaataaagctgcgcagctatgtccgaccagatggttgtttgaggctgaagagtaccttctcaagtgggggagaaaagtggcactgtttgattttgagttaccaggtgggagcaacttcatcataatgaaagcctagccggtgacttgctggggaaaaggaggtggccagaaaagcttggttccaacaagtttttctgctctcctttccatgaaccttggaaaat

SEQ ID NO: 93404 - protein, 122 aa, Zea mays
  misc_feature: Ceres CLONE 1582699
  misc_feature: SWISSPROT Homolog: EC 1.14.13.70 Sterol 14-demethylase
MMDLADSQQQRLIAGAALLVATVAFFRFLLRSRSGGKRLPPTIPGAPVVGGLVKFMRGPIPMIREQYARLGSVFTVPIISRKITFLVGPEVSAHFFKGNEAEMSQQEVYRFNVPTFGPRGRL

SEQ ID NO: 93405 - DNA, 878 bp, Zea mays
  misc_feature: Ceres CLONE 1582703
  misc_feature: Encodes the peptide sequence at SEQ ID NO. 93406
  misc_feature (878)..(878): n is a, c, t, g, unknown, or other
tccccgcggtggcggccgctctagaactagtggatcccccgggctgcaggaattcgtctcacccctagaaaaaccaacctaacccacaagccacacaacccaagcacaaaacacatcaccgcatctttttccttccgagctgtacgtatctgcagagagagagagagatagagagagaggttaggtcagagatcatgaagcacccgaggccgacggagcaggatgtgtcgctggcgctgtcgctgagcacggactcgtccacgacgacgtccgactcggcggggacgccaccggcgaagcgggcgcgggcgcgggcgcggcggcggggcgctgtggtggccacgtcgggggagggcgagttcgtctgcaggacctgcagacgcgccttcccctcgttccaggcgctgggcggccaccgcaccagccacctgcgcgcgggccgccacggcctcgacctcggcgtcgtcggcgcccgggcgctcaagcagcacaagcagcaggccgccaacgccaacgccaacggctgcgaaggaggcaagcagcggcacgagtgcaacgtctgcgggctcggcttcgagatgggccaggcgctgggcggccacatgcggaggcacccaggaaggaaaaagggggcgccgccgacgcctggggtcaccctctgggcgcacggaggcgtcgcgcggcgcccgacccgccccgtctttgctcgagctctttcgcttaagatcgatccggcccggcataagggtcggggctaatcccatccttggtaattttgggggggggagggttaacccggtcatcttaaacctcctagtagcccgccggggggtttaaatccccgggacatggtgaaaaccccaatgtggttccggtcn

SEQ ID NO: 93406 - protein, 187 aa, Zea mays
  misc_feature: Ceres CLONE 1582703
MKHPRPTEQDVSLALSLSTDSSTTTSDSAGTPPAKRARARARRRGAVVATSGEGEFVCRTCRRAFPSFQALGGHRTSHLRAGRHGLDLGVVGARALKQHKQQAANANANGCEGGKQRHECNVCGLGFEMGQALGGHMRRHPGRKKGAPPTPGVTLWAHGGVARRPTRPVFARALSLKIDPARHKGRG

SEQ ID NO: 93407 - DNA, 877 bp, Zea mays
  misc_feature: Ceres CLONE 1582706
  misc_feature: Encodes the peptide sequence at SEQ ID NO. 93408
  misc_feature (359)..(359): n is a, c, t, g, unknown, or other
  misc_feature (431)..(431): n is a, c, t, g, unknown, or other
  misc_feature (432)..(432): n is a, c, t, g, unknown, or other
  misc_feature (459)..(459): n is a, c, t, g, unknown, or other
  misc_feature (462)..(462): n is a, c, t, g, unknown, or other
  misc_feature (482)..(482): n is a, c, t, g, unknown, or other
ccgcggtggcggccgctctagaactagtggatcccccgggctgcaggaattcgtctcacccctagaaaaaaactggtataacaagatcccgctcattcccatcacggccatcgttttccgttctccaatccgtcaatccagtccccatccccacggcgccgacgactcgggggctcccccccttggacttggcccgggtgggagtagcacgtcggggaagggaagcaagcgtccgcgagtaaggacagaaaaccgaagggaggagtggagaggaggagcttgcttggagcgggtggacgggtggtgtgtatatagttaagcgggcgggcgggcagccaatgccgtcgggcgcgcagggnctagagcatgggcggagggggcgcgatcgtgcacggcttccgccgctggttccaccgccggagcgaaggctnncactccaactccaacagtcgtccctcnccnggccaggggggaagcggacnaacggctcaatccgatctccaagtcatccgaggaacccggatctccctcggccttcgggccaatccgcgttgcccaaacccaagaatccccctgcccctccaaaagccacagggaaaaaatcctttaaaaatgggagttcttccccgaagtccgggaaggggaacccctttcccgaatcccaaaaaatctttggtaaagggggccccccggaaatttttcctgccccttttggacaccccccccccgggggaagggggtttgttttaaaaaaaaaaaaaaggtttttttaaaacaccttctttggaaacccaccaccaattatgggggggagaaaaaaaccccccccgcgggggtgtttctccccccaaaaattttgggaagaatataacccccc

SEQ ID NO: 93408 - protein, 127 aa, Zea mays
  misc_feature: Ceres CLONE 1582706
  misc_feature: SWISSPROT Homolog: EC 2.7.11.24 Mitogen-activated protein kinase
  misc_feature (22)..(22): Xaa is any aa, unknown, or other
  misc_feature (39)..(39): Xaa is any aa, unknown, or other
MGGGGAIVHGFRRWFHRRSEGXHSNSNSRPSPGQGGSGXTAQSDLQVIRGTRISLGLRANPRCPNPRIPLPLQKPQGKNPLKMGVLPRSPGRGTPFPNPKKSLVKGAPRKFFLPLLDTPPPGEGGLF

SEQ ID NO: 93409 - DNA, 1221 bp, Zea mays
  misc_feature: Ceres CLONE 1582707
  misc_feature: Encodes the peptide sequence at SEQ ID NO. 93410
tttgtttgtttttggtttcgtcactttagacccgggcccgaccgctgcgcgccacaaaacccaacacccataaacgcaaaacactaatcacaacgcggtggcggccgctctagaatagtggatcccccgggctgcatgaattcgtctcacccctagaaaaactcacggtcctcacctcactccaccacgttcgccgcctcgatgccgcgatcaggccattgcgtgcgggcgggcgtgagtcactggctctcctcggcgcgcggacccaggggcggcggcgatggggaagaatatgcgcaacaagaccgcgcccacggcgaaccgtgtccccctcctcggcgacggggagacgtcaagggcgctctcggacctggaagagggtagcgacgtccagccagcgcacgccggcttctgtccggtcatcaaactttcgaagcaggacgccggcaaagcttggttctcaccaccgtggcgaatgcttcaccaccctccctcaggtaacccttctcaccttcccaaaaaaaaggggtggaagaaaaaatggaacatgggggaaaaaccacaaacgtttctgtcgccccccccacaaaataaggggctcctatgctccctcgtctagtaattgttcacagggggaagacaaattttcttgcaacccattatatggaacaaaaacacaattcccacccgtggacggggaagaagagctctttagcccaaggggtgcatacctcctcccctaggatcaatgggtagcgatctacttcccaccactttagcactaagacgcacataggcggggacaactccaacgaatcgctggagtgtgtgtcgggccccgtggtgaatcgttactgggtggcgtaatgcaggtaatgcttcgagtcaattccaggaaccccaaatcttcacttcacagcataagacccacatcggaaactaaaatatttaacgctttatcatactatgagaaacatagttttaaccacaacggtgtacagaatgtaggaaagacagaacctgtctatatttaaaatcatgaggtattttttgtccgcagtaaacataggtagtctcgccatgttatgatgtaaaagaaagtattatgtaggtccccgcctcatactctaaaatcacacagctaatagaaaggcacactcgcgagataactaagttctaaagaataataccccaccttctattacgggctcttctttgcgg

SEQ ID NO: 93410 - protein, 112 aa, Zea mays
  misc_feature: Ceres CLONE 1582707
MGKNMRNKTAPTANRVPLLGDGETSRALSDLEEGSDVQPAHAGFCPVIKLSKQDAGKAWFSPPWRMLHHPPSGNPSHLPKKKGWKKKWNMGEKPQTFLSPPPQNKGLLCSLV

SEQ ID NO: 93411 - DNA, 879 bp, Zea mays
  misc_feature: Ceres CLONE 1582709
  misc_feature: Translation starting site: 159
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagctatcgcctatggtctttgacaggaagctaccagtgtccgtgagaagaatgtccttcgtctttgatccttggagtgggtacctttgatgtctccctcctcaaccattgagaagggatctttgaagttcaggccacagctggtgacacccatcctgggtggggaggactttt

SEQ ID NO: 93412 - DNA, 1040 bp, Zea mays
  misc_feature: Ceres CLONE 1582710
  misc_feature: Encodes the peptide sequence at SEQ ID NO. 93413
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (82)..(82): n is a, c, t, g, unknown, or other
  misc_feature (83)..(83): n is a, c, t, g, unknown, or other
  misc_feature (694)..(694): n is a, c, t, g, unknown, or other
  misc_feature (788)..(788): n is a, c, t, g, unknown, or other
nntttttttttnnnnnggggggttatatgtagaaagggaataaaaatatagttaggggagggaaagctcaacgaaaaaaaanntggggttcaccgcggtggcggccgctctagaactagtggatcccccgggctgcaggaattcgtctcacccctagaaaaattcacgtattcatcttcaagccagccgtctccttatcctgcgatgccgctcacctgggctcatcttccagccgccctctccgcccagcagcagagcacaccatcctctcaactcggatccccaagccctcgcctccagctcttgccacggcatccatcccctgctcggacctccacccggccgcgtcctcgccggtggccagcgccgctgcatcgcccttcctagcgtcggccttggcaccgcttccccgagcgccccagtcgagctcgcccatcctctgctctagccctttctccacgccgtcgctgagctcgcccctcccctcagccatggacacgacgacctgcagccccttcttggtggccaagcccaatcttcctgctcgcgcccccctcttttcccacctctgcgcgttatcagctcgtccaacccccccatggtggtttcctcccttctcgggctccccttggctcccctcccccatgggcgttccccccttgggatgttgggtggatctgggttccccaacggntggcagggcaaattgtttcttttcccttcccctgtcaagcagcaaccctttgggtgggtttgttcgagacaagcaacggttcgcggctttgcgncagccctccggggtcaccgacgtttgttttcaccccccgcctaaaccaattgggtggtcaataacctcaccgttgttcaatggtgtttcgccccgaaaatgccctaaaacaatggtaagtcctggtccgtcgttccttatcccaaccagtccaaattttaagtccatggtaaaatcctgccaccttttataggagacctcgggaagttccggtcctaagaaagcaaaaaggtaaccctggcctggagttaaa

SEQ ID NO: 93413 - protein, 111 aa, Zea mays
  misc_feature: Ceres CLONE 1582710
  misc_feature (17)..(17): Xaa is any aa, unknown, or other
MGVPPLGCWVDLGSPTXGRANCFFSLPLSSSNPLGGFVRDKQRFAALRQPSGVTDVCFHPPPKPIGWSITSPLFNGVSPRKCPKTMVSPGPSFLIPTSPNFKSMVKSCHLL

SEQ ID NO: 93414 - DNA, 923 bp, Zea mays
  misc_feature: Ceres CLONE 1582711
  misc_feature: Encodes the peptide sequence at SEQ ID NO. 93415
gcggtggcggccgctctagaactagtggatcccccgggctgcaggaattcgtctcacccctagaaaaaatcgcaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggcacggcatccggcagataaggactgggtgggcggacgggccggagttcgtgacgcagtgcctcattcaggccccggcggcagctacaaataacggttcaccatccaggggcaaggaaggcaacgctgtggtgggcacgcgcaaaggttcctgggctaaggggcaaccgttctaagggggggcttcattaatctcgccccagggaaggaaacaagaacctaccccaattctcccaaaacccctccccgaaaaaattcccccgtccatccctccggggaaaatgggttggggaaatcccaaaaacccaattctaaagtttatttccggggaagggggcaaaaaataaacccggggggggggggtccccaaacgtgtttttccaaaggcgcgttttctccacatttaaaggggggaccattcccggggggaaaacctgttaaaaaaattgtttttccacaacaaaaagaagaaattaaagggggtcacaattcccccgggtggagagag

SEQ ID NO: 93415 - protein, 143 aa, Zea mays
  misc_feature: Ceres CLONE 1582711
  misc_feature (35)..(135): Pfam Name: Cu-oxidase_3 Pfam Description: Multicopper oxidase
  misc_feature: SWISSPROT Homolog: EC 1.10.3.2 Laccase
MASSSSSRLLLLLLPCLALTLLGAADAEVHHHEFVIQETPVKRLCKTHNIITVNGQYPGPTLEVREGDTLVINVVNRAQYNATIHWHGIRQIRTGWADGPEFVTQCLIQAPAAATNNGSPSRGKEGNAVVGTRKGSWAKGQPF

SEQ ID NO: 93416 - DNA, 814 bp, Zea mays
  misc_feature: Ceres CLONE 1582713
  misc_feature: Translation starting site: 186
  misc_feature (699)..(699): n is a, c, t, g, unknown, or other
  misc_feature (740)..(740): n is a, c, t, g, unknown, or other
  misc_feature (742)..(742): n is a, c, t, g, unknown, or other
  misc_feature (743)..(743): n is a, c, t, g, unknown, or other
ggagctccccgcggtggcggccgctctagaactagtggatcccccgggctgcaggaattcgtctcacccctagaaaaaaattcctcatcaccaagccgaaccacagagctcccccacacccacagcggggtgaagcgaatcgcatcaaattcgaccgaagaatcgcgccgctcggcccggccaccatgagcttctcgtccatgagcaagcagcaggtgctggacgccggtgacggggagggggaggaggtcatggagctcatcccgggcctgccggaggaggtggccgagaagtgcctcctccacctgcccttcctctaccaccgcctcttccgcaccgtctcctccacctggaaccgcttcctcacggacgccctggccaagccactgctgttccctcacgcggcgggggcggggaccgcggccacggggtcggtgcccttcctcttcgccctcgcctttgaccccatgtcgcggcgcctccagtgccaggcgctcgaccgtttctcgaggaagtggctcctgctcccgccggtgccccggcggcgccgcggccgggtcgttcgcggtggtggggctcccccgccgcggccagatctacgtgattgggggcgtcgaggagggcggcgacaaggccgtgacgagcgtggcggtgtacagcgccgcgcggaacgggtggggaggaggcggccgcaatgcngacgccccgcgggtacatggcggccggggaggtgggagggncnntgtttgggttgttttcccgggccataaaaaccctcggcgctcgtcttctcaccccaaagcacggagttgtt

SEQ ID NO: 93417 - DNA, 841 bp, Zea mays
  misc_feature: Ceres CLONE 1582714
  misc_feature: Encodes the peptide sequence at SEQ ID NO. 93418
  misc_feature (841)..(841): n is a, c, t, g, unknown, or other
cgcggtggcggccgctctagaactagtggatcccccgggctgcaggaattcgtctcacccctagaaaaaaactcattctttcacttctccagccgtcacagacaaccggccgccaggaagcatggccgaccgtgccctgctaatctcctccttttttttcttttttctgtttgcctacgcgcagcatagttctgttcttttcgtatgcgtgttcttttcgcatgcctgttgcatgcatgttacttctctctctgtttctgtttcttttttttgtgcgcagtctcatcggaccgcagggagcaccggcgcttggccggtggcgctcggccagagcggccttgcagccgcgctcggctagaggagcggccctgcagcccctcccgcctgctacgagataactacaggaccattccagctaacagtgtgcatctgatctatacctcctaactcgattccccctatgtgaatgcttgtacgagatgtaattatctgtattttgggatcgagtttggaggtaactatacgtggatctgtttcctaggggggttctctgtttattttgatgcgggccaaacagctctgtggcgttggaccctacctgatgccacttgatttttaaaaattataggggcacttttttatcccaaaaaaaaaaaaaaaaaaaaaaacggttttccccacccccaaaacccccaaaaccccagggggccaaaaaaaacaagggggggggccgggccagggggacccaaatttacccccccccgggaaaaaactcccggttgggggcccccccaaccggcattggtatgttttaaaaaggttttcacccccgtgggaaaan

SEQ ID NO: 93418 - protein, 78 aa, Zea mays
  misc_feature: Ceres CLONE 1582714
MADRALLISSFFFFFLFAYAQHSSVLFVCVFFSHACCMHVTSLSVSVSFFCAQSHRTAGSTGAWPVALGQSGLAAALG

SEQ ID NO: 93419 - DNA, 811 bp, Zea mays
  misc_feature: Ceres CLONE 1582715
  misc_feature: Encodes the peptide sequence at SEQ ID NO. 93420
  misc_feature (710)..(710): n is a, c, t, g, unknown, or other
  misc_feature (711)..(711): n is a, c, t, g, unknown, or other
ctccccgcggtggcggccgctctagaactagtggatcccccgggctgcaggaattcgtctcacccctagaaaaagggcattcgtcaaaccactcatcatcccatcccatcccatccaagggaatccgatcaatcccggactcgtcctcccggccaaccctagcttcccttctcttcccctcccccgatggacccgccgccaaccagggacagaggggaggagctggagcctgaaacccgcgccttccccgacgccgacgacccggagacctcccgatctgaacgcgaagagggtatccctccaccgccaccgccaccgcctctgcgccagcagctcatgggggcttgccgcgccgacgagcgcctcaggccgctcctcaccctcaacgtctcctgcggcgcagcggacgaccgactcatcgcacacctcgcgcagcacttcgaggtgtcggaggtgggcatgctcgcgcgttgcctctgtgttcccctcgtttccctgcgcgttggcaaggttcagagggaaggggccctcctctgcccacacacattagagggaagctgaaccttgttcttctgccatcatctagcatgcggcttacctttgtttgtgatgatggttatccagagcaactagctctcttgagcaatggctttgaattttcggaaagtatgattgaagaatatcagctgataattctggacgctcttccnntatcagaattcagaatctaagtgttttactactggtgtgctgagagtcgaaggacatggaatggacttctgcaagatgaaaaacttttgggacggagcat

SEQ ID NO: 93420 - protein, 124 aa, Zea mays
  misc_feature: Ceres CLONE 1582715
MDPPPTRDRGEELEPETRAFPDADDPETSRSEREEGIPPPPPPPPLRQQLMGACRADERLRPLLTLNVSCGAADDRLIAHLAQHFEVSEVGMLARCLCVPLVSLRVGKVQREGALLCPHTLEGS

SEQ ID NO: 93421 - DNA, 1271 bp, Zea mays
  misc_feature: Ceres CLONE 1582728
  misc_feature: Encodes the peptide sequence at SEQ ID NO. 93422
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (1088)..(1088): n is a, c, t, g, unknown, or other
  misc_feature (1271)..(1271): n is a, c, t, g, unknown, or other
tttttttttttnnngtcgatacccaactacaccccacctccttctgctgaaggcgcgaccagaaaagaaataaaaatggagctccccccggtggcggccgctctagaactagtggatcccccgggctgcaggaattcgtctcacccctagaaaaagagaggcgtttcgccgagcagttcgcgtgctcccctccacaggccgacgcggcgacgccgctgtttcaggttctggaatttccagtgcgggtgcattaggctgctatgggcaagtcgccggggaagtggatcaaatcggtgcttttggggaagaaatctaccaagtcaggtcctaccaagtcgaatgaatctaaggctgacaacaacagatactcgaccggggaggaccgcacattgtctgagagttctcctgtgatttctgagccggtactagttaacatccacaagaacgtagctatcaatgggaaggctgccgatgcccctgatatggcacggcaacaaagatccgccagagcccaatccgtttgttgagtcccagatcatccggcttcccagctgctacaagctggggaaaaagaatcaaggcttgcatcccgaaaggccccacgggaagccctttttcgttggggttaaccctggaccaaggtaaaggaccaaccttcccgtggccatttagacaaaggcgtattcggttaaaggaacttcccaaaaggcctcactgcgatatctcgggagggggctaacccttgtggggaaaatagacaggggtaccagagcgtctcggggtcattctcaaaacctccgcctttttccgtggcgggcgaaaaaaaaaatggggggtctatggaaaattgtggggcgagaacaaaatattattccccgggaccctccccacaacgcgtatccgcgagggccaataagacaagaaacagatggttctaataaagacccccgctcttgggcgggcgaggccccatactaatgggtgtggcttcatgccataattggattatagaaagtgtattagagcttccacacgaaagtatataccgttttgggggaggcggagggggttatacaaagatccccacntttagaaactcccaccgcgctacgacaggagaaagaaagatttttatactcatataacaaccgggccttttgccgtactattcggcgaaatagcgtttggaagtatccttgaccaccacatacatgtgcttttatagaaaaatctcacttatacgatgctcctcgcaagtatgtcaaaagggn

SEQ ID NO: 93422 - protein, 88 aa, Zea mays
  misc_feature: Ceres CLONE 1582728
MGKSPGKWIKSVLLGKKSTKSGPTKSNESKADNNRYSTGEDRTLSESSPVISEPVLVNIHKNVAINGKAADAPDMARQQRSARAQSVC

SEQ ID NO: 93423 - DNA, 868 bp, Zea mays
  misc_feature: Ceres CLONE 1582731
  misc_feature: Encodes the peptide sequence at SEQ ID NO. 93424
ccccgcggtggcggccgctctagaactagtggatcccccgggctgcaggaattcgtctcacccctagaaaaaatcaggcccacgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttaccaatccccctggcctgctgcttttccgacaatcgaccagttccccagtcttgctccctgcagtcctccctcctccatctccagggttttgttccggaccacctgcaccaatgggctggtctttctggctggggggtgctcccccggcctcagcttattcggttttgaaggggtatgaaaaagcgcccttggggatcacatttctctgaaggcaccttgtcttttgggggaccccccatgggcacgcgggtttgtggttgcccctcctccccgggtcccccagaattggactccttggtcctgggaaactttgggaccggg

SEQ ID NO: 93424 - protein, 50 aa, Zea mays; identical to SEQ ID NO: 23071
  misc_feature: Ceres CLONE 1582731
  misc_feature (1)..(50): Pfam Name: AdoMetDC_leader Pfam Description: S-adenosyl-l-methionine decarboxylase leader peptide

SEQ ID NO: 93425 - DNA, 823 bp, Zea mays
  misc_feature: Ceres CLONE 1582732
  misc_feature: Translation starting site: 265
  misc_feature: SWISSPROT Homolog: EC 1.2.1.3 Aldehyde dehydrogenase (NAD(+))
ctccccgcggtggcggccgctctagaactagtggatcccccgggctgcaggaattcgtctcacccctagaaaaaagccattacttactggtcctcactcccacaccaaccaaccaacctcctctgcctgccgcttctcctgctgcgggcgggcactgctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggccccttccggcgcgccgcccgctgccccctctgcgccgcgcaggacagtgcctgcagatgggatgcacaggctgttgccaggtgtccttcagaggttcagcactgcagcagcagtagaggagcccatcacgccgtcagtccatgtgaactacacaaagctcctcattaatgggaactttgttgattccgcatccggcaagaccttcccaactctggaccctcgtacagggggagtgattgctcatgtggctgagggtgacgcaaaagacataaccgtgcagtagctgcggcttcgcaggcttttgatgaaagggcatggccgaagatgactggctattaaaggtcccgtatcccaactgcgggtttgctgatttggatgaaaaacccaatggcgaagcttgctgcctttggaacttggggcaaccgggaaagcccattgagccagcagccccaaatttgaaataccccggggtgggcccggcctaagggggtaaaaatggccgggtg

SEQ ID NO: 93426 - DNA, 1181 bp, Zea mays
  misc_feature: Ceres CLONE 1582734
  misc_feature: Encodes the peptide sequence at SEQ ID NO. 93427
  misc_feature (1)..(1): n is a, c, t, g, unknown, or other
  misc_feature (47)..(47): n is a, c, t, g, unknown, or other
  misc_feature (61)..(61): n is a, c, t, g, unknown, or other
  misc_feature (62)..(62): n is a, c, t, g, unknown, or other
  misc_feature (1009)..(1009): n is a, c, t, g, unknown, or other
  misc_feature (1011)..(1011): n is a, c, t, g, unknown, or other
  misc_feature (1130)..(1130): n is a, c, t, g, unknown, or other
  misc_feature (1150)..(1150): n is a, c, t, g, unknown, or other
ngggtgggtggggggggtaggtggggggtatggtggtggggtgtttnatgtttttgttttnnaacacaaaacaaagaaaaactaaactcccctcggtggcggccgctctagactagtggatcccccgggctgcaggaattcgtctcacccctagaaaaacttccgggaaaaaggctcccaatctgttccgagccagccggccatggcgattagggctggccgctcgccccttctccacctcctcgccctcgccttcctcatcctcgccgcctctccctgcctccaagctcgagtggaccatcgcaaacagatatctcactggactgggcaacccaactttgacctgcagaatgtctcatcgggtcgaaaggatggccctcatctcctgggtagatcaaaggaaataacacacatgaaattaacgagagttgctgtaaggaagaaaatggaagtagtgcagcaaggatgatgaagcggtagttcaaacttgagaaatgagggtatcgaaaccgttcaaaaagcttgttggactctgcttgtggctggggaaaataccggcagtctggaacgaactgaaaaatgaaaaaataaaaaagggcgtgatttccaaaggggtcccccctttttggaattgcccaaaattctaaaatttattccatagggacccaggaaaaaaaaatattaccgggaatgcccatggggcctaaaaatttctcaaggggaggaaaaaaaggcccttgtgtgcaccccccccgaccacctcacaaggaagaaccctctttggcctttgtgagcaaaaaagagaagcttttttccagaggggggaaaaaaagaaacctagaggacgaccctcttctcacccttttgtggtggggggaaaaatcccctttactgtgtgtcgtgggaaggtgttgctaagaaaaactttaaccgacaaaaaaaataataggcgattctcacgggtaaacataccacacaccacaagttgcacatggtgaggcccaccccngnttcttatcaccccccaaagatgcctgggcgacaaatcacacaattgtattcgctgttgtcactcaggggcatatagtcacccccccaccacgatttataaaaaaccaaacggcattccncctatccacaacaatagaanacgggcccccccgaaactcttaaaaaaaaac

SEQ ID NO: 93427 - protein, 88 aa, Zea mays
  misc_feature: Ceres CLONE 1582734
MAIRAGRSPLLHLLALAFLILAASPCLQARVDHRKQISHWTGQPNFDLQNVSSGRKDGPHLLGRSKEITHMKLTRVAVRKKMEVVQQG

SEQ ID NO: 93428 - DNA, 826 bp, Zea mays
  misc_feature: Ceres CLONE 1582735
  misc_feature: Encodes the peptide sequence at SEQ ID NO. 93429
  misc_feature (782)..(782): n is a, c, t, g, unknown, or other
ggagctccccgcggtggcggccgctctagaactagtggatcccccgggctgcaggaattcgtctcacccctagaaaaacactccggtgcaagatagttggcccagtaaagagagtttagctgccgcaacagagttcagtgaggcggggagcatctcaagaacaggcgaggtggatgtcgccttgcggaaacccaccgtgcaccagagtcaggatgatgatctgaagtccaagctcaaaattaagccaaatgttaacctgaaaatgaggaaagatatgaatgaggacttaaggaacatttctctccttcaaaagccagatgttgcaaaagatactgtaaacccagagcaggaccatgcctccgctagccctgccacagtttctgctacagaggataacagcgaacttgaggcagaaaatgctcttgatgaaaaaatagcaaccgaaaatgtccatgaatcatctgggctcgatgatgattctgctgcaggactacagccatcagctcaaactttcatccaagaaacaagcactgctggaccagtagataaccaatcagctaccagcaacaatttctctatgcaggctttcttgcaaggaaaacctagaagagaaaaccaatctgctgaaatattgccatctgaagtagatgaaaagatgactgctactgataataaaaattatgttgatgatggggggaaatgtgttaccatcaaaattagaggacatcacagagagtgactggacaaggttagagaatttacgcagtaccggagaaaaaggntgaggtggagctgataaattgcagtgcgaaggggttttgttgtg

SEQ ID NO: 93429 - protein, 158 aa, Zea mays
  misc_feature: Ceres CLONE 1582735
MRKDMNEDLRNISLLQKPDVAKDTVNPEQDHASASPATVSATEDNSELEAENALDEKIATENVHESSGLDDDSAAGLQPSAQTFIQETSTAGPVDNQSATSNNFSMQAFLQGKPRRENQSAEILPSEVDEKMTATDNKNYVDDGGKCVTIKIRGHHRE

SEQ ID NO: 93430 - DNA, 1196 bp, Zea mays
  misc_feature: Ceres CLONE 1582737
  misc_feature: Encodes the peptide sequence at SEQ ID NO. 93431
  misc_feature (1182)..(1182): n is a, c, t, g, unknown, or other
tttgtctttttatcctttcctataacaataatctacttataaacaaacaatgcggttggtcctatttcttattttttcttagtgggagctccccacggtggcggccgctcttttactagtggatcccccgggctgcaggaattagtctcacccctataaaaaactctggtgcaagatagttcgcccagtaaagagagtttagctgccgcaccagagttcagtgaggcgggggagtttctcaagatccggtgatgtggatgtccccttgcggaaagaaccgtgcaccagagacacgatgatgatctgaagtccaagctcataattaagccaagtgttaacctgaaaatgaggaaagatatgaatgaggacttaaggaagatttctctccttcagaagccggatgttgccaaagatattggcaacccagagcaggaccttgcctccgctagcactgccacagtttctgctacagaggataatagtcacaccccatgcagaaattgctcttgacgaaataatagtagaccgaaaatgtccatgaatcaatctgggtctaccatgaagatttcttgcttgcgaggactttcagtctctttcaaacttaaaacattttcctcccttaagaaaaacagagcaacttggcttgtgacacccggtagaaatatatctaatttccagggctagacgagggctaatcaatgtatgttcttccttaatgcccagtggtcttttactccatgtgtctccaagggggaacaacaaacccgatttaggagagggtatagacaacaagaacgcgaaaaaatctctttgcacgttggaaaaaaaaatatattgtggccgcccaatctgctcttctaaaagcgtatacccaatgtgataataaatgcgaatctgcacacctgtggccttacacgctgtgaattttatttggggtacacaatgtttaataagttatttgaaaatgagattttaccggggggaaaaaaattcgcccgcttttcactctgtttaatgaaaaactctatagcataattacacctctgcacacaagtaatatggatgacataatgagtgcacaacctgcttctattcagaaacctttacttcccatatttaccacttgctaattgaaaacaccttctaatggtgatgaggatttttaatacaaattcgcttaanctgttgaaagtcta

SEQ ID NO: 93431 - protein, 54 aa, Zea mays
  misc_feature: Ceres CLONE 1582737
MRKDMNEDLRKISLLQKPDVAKDIGNPEQDLASASTATVSATEDNSHTPCRNCS

SEQ ID NO: 93432 - DNA, 1005 bp, Zea mays
  misc_feature: Ceres CLONE 1582739
  misc_feature: Encodes the peptide sequence at SEQ ID NO. 93433
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (44)..(44): n is a, c, t, g, unknown, or other
  misc_feature (46)..(46): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
aataaaataannnnatnnnttaattacttaaaatacaaagcgananaaatnnnnnnnttatttaaaaaaaaactgggactccccgcggtggcggccgctctagaacagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgttcgtcgacgtgcgctacgatgagggcctcccgcccatcctcacggcggctcgaggtgctcgacaacgacatccgcctcgttgctcgaggtggcgcagcaccttgggcgaagacatgggtgcgcacccatcgctatggaccggcacgggagggggcttcgtccgcgggccagcgcgttcctcaacaactgggcttcccccatcaaccggggcttgttgggccagggctacccccttggacgtaatcctttaaaaggttaatccggtgaaccccaattggatgaagaaagggtggatataaacggaccaaacccacttttcctccccctatccaatatcgggaaaagccccccggccttttccgtttgaagcagggccccttgaagccagcccaaaatttcttgtgttactggggaaaataaaggggtgccgggggaaatttttctttgggaaccccttaaccaaaagaaaagggggtagaaaaaaatgaagagttaa

SEQ ID NO: 93433 - protein, 98 aa, Zea mays
  misc_feature: Ceres CLONE 1582739
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVRRRALR

SEQ ID NO: 93434 - DNA, 789 bp, Zea mays
  misc_feature: Ceres CLONE 1582740
  misc_feature: Encodes the peptide sequence at SEQ ID NO. 93435
ctccccgcggtggcggccgctctagaactagtggatcccccgggctgcaggaattcgtctcacccctagaaaaaacaggccgtgaagtggcctggcccctcatcgcttctcgtagtcgtagtctcgcacccaccactccatcgtctccatccacgcgcccgcgcgcggcccggcaacgggagccaaggaaaccgaagccccgatggcgagcttcttccgggacgcgcgcctcccgcagcagcgcgtcgtcgagggcgtcccgttcccggcggtgctggtcccgagcgcccccgcgggcggcgggctcgacgagttcctggcggccgtgcgctccgagagggcgtcccggctggagccgctggtgcgggacgcgggggccctgctgctgcgcgggttccccgcgacgacggccgcggacttcgaccgcgccgtcgacgccttcgggtacgaggagctgccgtacgtcggcggcgccgcgccgcggaccaacgtcgtgggccgggtgttcaccgccaacgagtcgccgcccgatcagaagatccccttccaccacgagatggcccaggttccaacgtttccgtccaaactgttcttcttctgtgaagtggagccaaagagtggcggggagacaccgatcgtactgagccattacatctacaagaggatgaaggaagaatttcctgaattcgtggagaaactggagaaggaagggctggtatatacaagggtttctgggagagggcgacgacccgtcttcgccaatcggccgtggatgggcatcgacatttc

SEQ ID NO: 93435 - protein, 195 aa, Zea mays
  misc_feature: Ceres CLONE 1582740
MASFFRDARLPQQRVVEGVPFPAVLVPSAPAGGGLDEFLAAVRSERASRLEPLVRDAGALLLRGFPATTAADFDRAVDAFGYEELPYVGGAAPRTNVVGRVFTANESPPDQKIPFHHEMAQVPTFPSKLFFFCEVEPKSGGETPIVLSHYIYKRMKEEFPEFVEKLEKEGLVYTRVSGRGRRPVFANRPWMGIDI

SEQ ID NO: 93436 - DNA, 824 bp, Zea mays
  misc_feature: Ceres CLONE 1582748
  misc_feature: Encodes the peptide sequence at SEQ ID NO. 93437
gcggtggcggccgctctagaactagtggatcccccgggctgcaggaattcgtctcacccctagaaaaaatagagagccactggccacacgcaagacaggcagtgaggatcggacgagtcggcgaggaagctgcctgcttttcagatagagttattaagatggcgttgcttcggctgcttgccctgatctccctgctcttctcagtggccactcctgtcagggacatcgcccacgatgactgctcatcagaagtgaaggatttccagcacctgaagtacaggtcggggctccacctgacgctgcaccacccgcagagcccctgctccccggcgccgctgcccgccgacctccccttgtccgcggtgctcgcccacgacggagcgcacaccacgtcgctcgccgcgcgcctcgacaagacgccgtcctctcggcccaccttgcttgaccagagccgcgcggggtcgtcgtcgtcgtcccccgatgacgagtccctcgcgtccgtgccgctcggccctggcacgtccggcggcgtgggcaactacgtcacccgcatgggcctcggcacgccggacaaggcgtaactcatggtcgtggacacggagtcctctcgcgaactgggtccagggctcccccctgcgtcgtggccgtgccaaccgcctgttccggcccgggtgttcaaccccaaaggcggtccaggctccctaaaccctcccgtggtccctggctcccccgccagcaggtggcaggtgacccttaccacccggggacggctttaagcgcccgccctttccggggtttcaacccttccaaagggtctgggaaat

SEQ ID NO: 93437 - protein, 140 aa, Zea mays
  misc_feature: Ceres CLONE 1582748
MALLRLLALISLLFSVATPVRDIAHDDCSSEVKDFQHLKYRSGLHLTLHHPQSPCSPAPLPADLPLSAVLAHDGAHTTSLAARLDKTPSSRPTLLDQSRAGSSSSSPDDESLASVPLGPGTSGGVGNYVTRMGLGTPDKA

SEQ ID NO: 93438 - DNA, 1211 bp, Zea mays
  misc_feature: Ceres CLONE 1582752
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (1045)..(1045): n is a, c, t, g, unknown, or other
  misc_feature (1072)..(1072): n is a, c, t, g, unknown, or other
ttgtggttggnntntttgcttcttttctcattacatattgttcaaattatttcttcaaacccgaatcatatcccccccaataatataatttgaactcccctcggtggcggccgtctctagaactagtggatcccccgggctgcaggaattcgtctcaccccctagaaaaattcaccgtccacgttccatatggcttcctgcaagatgacactcctccttggcttgctgctgctagtagtagcttcccccgcgatcgctgatgacgaccccggttacctactaccaactggcctcttttgtggccaggaagcaacctgccaacaaaccaacccccgggggccttcaaggccgaaccccccgagatctttccccgagcccgcaaaacttttcctaaattattttaaaggtggttttttttttttcccctctcttttgttttatattctagttatatcctaccaataaacacctcctccaattgtaccttattatattgtagacagtatattttacgtcaaactaacacaaatcattaaaatcagcactatatcctataacctttcttgaggtttatcacaaactccatcttttaagaatgatttattttttgttctctgtccttcttgagcttgttcgtccctttcttttttttttagtttcttgttcattcactcctcccaccaacaacccgcaccactaaaactttaaacaatactatgaattacactttccctctatgagctgtacctgcgctctacagctttcatcaaacaaagctacttagattaaacgagacgaaatttcctcctttcggtgttataaagtttgagatcttcgtatttcttcacttacacttttgactgttgccataattctctccttactactactaacataacaaagacatcacatctcccaaatgatagcctaaaatatctatgtaagagttgttgccatgtatattactacaacaaccttcctaaactacaaaccacacttactacaccacactaaacaaactatatacatatgtgacaattctatntctattagtagctgcataacatctagngggatcccgtacgcactggtgccggcctatcgtgtggtggagtctctgcccaggttcacgcgctggtctctatatacacgtgatagtagtaaggaacacataagattcgtacaatgtgtcgtgtgtcgcgttctacgcg

SEQ ID NO: 93439 - DNA, 866 bp, Zea mays
  misc_feature: Ceres CLONE 1582753
  misc_feature: Translation starting site: 169
  misc_feature: SWISSPROT Homolog: EC 3.2.1.23 Beta-galactosidase
tctgaactagtggatcccccgggctgcaggaattcgtctcacccctagaaaaaatcctctcccactccctcgtccctccccctcgtccagttcactcccattgggcgagaagccgagaaggacagggagggagcgagagctagccaggccgtcccgtccagagccgctatgtccggcggcgcgcccctcctggccctgctgctgctggcggcggcggccatgatcgccccgtcgccggccaatgccgccgtgtcgtacgaccacagggccgtggtcatcaacgggcagcgccgcatcctcatctcggggtccatccactacccgcgcagcacgccggagatgtggccggggctgctgcagaaggccaaggacggcgggctggacgtggtccagacgtacgtgttctggaacgggcacgagccggtgcgtgggcagtactacttcggcgaccgctacgacctcgtccgcttcgtcaagctcgccaagcaagccggcctctacgtccacctccgcatcgggccataactctgcgccgagtggaacttcggcggtttccccgtgtggctcaagtaactccccccgcatcagcttccgcacagaccacggcccccttcaagggcgggcgatgcaggggttcgtgggaaaagatcgtgtccctgaatgaagtcgggaggggctgttcaaagaggcagggcgcggcccattattccttggggcagggtggagaaacaattacgggccccctgggaagtccgtacaggggggcgcccgggcccccaaaccccttatgccaaactgggggcagcccaaaaaatggcccgtttccccacccgggccccgggtcggtcccactggggtcacatggt

SEQ ID NO: 93440 - DNA, 1070 bp, Zea mays
  misc_feature: Ceres CLONE 1582754
  misc_feature: Encodes the peptide sequence at SEQ ID NO. 93441
  misc_feature (12)..(12): n is a, c, t, g, unknown, or other
  misc_feature (13)..(13): n is a, c, t, g, unknown, or other
  misc_feature (31)..(31): n is a, c, t, g, unknown, or other
  misc_feature (57)..(57): n is a, c, t, g, unknown, or other
  misc_feature (59)..(59): n is a, c, t, g, unknown, or other
  misc_feature (61)..(61): n is a, c, t, g, unknown, or other
  misc_feature (71)..(71): n is a, c, t, g, unknown, or other
  misc_feature (73)..(73): n is a, c, t, g, unknown, or other
  misc_feature (94)..(94): n is a, c, t, g, unknown, or other
  misc_feature (128)..(128): n is a, c, t, g, unknown, or other
  misc_feature (148)..(148): n is a, c, t, g, unknown, or other
  misc_feature (166)..(166): n is a, c, t, g, unknown, or other
  misc_feature (170)..(170): n is a, c, t, g, unknown, or other
  misc_feature (174)..(174): n is a, c, t, g, unknown, or other
  misc_feature (179)..(179): n is a, c, t, g, unknown, or other
  misc_feature (181)..(181): n is a, c, t, g, unknown, or other
aaacggggaaannaaacaggaccaaagaaanccaagcaaaggccacagcccaggggncntntggggggttncnccaaactggattcagtgtggnggctgccgaattcaaagaggggatcccccgggcngttttcaaaagaggggcccnagaaaaaacaccaccacncccncacngcccncncatttccgctccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaaagccctttttttataccacccacaccgcgcaaccattgttgtctctggtgatggccgccactcctcaaaagaagcaggtcagagcagagcgaaaggggctgccgccaatgggagaaaagactggtttggggtggaacaaaacaaggccccaagtctaaccccctgctggaaaccggccgggcaaaccggggaaaaaaaatgggggccagaagggaaacaaaaggcctaccggggggcccccccaatcctgggaacaacccaagccccataaaccccaaaggggggggccctcaacggggagggaaaatcctgggggaaaccaaaaaaaacaaaaaataggcggaaaaaagggggggaaacccggcccccgcggaaaaacccggtgaacccaaacaaaaagaaaattccccctaaaaaaaaaaacggaccaaaacaccggggaaaaaccctcaaaccccgcggaaagaacctcccccaagagggtgaagaaaactcccgggaggggcggggggccaccccgccctaccagggggaacccgaaagggcgcccccatggaaaagggagaagcccttggaacacccaggaggaaaaaaacccaaagacggcaagggaaaacacaagtttggacgcccgcgaagaaaaaaaaaacccc

SEQ ID NO: 93441 - protein, 135 aa, Zea mays
  misc_feature: Ceres CLONE 1582754
  misc_feature (16)..(132): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFEGQKPGTSGLRKKVTVFQQPHYLQNFVQSTFKALFLYHPHRATIVVSGDGRHSSKEAGQSRAKGAAANGRKDWFGVEQNKAPSLTPCWKPAGQTGEKKWGPEGKQKAYRGAPPILGTTQAP

SEQ ID NO: 93442 - DNA, 808 bp, Zea mays
  misc_feature: Ceres CLONE 1582756
  misc_feature: Encodes the peptide sequence at SEQ ID NO. 93443
ctcaccgcggtggcggccgctctagaactagtggatcccccgggctgcaggaattcgtctcacccctagaaaaaagttgtaaatttgatcaatgaagaagattcaagaattaccgttttactggattgccatgggatttcgccattcagatttccaatgcaaatgatgaggtcgtttatcactgtggttcaagaaaactacccgaatcgtcttggggtattgtttgtcatccgccttcctccagttgtcagagttattgcacagacatttcttcaaattgcaatatcacatggtatccgtggagatgaggacgacattgcctccaagtctgctccaccggcatccatcgacggtgcaagatccagcagatagattgatggcaaagaggacgactccatgtccaggcgtactccccgccttgcatcgagattgctaggtcataatcgaagggtttacagggaggagatctgaacatagctcttcaatcccaaagttaacatcgttggttaccataattcttactgcttgcaagcccttttagaatattactgctgcgaggttcttgcaagtccttgatgaagaagtcgaaggtgacgaacgccgaggccgtcatcctgatcgacgccaagaacctcacagcgcacctcccttgtgatgctcttttctccaatgtcttctcctatctacatgcaggaaaaaatctacatgtttgatggcgtggatcagaaaaatgtgggaagaacagattttaagatgcactgccatgggttggcgggtctattttactgatctcgaagccggttgcatt

SEQ ID NO: 93443 - protein, 71 aa, Zea mays
  misc_feature: Ceres CLONE 1582756
MQMMRSFITVVQENYPNRLGVLFVIRLPPVVRVIAQTFLQIAISHGIRGDEDDIASKSAPPASIDGARSSR

SEQ ID NO: 93444 - DNA, 789 bp, Zea mays
  misc_feature: Ceres CLONE 1582758
  misc_feature: Encodes the peptide sequence at SEQ ID NO. 93445
ctccccgcggtggcggccgctctagaactagtggatcccccgggctgcaggaattcgtctcacccctagaaaaataaactcacaacacggtagcagggggtggtagtagaaggcataagctctgttctctgaccctcaagtgtttgagcctatttgcgcaacgaaaaaatgagcatcaaaagcattaatggaaagagccccatagtggttggaccttggggagggacaggagggtacccttgggatgacggcgtgtactcaacaatacgccagatcgtgattggccatggtgcagctattgactcaataaggattgaatatgatctgaaaggaaggtcggtttggtcagaaacgcatggaggtactgatggtggctccgaaacagataaggtgaaactagattttccagatgaagtcctcgtgtctgtaagtggacactacggatctgtctgcgggacaccggtcatcataagatcgttgacgtttcagagcaacagctcgacgtacggacccttcggcaccgaggatggcacacctttctcactcccagttagcagtggcaagatcattggattccacgggcggtctgggtcgtatctcaactcaatcggtttctacctgaagcaggtgcattttccaactccagtgaatccttctccagcttcacctctgagcctcccgagtccacaaagtagaaacagcgcctatggcctcaccggtggcgacgctagacctgacatggttctcgccgtgcgagacagaagagacagctatgctgtctacgcgagc

SEQ ID NO: 93445 - protein, 207 aa, Zea mays
  misc_feature: Ceres CLONE 1582758
  misc_feature (22)..(153): Pfam Name: Jacalin Pfam Description: Jacalin-like lectin domain
MSIKSINGKSPIVVGPWGGTGGYPWDDGVYSTIRQIVIGHGAAIDSIRIEYDLKGRSVWSETHGGTDGGSETDKVKLDFPDEVLVSVSGHYGSVCGTPVIIRSLTFQSNSSTYGPFGTEDGTPFSLPVSSGKIIGFHGRSGSYLNSIGFYLKQVHFPTPVNPSPASPLSLPSPQSRNSAYGLTGGDARPDMVLAVRDRRDSYAVYAS

SEQ ID NO: 93446 - DNA, 834 bp, Zea mays
  misc_feature: Ceres CLONE 1582762
  misc_feature: Encodes the peptide sequence at SEQ ID NO. 93447
  misc_feature (680)..(680): n is a, c, t, g, unknown, or other
  misc_feature (715)..(715): n is a, c, t, g, unknown, or other
  misc_feature (719)..(719): n is a, c, t, g, unknown, or other
ccccgcggtggcggccgctctagaactagtggatcccccgggctgcaggaattcgtctcacccctagaaaaagcacaagcgcaagccgggcaagaaaactccgcaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacgctgtcgtttgatgntggcatcgtgacgatcttcggcgggcggctggacnaagnggcgcaaagcggagctgaggaagaaattactcgtcgttgaagaaggggaacaactctttcccaacagcctgccgggggacgcttcattacaaagcgatgcaaggccccgcgcgga

SEQ ID NO: 93447 - protein, 211 aa, Zea mays
  misc_feature: Ceres CLONE 1582762
  misc_feature: SWISSPROT Homolog: EC 1.14.13.93 (+)-abscisic acid 8'-hydroxylase
  misc_feature (186)..(186): Xaa is any aa, unknown, or other
  misc_feature (198)..(198): Xaa is any aa, unknown, or other
  misc_feature (199)..(199): Xaa is any aa, unknown, or other
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFHQGDYHLRLRKLVQGALGPDALRALVPEVEAAVRSTLASWDAGHVRSTFHAMKTLSFDXGIVTIFGGRLDXXAQSGAEEEITRR

SEQ ID NO: 93448 - DNA, 872 bp, Zea mays
  misc_feature: Ceres CLONE 1582763
  misc_feature: Encodes the peptide sequence at SEQ ID NO. 93449
  misc_feature (450)..(450): n is a, c, t, g, unknown, or other
  misc_feature (486)..(486): n is a, c, t, g, unknown, or other
  misc_feature (497)..(497): n is a, c, t, g, unknown, or other
acccgcggtggcggccgctctagaactagtggatcccccgggctgcaggaattcgtctcacccctagaaaaaagccctcttcctcttcctcgctatacaggacttcccagcagagcagagagctgagacgaaaacgagaagatcccatccactaccgcccggtcgccgtcctcccttcccgccgcgccgctccgcttgctcgccgcagatcgccctcaggattttattccgccctccgtctccgggctcgcttggatcgagatgggcgtctgcgtgtccaaggccgcctcctcctgctgctgctgctgctgctgccgcgagccgcacaacggggttactaacgacaggactgatgctgtaacggatgacgaggaggcatacgccctgcctgcgttccaggagtttaccttcgagcagttgcggctagctacatcaggggtttgcggtggnagaacatcgtgtctgagcagggtgagaaggctcccnatgttgtatancagggggaagcctcatgcccagggccccgttcgccgtaagcgctttcaaccgtttgtgcttggcccgacccggggccagtccctggaaaaaactaagatcagttgggccgctcccaaagcaaagggtgggcaaattttctttggcttttcctcaaaggggaaaaaaaggtttcttttttccaaaaaaatgccccaaggaacccccggaaaaattttttttcccggggggggccccctcggaaaagggccccgggaattgggggggtttctctcctttgcggggggttttaaaaatgccaccaggggggggggggctcctccccgggaatctcgcccaaaaaagtttttttttaaagaattgagccccccccccct

SEQ ID NO: 93449 - protein, 203 aa, Zea mays
  misc_feature: Ceres CLONE 1582763
  misc_feature (79)..(79): Xaa is any aa, unknown, or other
MGVCVSKAASSCCCCCCCREPHNGVTNDRTDAVTDDEEAYALPAFQEFTFEQLRLATSGVCGGRTSCLSRVRRLPMLYXRGKPHAQGPVRRKRFQPFVLGPTRGQSLEKTKISWAAPKAKGGQIFFGFSSKGKKRFLFSKKMPQGTPGKIFFPGGGPLGKGPRELGGFLSFAGGFKNATRGGGAPPRESRPKKFFFKELSPPP

SEQ ID NO: 93450 - DNA, 924 bp, Zea mays
  misc_feature: Ceres CLONE 1582764
  misc_feature: Encodes the peptide sequence at SEQ ID NO. 93451
  misc_feature (1)..(1): n is a, c, t, g, unknown, or other
  misc_feature (2)..(2): n is a, c, t, g, unknown, or other
  misc_feature (62)..(62): n is a, c, t, g, unknown, or other
  misc_feature (63)..(63): n is a, c, t, g, unknown, or other
  misc_feature (80)..(80): n is a, c, t, g, unknown, or other
nnttttttggcggggggcccccacacaaagagggagccgtttgtaacataaaaatgttcacnnaaaaaaacaacctaacnaaaaaaactagaactccccgcggtggcggccgctctagaactagtggatcccccgggctgcaggaattcgtctcacccctagaaaaactggggagcaacgcaagcactccacactgctgtgcagaacgagagccacaccatcagtagttagagcgaccaatagatgagttcctccccgtcctttggtctcctggctgtagcagcattactcctagcactgagcttagcacaacatggctccctcgccgcaaccgtcggccccagggtcatcgtcgtcggcgccggcatgtctgggatctcggcggcgaagaggctgtcggaggccgggataaccgacctgctgattctggaagcgacggaccacatcggcgggcggatgcacaagacgaacttcgccggcatcaacccccacttaggcgccaactgggtggagggcgtgaacggcggcaagatgaaccccatctggcccatcgtcaactccaccctcaagctccgcaacttccgctccgacttcgactacctcgctcagaacgtctacaaggaggacggtggcgtctacgatgaagattacgtccagaagagaattgaactggcggacagcgtggaagagatgggggagaagctctctgccactttgcacgccagtggcagaaacgacatgtctatccttgccattgcagcgcctcaacaaaacaccagcccgaacgggcccggcgacccccggggggacatgggtgggtggaacttactaccaaggttcgaacttacagaattcggccggaagcccccccccccgcgttgaacccaggcccctggcaaaaaacaaccccgttggcccctcccc

SEQ ID NO: 93451 - protein, 212 aa, Zea mays
  misc_feature: Ceres CLONE 1582764
  misc_feature: SWISSPROT Homolog: EC 1.5.3.11 Polyamine oxidase
MSSSPSFGLLAVAALLLALSLAQHGSLAATVGPRVIVVGAGMSGISAAKRLSEAGITDLLILEATDHIGGRMHKTNFAGINPHLGANWVEGVNGGKMNPIWPIVNSTLKLRNFRSDFDYLAQNVYKEDGGVYDEDYVQKRIELADSVEEMGEKLSATLHASGRNDMSILAIAAPQQNTSPNGPGDPRGDMGGWNLLPRFELTEFGRKPPPPR

SEQ ID NO: 93452 - DNA, 853 bp, Zea mays
  misc_feature: Ceres CLONE 1582766
  misc_feature: Encodes the peptide sequence at SEQ ID NO. 93453
ctccccgcggtggcggccgctctagaactagtggatcccccgggctgcaggaattcgtctcacccctagaaaaaattcgcatctctgcttctttctgcttgggtgccctctgccctgaccacagggcccaaccatatcttcttcctcacacagagacactgagcgagcgagcttgagatcgatctcaggaggcggccggcggcggcagcagcagcagagcttgttggcgccgccatggcgataggtggcttcgtggaagcccctgccggcgccgactacggtggccgcgtgacgtccttcgtggtgctctcctgcatcgtagccggtagcggcggcatcctcttcggctacgacctcggcatctcaggtggggttacctccatggagtcgttccttagaaagttcttcccggacgtgtaccaccagatgaaaggagacaaggacgtgagcaactactgccgcttcgacagcgagcttctcaccgtcttcacctcctccctctacatcgccggcctcgtcgccacgctcttcgcctcctccgtcaccaggaggttcggccgccgcacctccatacttatcggaagcaccgtcttcgtcatcggctccgtcttcggcggggcagccgtcaacgtatacatgctcctactcaacaggatactccttggagtaggcctcggaattcacaaacagtccatccgctgccccctttacaaaaaaagggccgcccccgcaataccgggggcgccattaacaaacgggcttcaagctctgccattagcaatcgggcattcttcaatgccaaccctcatctaattaagggcgtgggaagaagataaccaagtgggaagggggt

SEQ ID NO: 93453 - protein, 192 aa, Zea mays
  misc_feature: Ceres CLONE 1582766
MAIGGFVEAPAGADYGGRVTSFVVLSCIVAGSGGILFGYDLGISGGVTSMESFLRKFFPDVYHQMKGDKDVSNYCRFDSELLTVFTSSLYIAGLVATLFASSVTRRFGRRTSILIGSTVFVIGSVFGGAAVNVYMLLLNRILLGVGLGIHKQSIRCPLYKKRAAPAIPGAPLTNGLQALPLAIGHSSMPTLI

SEQ ID NO: 93454 - DNA, 823 bp, Zea mays
  misc_feature: Ceres CLONE 1582770
  misc_feature: Encodes the peptide sequence at SEQ ID NO. 93455
  misc_feature (563)..(563): n is a, c, t, g, unknown, or other
gcggtggcggccgctctagaactagtggatcccccgggctgcaggaattcgtctcacccctagaaaaaatccgcaacaaattcctagctaaaccctcctccccgtcgtccaccgccggtcgccgccatggcgctctccaagcctctcctctctcgcctcctcccccttcctctccgcctacgtcctcaggcccgcttcctctgcctcgccaccccgcctttgacgccgtcctcgccgcgctgctccgccaggcccgctacgccgacctcctatccctccaccgcttcgtcacgcaggcctctgtcgcgcccaccgtcgccacctacaacctcctccttcaggcctactgcgactgccgccgccctgacgtcgcgcttgagcacttccgcctccttctcaaggacgactcgcccgtgctcccatcccccaccacataccgcatcctggcgcgctccctcgccgagaacggcaagctagaccaggcgctcgagctcaaggatggcatgctcgagcgtggccttattgcccctgataccaggtgtatgccttcatcatgggtgggnttgtcaatgccggggatggggacaaggcagtttcgttgtttgaggagacaagggagaacttggcggggagtctattcttgaatgcgtaatgtattgcaacctaatgaaaaggtatttcctcaaggcatggaaaaaggagccatgggattgcttttcaaaagggcttggaaaagggtccaaaggggaagggtcgggctttgaaaaaaaaaaggggggtttaaaccccttgggaagaaaatggaaggtttgaaaaaaaccat

SEQ ID NO: 93455 - protein, 213 aa, Zea mays
  misc_feature: Ceres CLONE 1582770
  misc_feature (143)..(177): Pfam Name: PPR Pfam Description: PPR repeat
GGGRSRTSGSPGLQEFVSPLEKIRNKFLAKPSSPSSTAGRRHGALQASPLSPPPPSSPPTSSGPLPLPRHPAFDAVLAALLRQARYADLLSLHRFVTQASVAPTVATYNLLLQAYCDCRRPDVALEHFRLLLKDDSPVLPSPTTYRILARSLAENGKLDQALELKDGMLERGLIAPDTRCMPSSWVGLSMPGMGTRQFRCLRRQGRTWRGVYS

SEQ ID NO: 93456 - DNA, 1324 bp, Zea mays
  misc_feature: Ceres CLONE 1582771
  misc_feature: Encodes the peptide sequence at SEQ ID NO. 93457
  misc_feature (54)..(54): n is a, c, t, g, unknown, or other
  misc_feature (55)..(55): n is a, c, t, g, unknown, or other
  misc_feature (57)..(57): n is a, c, t, g, unknown, or other
  misc_feature (474)..(474): n is a, c, t, g, unknown, or other
aaaaaagtgatgaaaaaaagagatatgtggtgataaaacactactcacaaaaannancacaaccctccctacccactaacctcaccgcagtggcggccgctctagaactagtggatcccccgggctgcaggaattcgtctcacccctagaaaaagcacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcagtggcccaaccatggcggtcattgccctcaagtgcccagacattgaggttgtcgttgttgacatctccaagccccgcattgaggcaccnaccaccttatttcctcccgatctacgagcccgggcctcgatgatttttgtggaagcacgtgcagggagcaaggaaccttcttctttcagcacctgaacgttgaagaaagcaccgtccccttgaggcctgacaatcattcctttcggtctccgggggaaacccccccccaccaaaaaaccccctggtgggtccttggaaggcttggacaaaaggaatggccgaaaacccttcccccttaccttggggaaaaatgccgcccggcccttcattaattggaatccgtaccctgaaatagtgtctcttctaaagagttcctcgtgaaacaaataacgactcgacactatgtcctcgataatataaagatcacacctacacctcggttttaccccccccttgattcttacatagaaacccccccccctcaccgagaattgtgttctcaactttgttgagaaagaacagaaaaaactttttggtgatcacccgccatcagaataaagtacaaagagggggcgctcatcttccagtccttattccacgcggaatatcccctttttcatccataaacccacccgggaatatgtccctctctttctcacgaagagggcacatctggcctctatatttggagaagaaactcgtgtgttcaagagacccctgatacaacagagaggatgcgctccatttctgctggcgcgcttagtgagaaaaaccatcttctagggggctaggggagaataatcttcacccatgtgcttcttctaaagtgaactgtgaatatgtcccccttttggctcttcccagggagcagaggtgtccacccaaaccataacctgtgtaacgcgggagg

SEQ ID NO: 93457 - protein, 73 aa, Zea mays
  misc_feature: Ceres CLONE 1582771
  misc_feature: SWISSPROT Homolog: EC 1.1.1.22 UDP-glucose 6-dehydrogenase
MVKICCIGAGYVSGPTMAVIALKCPDIEVVVVDISKPRIEAPTTLFPPDLRARASMIFVEARAGSKEPSSFST

SEQ ID NO: 93458 - DNA, 979 bp, Zea mays
  misc_feature: Ceres CLONE 1582773
  misc_feature (320)..(320): n is a, c, t, g, unknown, or other
ccccgcggtggcggccgctctagaactagtggatcccccgggctgcaggaattcgtctcacccctagaaaaagtacctctcggctctcgctcttatccccacccacctcgctttctcccctctacaagaaagcgaccaccgctgtgaatcagcagagctgcagtgagagcaagtgagaggatcagaaaggaggcatccgtgaccaaagatcgagtagccaagaagaagagagatgaacgccgacttcggcgcgcccaaggagctcgcggggagcctgcagcagcggcgggccctgtaacagccccgcctccggcatgccntcagggaacgaccgtaagggcggagtaccgggacgcgaccacaaaccttgattcccacctgtgccccaagcggttgggcaaggctttcccggaaaccttttgggcaacccgctttgtaaactttttttttccccccggcccccggggccccggggcccctttaaggaagagcccccccccaaaacaaggggggggggcgtggggggttttctttttgggaggggggcattccccccgggggggggggaccaaaacgcctctctcttgggggggccctccctctgggggggcgccttttataaaagcctcctcaaatttccccccctaagaaaaggtttgttcccctcacagggaaattcttccccggcggggggcgccccacaaagggagacactgttttttttcaaaaccaaacacaagttgggggggagaaataaccacaaaaaaaatgtttttttttctctccctcttataaaaaccaaacaaggaggggggtttctcatatttattcccccggcgggggggattttattttaaaatacctccccgcccccataaaaaaagggggagtggggtgtggtggaaaaacaaaactcccccccacccaaaaaatgtggtgggggggggggggcccccctcgggggggggggggcccgcca

SEQ ID NO: 93459 - DNA, 807 bp, Zea mays
  misc_feature: Ceres CLONE 1582778
  misc_feature: Encodes the peptide sequence at SEQ ID NO. 93460
  misc_feature (738)..(738): n is a, c, t, g, unknown, or other
  misc_feature (773)..(773): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
ctggagctcaccgcggtggcggccgctctagaactagtggatcccccgggctgcaggaattcgtctcacccctagaaaaactccgtctcgcgtgacttcattcccagcggccggcggcgacctccacgtggtgccattcgccggcaacgagcacccgcccaccaggatccaggtttgtgctgcgagagcgcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtatgtgagttggatttgatattcaattttcataaggcctactacatactggatgagattctcatcgctggtgaacttcaagaatctccccttcccctgctcccccgaagcagcaagccagcctgcccacccgcagccatcacctccgccgctctccaccatgaatcccatccaccagcacggcatcgtacccaatccttcgtgactgttgcctccgcgcatctccgggagcaatgggaggangccgagatgtgtcttaaggtgccggccgcaagggngcccgccgccgccgcctacggggnnnnnnnnnna

SEQ ID NO: 93460 - protein, 197 aa, Zea mays
  misc_feature: Ceres CLONE 1582778
  misc_feature (1)..(137): Pfam Name: Clat_adaptor_s Pfam Description: Clathrin adaptor complex small chain
  misc_feature (178)..(178): Xaa is any aa, unknown, or other
  misc_feature (190)..(190): Xaa is any aa, unknown, or other
MINFVLLISRQGKVRLTKWYSPYTQKERTKVIRELSGLILTRGPKLCNFVEWRGYKVVYRRYASLYFCMCIDAEDNELEVLEIIHHFVEILDRYFGSVCELDLIFNFHKAYYILDEILIAGELQESPLPLLPRSSKPACPPAAITSAALHHESHPPARHRTQSFVTVASAHLREQWEXAEMCLKVPAARXPAAAAYG

SEQ ID NO: 93461 - DNA, 1321 bp, Zea mays
  misc_feature: Ceres CLONE 1582781
  misc_feature: Encodes the peptide sequence at SEQ ID NO. 93462
  misc_feature (9)..(9): n is a, c, t, g, unknown, or other
  misc_feature (10)..(10): n is a, c, t, g, unknown, or other
  misc_feature (47)..(47): n is a, c, t, g, unknown, or other
  misc_feature (50)..(50): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (951)..(951): n is a, c, t, g, unknown, or other
  misc_feature (1061)..(1061): n is a, c, t, g, unknown, or other
  misc_feature (1062)..(1062): n is a, c, t, g, unknown, or other
tttcccttnnggcccgccgcctaccattcacccacgcccacactccnganagaaaaaannnaaaaaaaaaagcacaactaagagtgggactcccagggggtggcagccgctctattaatagtggatcccccgggctgcaggaattcgtctcacccctagaaaaagggcgctgcagtagcgcagcgcagcctcgccgcggcaacagcaacaccgcaccatggcgcttcatcttcatccccgcctcccgtcccatcctttccgcgcggcagcccaccaccaccacgccatctcggacgcctcttgcttccttaccctccacggccccggaaggaagcgcctcatgctgctcgcggcggacacatgccacgcagccagggtgaaggaggccgctccgagtgtaggagcatcgcctccgccgccgccacaggcgctgacgaaggaggcgcacaatgtattctaccacgccgcggccacaatctgggcggccccaagcgggcaagtacgccatgcttcgccatgtcgtcggtcgccctccgcggaacgaccaccaagtctccgtcggcagggtatcatacctgtgggcgcagtaataaagaagtcatggaaaggttgtccgctacgaaggcggagaaccaaatcaaacagggaacccgtttatatttcatttcactgtattgggtagagagacagccgtttcttgaccaaaattactttgctggcgattggtaatagacaattagtacagaggaggacctccgtaagatgaaacagacacaactcgtggacatcgagagcggtgatacccgcaacataggtaagtgaaatagaagcgtcttttacgccagtatagaccatgtggtttagccctcaaacaaaagccatggtaggttcttatgttcgcgatatactcagttcgggagcgttacgccctcttggacacttgcaaaattnaggtgcagaagtaatgatgtctcacttgatttttgccccctggatactaatcactacaacgagagattggagagaattcacacagcaagagaggggatatacaaacccanncatgtatagggaaaataaaaacaccacgtagtcaccccgggttctagagatataaaccaacgttgattctgataaaaaatcggccaattgcatatatggatgagagcgttagataacctggtacgtcactgcaattatggtcgtcgcatcaatataccactgtgagaataatctataaaaaacgtattttcccgtgacccatataattacagtaaataaaaatccgactcagcgaatataacttactctctgcaatttg

SEQ ID NO: 93462 - protein, 154 aa, Zea mays
  misc_feature: Ceres CLONE 1582781
MALHLHPRLPSHPFRAAAHHHHAISDASCFLTLHGPGRKRLMLLAADTCHAARVKEAAPSVGASPPPPPQALTKEAHNVFYHAAATIWAAPSGQVRHASPCRRSPSAERPPSLRRQGIIPVGAVIKKSWKGCPLRRRRTKSNREPVYISFHCIG

SEQ ID NO: 93463 - DNA, 807 bp, Zea mays
  misc_feature: Ceres CLONE 1582787
  misc_feature: Encodes the peptide sequence at SEQ ID NO. 93464
tggagctccccgcggtggcggccgctctagaactagtggatcccccgggctgcaggaattcgtctcacccctagaaaaaactgccagccaccaccgcgctccatttcctttctctctctctcggctcctccgctctcttgcccgagtcgctagcttccctgccccgcctcctcccgtccccgtggacagacagctccccccacctccgcttccatagcatccgagctaaggtcaactcctccgtcggcggagcgagagcggggaagagacgggagggtcccggatccgagccgagctgcgctccccgcgcgaccgacacccaggtctcgtcgtcccatgcagatctgctcctcctcctgagatctaaaccgaagcttgagctccggttgttggtggttggtcggcggcggcggcggcggcaggggaggctgcgaagatgtcgtcgagcactatccgcaaggccctgggcgcggtgaaggaccagaccagcatcggcctcgccaaggtcaccagcaacatcgcgcccgagctggacgtgctcatcgtcaaggccaccagccacgacgacgagccggccgaggagcgccacatccgcgagatcctccacctcacatccggatcccgcgcccacgtcgctgctgccgtggcaggctgctcccgcaggctctcccgcacccgcgactacgtggtcgcgctcaagtcgctcatgctcgtgcaccgcctcctggccgatggcgacccgtcctttcaccgcgagctcctccacgccacacgccgggggcacccgcctgctcaaactctccgatt

SEQ ID NO: 93464 - protein, 123 aa, Zea mays
  misc_feature: Ceres CLONE 1582787
MSSSTIRKALGAVKDQTSIGLAKVTSNIAPELDVLIVKATSHDDEPAEERHIREILHLTSGSRAHVAAAVAGCSRRLSRTRDYVVALKSLMLVHRLLADGDPSFHRELLHATRRGHPPAQTLR

SEQ ID NO: 93465 - DNA, 813 bp, Zea mays
  misc_feature: Ceres CLONE 1582790
  misc_feature: Encodes the peptide sequence at SEQ ID NO. 93466
  misc_feature (275)..(275): n is a, c, t, g, unknown, or other
  misc_feature (276)..(276): n is a, c, t, g, unknown, or other
  misc_feature (279)..(279): n is a, c, t, g, unknown, or other
  misc_feature (282)..(282): n is a, c, t, g, unknown, or other
  misc_feature (285)..(285): n is a, c, t, g, unknown, or other
  misc_feature (292)..(292): n is a, c, t, g, unknown, or other
  misc_feature (293)..(293): n is a, c, t, g, unknown, or other
  misc_feature (297)..(297): n is a, c, t, g, unknown, or other
  misc_feature (305)..(305): n is a, c, t, g, unknown, or other
  misc_feature (308)..(308): n is a, c, t, g, unknown, or other
  misc_feature (311)..(311): n is a, c, t, g, unknown, or other
cgcggtggcggccgctctagaactagtggatcccccgggctgcaggaattcgtctcacccctagaaaaaccccctcctctcattccattccacccacgccgcctgcctgcccctcgcctcgggggcgaaccacgagaaggggattccggctagggtttcgcggatcgagaagagtcagggaagaagcggggggagagaagagggcggcacctagggtttccgcgggcggctccccccgcatggcctcgccagcggcagcggcgggcggcggtggnnccnccnccngccgccnngggngagggganggnganggacgcggaggaggcaccggtcacgggggacatggtcagcgcgggcttcgcagagctcgagcgccagcagcagctgctggccacctgcacgcgcctctaccagcagctgtccgaccacttcggctcgctcaagcgggggctcgcggggcgctccgacgcgctccgcggtcgccgcagggtcttcgaaccgcgcagccaccgcgcgctcgacttcgctcaccggccgggaggcctccattgaagcctacgactcactcgctctctaccagctccacttcaacaccgccttctgattatgtagcgtacctctcttctttaagggccactgtgtctttcgagttcctaattcgaaggggtcccctaaatatctttgccccgcctgtggcgacggaatggaattccgcccggtgtccatggtaatagagggtggctcgccagaaaggaggcggaaacgattcccggtacagaattactgtgggggcttctaatttcccaactgaac

SEQ ID NO: 93466 - protein, 69 aa, Zea mays
  misc_feature: Ceres CLONE 1582790
MVSAGFAELERQQQLLATCTRLYQQLSDHFGSLKRGLAGRSDALRGRRRVFEPRSHRALDFAHRPGGLH

SEQ ID NO: 93467 - DNA, 818 bp, Zea mays
  misc_feature: Ceres CLONE 1582792
  misc_feature: SWISSPROT Homolog: EC 4.99.1.1 Ferrochelatase
  misc_feature (299)..(299): n is a, c, t, g, unknown, or other
gcggtggcggccgctctagaactagtggatcccccgggctgcaggaattcgtctcacccctagaaaaagttgcggatgatttcctctcgtctcgtctcgtcccatactccagtcccgtccgtcttcacctgcgttccccgggtcccgacaagccgctgtaccagtcccgcccgcctgcgcacttctcccacccccgcgccgccttcggcgccggcgagccctcccgacgctcctcgagcgatccgtccctctcgcggcccttctctcagccgcttccagcccaaggggaggagagggangaggatgtggtcgtcgagccaggcgagcacgaggggcgtcgtggagatggggaagggtggaggccgggccgtcgcatttccctaagagacccgcgcctcagaactccgccagggtcaatctgtcaaggacacacacagttaaacctacctctgctggcaaccgttcaggaatttctgttaaatgcaacttggggtggtcttctcaaccatcgcctgacttgaggcatcactttagaggatactcatcagcatcagaggcagttcttacttcccaatctgatgtgagaaaactgtttgttggcaatgaaaaaatcggtgttctcttgctgaatcttgggggcccagagactcttgacgatgtgcagcctttcttgtttaatctttttgcagatccggaccatatccgtctttctaggctctttcgctttctgcagaagccacttgcaaaattatatcgggtagtgaggagcacaaaaagttagggaaggtatgcctccaataggggggcggtctccccca

SEQ ID NO: 93468 - DNA, 857 bp, Zea mays
  misc_feature: Ceres CLONE 1582794
  misc_feature: Encodes the peptide sequence at SEQ ID NO. 93469
tccccgcggtggcggccgctctagaactagtggatcccccgggctgcaggaattcgtctcacccctagaaaaaaccctccctctcctcgcctcccaaaaaaggcgcggcaccaaaaggcgcgagagagaggcacggggaccgcccgcctcgctcgcctgcgcaccggattcgtcgctgcggcggtggttgcagcggcggcgggcctggcggggagatgtcttcgcgctcggggtccacgggcggagggagcaccggcggcggcagcagcgcggggggaagggccggcgccggtgccgctggccgtgctgctcaggcgggaggtggccagcgagcgcaccgcgtctgagcgcccggagctgcactggggcctctttcagcaggccaagaagggcgaggacttcaccttcctcaagcccgaattgcgagcgcgtccctgaacgtcccgtcctcctcctttctcgcccttcggcctggttggaagggcattagggggaacgggagcccccaatttcccccaaggagaatctcttgaacaacctccttgagtgccggtccccagccgatctggaaaaggggaagaccgggcttggctgcactcccccaaaagcgctgggtttgctgcctttcgttaaaaagccctttaaggaattttcagaattaaaggcagcttcttttcggggaaaaaacggtggcaatttggccaaaaaaaagagggaattgggtccctccctgtttggccatcaggtggggggaaattccccgtggtggtaatcccaacgccggaagggttccaatttacccactcaaccccccggaacctacgcgttccaagtcaagcaaaaagaaaggagggtgt

SEQ ID NO: 93469 - protein, 43 aa, Zea mays
  misc_feature: Ceres CLONE 1582794
MSSRSGSTGGGSTGGGSSAGGRAGAGAAGRAAQAGGGQRAHRV

SEQ ID NO: 93470 - DNA, 813 bp, Zea mays
  misc_feature: Ceres CLONE 1582795
  misc_feature: Translation starting site: 164
  misc_feature: SWISSPROT Homolog: EC 3.6.3.14 H(+)-transporting two-sector ATPase
  misc_feature (413)..(413): n is a, c, t, g, unknown, or other
  misc_feature (471)..(471): n is a, c, t, g, unknown, or other
ctggagctccccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccgggcgccggcgccatcggnccagtgtgccaggtgatcggcgccgtcgtcgacgtgcgctacgatgagggcctcccgnccatcctcacggcgctcgaagtgctcgacaacgacatcccggctcggtgcttgaggtggcgcaacaactttggcgaagacatgggggggacccttcgcttatgaacggcacgaaaggggctctttcgggggccaaggggtccttaaaactgggctcccccaaacacggggccggttgggaggggcttcccttgggaacatttattaaaggttatccggggacccattttttaaaaagggggtaatttaaccaaaaaaccctttcccccccaaaaaaaaggaaaaccccctttttttctttgaaagggcccctttgaaaaaaaaaattttgtttcgggaaaaa

SEQ ID NO: 93471 - DNA, 1189 bp, Zea mays
  misc_feature: Ceres CLONE 1582797
  misc_feature: Encodes the peptide sequence at SEQ ID NO. 93472
  misc_feature (1)..(1): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
ntttttttttgttttttgctcatatttccccccgaaagggggggaggtgtgttttttcttaaaaaacnnnnncatactggagctccccgcggtggcggccgctctagaatagtggatcccccgggctgcaggaattcgtctcacccctagaaaaatagcccgacaggtgaagccgccgccgctgcagtgtccatagccaccgcaagagactgagatggggggttttgtcaagacccacaagagcaatgcatacttcaagcgtttccaggtgaagttcaagacaaggcgcgctggccagacagactacaagggccaggataaggctgattaaccgagacaaaaacagtacaatacacccaaatacagaatgggcgggcgattgaccaacaaggacctcaaagcacaaattcattcggctagtactgcaagggaatatgggtcctgccttctgcttagaccacaggaattggacaacaaaaagttccccgaaagggggctgaaccaaacagggcagaaagccctacggccatcgggacctttttgttaagaaaaccccctggggggtgttaaaaacccctgggtttttaaaaataaagggaacatagcgaggcgcacatggtttgaagggcccccccggggtggggaggactcctctgtccgttgtgggagacccgggcggtcattgggaaatggggtgaggccccttttaacgggtgggcgtctcatccctttgggggaaatgcttggggtctccccctgataaggttgagaggagatgtaaaataaagcctaggggggggaaaggaccgcgcgtgcgtaactgttgggggcggggccccacaacctcagaaggggggacacccattttagaaaataaggagggggggcgcccctgggggaaaaaattgttgccccgcggagtgggcctgtgggataagggaggggcgttttgtcggcgggggttttctctcacgaagagtgggatatctaccccaagccactgctggggggttgtgccggggaaatggatcccccccttcgagggaggggaatacagtctcattatcgtgaggaggcccacggaatttgggcttaagagacataaactgttaaagcaaaagccaacgcgccgctaaagagggaaggaatgcgcgcagaaaaaataagtgcgagggtctgtggtaccttt

SEQ ID NO: 93472 - protein, 38 aa, Zea mays
  misc_feature: Ceres CLONE 1582797
MGGFVKTHKSNAYFKRFQVKFKTRRAGQTDYKGQDKAD

SEQ ID NO: 93473 - DNA, 904 bp, Zea mays
  misc_feature: Ceres CLONE 1582798
  misc_feature: SWISSPROT Homolog: EC 2.4.1.13 Sucrose synthase
ccgctctagaactagtggatcccccgggctgcaggaattcgtctcacccctagaaaaatgtcaccaggttgctccctgatgcaactggcaccacctgtggccagcgcttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcatcggaaactacagtgacggaaaccttgttgcgtgtttgctcgcccacaagatgggtgttactcactgtaccattgcccatgcgcttgagaaaactaactaccctaactccgacctctactggaagaagtttgaggatcactaccacttctcgtgccagtttcaccactgacttgattgcaatgaaccatgccgacttcatcatcaccagtacctttccaagagatcgccgggaacaaggaacacccgtccgccagtacgaggtccaccacatgggcgttcacaatggcctggccctgtaccgcgtttgtcccacggcattgatgtgttccgacccccagtttcaacatcggtgtctccctgggggcgggacctggccattctacttttcccgtaacccgaggtcgcacaagaaggctggaactccccttcaccccggaaaattgaggaagctcctgttcaggccaaacccgaaaacccgggagcgacaagtttttttcttgaacgaaagggaaacaagccaattcatctttttccaggggtcggtttccgacccgggtggaaaaacatttacctgggcctgggggagactttatcgggccggaaaaaagcgggctggcgg

SEQ ID NO: 93474 - DNA, 1178 bp, Zea mays
  misc_feature: Ceres CLONE 1582800
  misc_feature: Encodes the peptide sequence at SEQ ID NO. 93475
  misc_feature (819)..(819): n is a, c, t, g, unknown, or other
  misc_feature (1178)..(1178): n is a, c, t, g, unknown, or other
tatgtgttattatttatagtattttaatcccgcgccttggatttcttattggggggaaattgaacttccactcttcttggagctccccgcggtggcggccgctctagaatagtggatcccccgggctgcaggaattcgtctcacccctagaaaaactctctcctctacctccttttcctctaacctttagctttcctccctccctctcctctctcccccctcctctaacaagaactactcccagccattcagatcctaagttgctgaccttgctgctgcttgttggagatagatttgttggttctaagttcgaagtaccatgagtccaccgagtgtgatggggcagtttggggacacaacctacaccaaggtttttgttgggggactcgcgtgggaaacccagaaggagacgatgaggaagtacttcgagcagtttggggagatcctggaggctgttgtcatcactgacaacaacactggcagatccaagggctacggatttgtttaccttccgggatccggacgcggcgaatgagagcttggcgttgatcccccaccgggtgatttgatggggaggaggggctaacttgtaatacttggcttcccttgggggggttcaaagaatctaaggagctcctaacctcccccagcaatggaaaggaacctaagaaaaccttttagaggtaaatgaaaaatccctttcaggcccagacagggccaggggaaaattcccaaagggtgggggacactccggcggcccaaacacttttttctccttttcttctcaaggggccccacacctattgtcctctctaaagnttaaatgtgggccaaactccccgaaagaagagggggccgttttcccccttttcgcaaggggtacataatagggggggtcacctccctcccacaaaatacccaccccccaagaacctctatgggtgttttcctccgcaacggaaaacccctctctccacgataattgtatcaagttggggcaggggagcgtctacgtataaccgcctgatctttcattaggagggggagagacacaaagccttgggcaaattggtgtgacaaaggagaacacaaattacccctcttttgttttcgcgtaatactccccaaaattggtgggcgcattaaggggaaagaaaactttacatcataccggtgtn

SEQ ID NO: 93475 - protein, 71 aa, Zea mays
  misc_feature: Ceres CLONE 1582800
MSPPSVMGQFGDTTYTKVFVGGLAWETQKETMRKYFEQFGEILEAVVITDNNTGRSKGYGFVYLPGSGRGE

SEQ ID NO: 93476 - DNA, 884 bp, Zea mays
  misc_feature: Ceres CLONE 1582801
  misc_feature: Translation starting site: 363
  misc_feature (416)..(416): n is a, c, t, g, unknown, or other
  misc_feature (422)..(422): n is a, c, t, g, unknown, or other
  misc_feature (487)..(487): n is a, c, t, g, unknown, or other
  misc_feature (498)..(498): n is a, c, t, g, unknown, or other
  misc_feature (510)..(510): n is a, c, t, g, unknown, or other
  misc_feature (513)..(513): n is a, c, t, g, unknown, or other
  misc_feature (518)..(518): n is a, c, t, g, unknown, or other
  misc_feature (555)..(555): n is a, c, t, g, unknown, or other
  misc_feature (736)..(736): n is a, c, t, g, unknown, or other
  misc_feature (779)..(779): n is a, c, t, g, unknown, or other
  misc_feature (786)..(786): n is a, c, t, g, unknown, or other
  misc_feature (816)..(816): n is a, c, t, g, unknown, or other
  misc_feature (844)..(844): n is a, c, t, g, unknown, or other
ctccccgcggtggcggccgctctagaactagtggatcccccgggctgcaggaattcgtctcacccctagaaaaaacctcgcaagctagctagctactactcatgccctcctacgctctgctccctactcctcctctccctttcggctcccgatcccttcccgcgcgcgcacgtcgtccttcccgattcgctccgacgacccaccgccgtgccgtcggctggatatagctgcccggttcgacccagcgcgccattaaaacacctctttcctcatcgaccggccgcgccatgcgcataggacagcacgtacgggtacagtaccacacgtctacgcgaacgaccgaccgggcgcatccatcgtccatgggcaaccgcaagaagctggtccacttcctccgcgtcgacccgggcggcggngggagngggcttcgcccctctccctcccctaggtccctctcctccttctccgaagacgacgggctaagctncctcctccttnctcctcctcctnggncgtgngggtaaagcccggcccaagtcgccggggggcgcgccntccggggggcctgcgggggcgccgggcgccgggcgccctagtacgcctgccgcgacagggcctcattcgcgtcgctccggtcaaggaggaagggcaaaggcctactcccctgggcggggggcccgggggactgtgctgtaaaccggcacggaaatccgggataaacctgccgtgtgtgggncggggacccgcttcgctagcctccgggggttttcgggaccggnagacggncctgtttcaaagcccatgctgggtggcctnccgaagggccggcatcttcagggggcanccaggaagggcaagggtccgggttgtgccgcggccgacgc

SEQ ID NO: 93477 - DNA, 1216 bp, Zea mays
  misc_feature: Ceres CLONE 1582804
  misc_feature: Encodes the peptide sequence at SEQ ID NO. 93478
  misc_feature (11)..(11): n is a, c, t, g, unknown, or other
  misc_feature (37)..(37): n is a, c, t, g, unknown, or other
  misc_feature (1019)..(1019): n is a, c, t, g, unknown, or other
  misc_feature (1071)..(1071): n is a, c, t, g, unknown, or other
  misc_feature (1216)..(1216): n is a, c, t, g, unknown, or other
ttcaccttttncctttttcactgttctccctcatatnaattttttccctttgccatgattgattgggtttcttttttaaaagctggactcaccgcggtggcggccgctctagaactagtggatcccccgggctgcaggtaattcgtctcacccctagaaaaagctacttttgggggacctccacgcccctcttatccagagaacaaaaaggagagagagagagaaagatagagagagagagagagagagagggaggcagagagcttgccatcccaagcaaaggttccctccttccccacctcgcgctcaacccccctcatcctcgcacatccgattgtgccctgtgctctgccgttctcttatccaagatttcgctggcggccgctcatggagcgaacaaagattgtttttttttttcaggctgtggagactaggcctgattcattcaggcccgggcggtggagtggcttcctgaccgggtctgattcgcattggttctaatgagctgggctggcttaattggttgcatcccgcgtccgccggggaaatcggagctagggcctgtggtttgattggccaagctggcgggatttagtccagcttaggactctcggatgagaatcttggaaagggtttccctggaattcaggccacacggcggatcgcaaggtccctggccggtgaagaatcccccctagcctttccgacattcccggcaggggccgtcgaatgattggtgctagtggcgggagagtttcattagtggctttcttgggtaagctatcacttcggttttcggagaaactcccaatctcaattttttcagaagccaccagagaaattatcccgtttcgagagatagagtgcgcgattgtccccctcgaaaaggtgtaaacacccctccgaaggtgcggtaaataggaggcccttgagaggcggaaaattaataccaccccggtggcaaagaaactcgtggccctttatgacttagaactcgtggggtacaaattggtgtaaanacgtgtggagagcctctccgttctcgaaaatatgttttctctatccccactntcggtttatgtttgtaaagtgaaggacgcccttttatgactcccgccccgaagggtattgtctgactgtaaagtggggtgcggggcgatgagtagccgaaaggaccactatttctcttagttttcaccacagccttacgtgtctn

SEQ ID NO: 93478 - protein, 37 aa, Zea mays
  misc_feature: Ceres CLONE 1582804
MERTKIVFFFQAVETRPDSFRPGRWSGFLTGSDSHWF

SEQ ID NO: 93479 - DNA, 1241 bp, Zea mays
  misc_feature: Ceres CLONE 1582807
  misc_feature (1213)..(1213): n is a, c, t, g, unknown, or other
  misc_feature (1216)..(1216): n is a, c, t, g, unknown, or other
tttgtttgtttgttttttttgggttgtcaatccagaacgggggctttattacctataaagaccaacggtaaattaaaggctcgggattatctgtgactccccgcggtggcggccgctctagaactagtggatcccgcgggctgcaggaattcgtctcacccctagaaaaagcgccgtctaggggttcacacccgcgccccgatccactacagctatggagttccacgaatacggagtacctggcacaaggcggtggagccggctccccccccggccaatggttccagctccggcgagaaggaccgcggctcgcgtcgccgcgagggcgacgagagccgcatatcgaagcgctcccgctcgggggaggaccgcgagcggggccagcaccgcggcgttcgggaacaccgggatcgggattaggatgacggaaaggagaaggagaggagccgcgacacccgcgggaaggacagagactgggaagggagagaaccccacaaggagaggggggcacagggcactccggcccacgatataaggcaggtggaaacaggtagcgttaaggagccttgaagcccgttcgggagcgtgcgccccttatccaaggtaaaaaaggaagaatgtttgcagggggaagccttggatgattgggaacccgccacagcaggccatccttgagtcgtacaatccccccctaattacagctggaacccggtgaggacaagctccacagagggctcttacgctgcaaataaagtaaattgtgaacgggggggggcccacatagaaattccccccacggaaaacaacttctgctggaatttcccctcaaggtcaaaatatgagcggggatacccctaagtgaaaaggatgacccccgtggtctaaatattatgtggtcctttttgtgtcctatgggaccactaatttacttatcaatgtaagaaggaggctaaattataccgataaaaaaagcaaaaaaatggagggccgtaacggggaggatcttaacattgtacgtctcaaaggtggagatctcggggtgataaacaggttcacggtacggatacgattttaaagagaccaaaaactcccagcgagatacacgcgatagaaacctccaatacaggccagttttccttttataggagagagctttgtgagggttactgacccacgaaactgtgaaacatctagtataataatcgtttgtacngtntcaatccactggcagtggacaattg

SEQ ID NO: 93480 - DNA, 829 bp, Zea mays
  misc_feature: Ceres CLONE 1582809
  misc_feature: Encodes the peptide sequence at SEQ ID NO. 93481
  misc_feature (761)..(761): n is a, c, t, g, unknown, or other
  misc_feature (804)..(804): n is a, c, t, g, unknown, or other
ctccccgcggtggcggccgctctagaactagtggatcccccgggctgcaggaattcgtctcacccctagaaaaaacagccctagctccaccgataaaaccccacctcctcccgtaacccgcgcctcccttcccttctcctctcttccccgaaagagaggtcgcggacggaacccttccaccctcacctcatcccacaaccttcgattccttcacgatcttacctcgcgcgctcgccgattcctcgatcgagtcccgcgcgattcgctttctggtcggattctctcccccgaagcatgcagccggaccagcctgtgatcagcttgcgccccggcgggcggcggcggcccgcgcgccggccgcctcttctcccccgccttcgccacctccgtctctggagacttcctccgcccgcacggcgggggcgcctccggcatctccaagatcggagattcacattttgagccacgtgagcgtgttcgatacacaagagatcaacttctcgagctgcgtgagattgttgatgtgtctgaggaaattttaagaatcaagcaagagattgatgtagagcttcatggtgaagaccagagctgggttcgcaatgattcaactgttcaaggacaagcacaagctcaaacacaagcacagaatcgctatgctgagactgatagccgtgattggcgtgcacggtctgcacagctgactccgactaatgaagaaaaatcttgggacaacataagggaggctaaagaagcctatgccntctagcggtagggcagcagagcaagctaacaggcaagatcagntaagctccccgtttgctttcgaagt

SEQ ID NO: 93481 - protein, 42 aa, Zea mays
  misc_feature: Ceres CLONE 1582809
MVKTRAGFAMIQLFKDKHKLKHKHRIAMLRLIAVIGVHGLHS

SEQ ID NO: 93482 - DNA, 815 bp, Zea mays
  misc_feature: Ceres CLONE 1582810
  misc_feature: Translation starting site: 229
gcggtggcggccgctctagaactagtggatcccccgggctgcaggaattcgtctcacccctagaaaaagtcgcattccgcaacacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatggctatgattgatgagcctctttatccaattgctgtactgattgacgagctcaagaatgaagacatccagttgcgtctaaactccattagaagactttcaacaattgcacgggctcttggagaagaaagaaccaggaaggagctgattccttttcttagtgaaaacaacgatgatgaagacgaggtgcttcttgcaatggctgaggaattgggtgtgttcattccgtatggttggtggtgtagaacatgctcatgttttgctcccacctttggagacattgtgtacagtggaggaaacttgtgtccgtgataaagcagttgaatctctgtgcccgtattggtgcacaaaatgaaggaaactgacattgtcgactggttcattccagtagtaaagaggctagccagctggagagtggtttacagctcgcggtatcgtccctggggtctttttcaacttagcctaattccaagtggcgtcggaaccaattgaaaaacagaatttgagggactatcctatgggtcagcctattgtcagggatggacattggcttatgggtcagaaagaacaagccggcatctaaattc

SEQ ID NO: 93483 - DNA, 838 bp, Zea mays
  misc_feature: Ceres CLONE 1582814
  misc_feature: Encodes the peptide sequence at SEQ ID NO. 93484
  misc_feature (457)..(457): n is a, c, t, g, unknown, or other
  misc_feature (470)..(470): n is a, c, t, g, unknown, or other
  misc_feature (486)..(486): n is a, c, t, g, unknown, or other
  misc_feature (773)..(773): n is a, c, t, g, unknown, or other
ctccccgcggtggcggccgctctagaactagtggatcccccgggctgcaggaattcgtctcacccctagaaaaattgagtatctacctcgtggcagtccatctgaagcatgccttatgaggatatttgtggcaacggttgaagctatacttaggagaacttttccttctgaaacatcagagcaatccagaaagccaagaagtcaatctaagaaccttgttgttgctgaacttcacacaatgatacattcactctttgttgaatcctgtgcctcaatggaccttgcctcccggttgctatttgtggtgttaactgtttgtgtcagtcatcaagctttgccagggggtagcaaaagaccaactggtagtgataaccattcccacgaggaagccactgagcattcaagattaacaaatggaagaagcagatgtaagaagagacaaggccctgttgctacngttgattcatatngtctagctgcagtttngtgcctatcttgtgagctccagctgttcccttttcatactaagaaatggatcacattcaaatttaaagggattcctgaagaattatctatcttgaaaaaaacatgggatgaataatgagctaacaacaggtttagttcagaattcttcaaactcccaaaattcttggcttctgggaaccctttttcccccgaagcccttctcaggtgggacccccgggaggcttagctcaaaggaaaaaatttgcgcccccaagggtgcccgccccggtttctcaaaattatttccnggggcccgggccaggccttaagaccaccccccgcgccaaaaaaaaaaacacaggggggggcttta

SEQ ID NO: 93484 - protein, 161 aa, Zea mays
  misc_feature: Ceres CLONE 1582814
  misc_feature (119)..(119): Xaa is any aa, unknown, or other
  misc_feature (124)..(124): Xaa is any aa, unknown, or other
MRIFVATVEAILRRTFPSETSEQSRKPRSQSKNLVVAELHTMIHSLFVESCASMDLASRLLFVVLTVCVSHQALPGGSKRPTGSDNHSHEEATEHSRLTNGRSRCKKRQGPVATVDSYXLAAVXCLSCELQLFPFHTKKWITFKFKGIPEELSILKKTWDE

SEQ ID NO: 93485 - DNA, 1095 bp, Zea mays
  misc_feature: Ceres CLONE 1582817
  misc_feature: Encodes the peptide sequence at SEQ ID NO. 93486
  misc_feature (1)..(1): n is a, c, t, g, unknown, or other
  misc_feature (9)..(9): n is a, c, t, g, unknown, or other
  misc_feature (14)..(14): n is a, c, t, g, unknown, or other
  misc_feature (18)..(18): n is a, c, t, g, unknown, or other
  misc_feature (19)..(19): n is a, c, t, g, unknown, or other
  misc_feature (62)..(62): n is a, c, t, g, unknown, or other
  misc_feature (63)..(63): n is a, c, t, g, unknown, or other
  misc_feature (75)..(75): n is a, c, t, g, unknown, or other
ntttaaaanttaanatannaaaaacatacatctataatcaccacttcctctgcgcgggtttnnttgttacaaccncaaaagatgaactccccgcggtggcggccgctctagaactagtggatcccccgggctgcaggaattcgtctcacccctagaaaaactctccccatcgctccgccactcccatggcgtccctcttcggggctggccgccggcgatcaccggaggacgacggcgaggacgatagatccggcagagggaggaccaagcgcttccgcctctccccggaggaggacgcagcgtcgccggcggaggcggggcccggcgcggcgacggagaccggctggctctccggcttcgtctacggagcgaagagggtcatttcttccgttttactgttctcctcgcccgaggagaccggctcgggggaggacgaggaagaggagaaggacgacgacgacgacgaagagggcatccacttgaatgaacatgaagctactcatgacactcatggagcaatagttcctttatagcgagccaaagcttactatttgagcaaatgggttatgaaaggaaacatttctcaaggggatgaattgtgaataggatgggtaagagcctaaataaaaatccaagaagttagaaggatttcctaacttttttccctggaaaggccccaatggaatttatttgtaaaaggcccccgaaaagaaaaaatccccccttaagttaaggagaaaatggccaaggggcaattttaaccacccaattgaaaacctttcccaaccaaggaaaaaccacttggggccgcccttccccttttgtgaagcccccgggggaaatcccgggaaaattgttccccccctgtgaaaaaccaaggttttccccacccctccttccttagggtaatggtaagaaaaccaaaggaaccctcgtggggtagaatttttttttcctttcaaagggttttttttcccaattttcacaaagaaaaatttccaccgtggaaaccttaatttcccacctggcccagccaagtttttagcgggaagagccccaaaaaaaattgggttttgggaaaaaaaaaaaaaaagt

SEQ ID NO: 93486 - protein, 115 aa, Zea mays
  misc_feature: Ceres CLONE 1582817
MASLFGAGRRRSPEDDGEDDRSGRGRTKRFRLSPEEDAASPAEAGPGAATETGWLSGFVYGAKRVISSVLLFSSPEETGSGEDEEEEKDDDDDEEGIHLNEHEATHDTHGAIVPL

SEQ ID NO: 93487 - DNA, 829 bp, Zea mays
  misc_feature: Ceres CLONE 1582818
  misc_feature: Encodes the peptide sequence at SEQ ID NO. 93488
  misc_feature (629)..(629): n is a, c, t, g, unknown, or other
ccgctctagaactagtggatcccccgggctgcaggaattcgtctcacccctagaaaaaaagcgttccagatcgtactggaccaatctgccaccacactttgatcacacacagacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcagatcgactacagctcaagcgtctcggtgttcccgatggaggcctgcgacctgcttggtggcgacgcgtgcaacgggcccatgttcccggaagccaagcccgcctcggcggcggcggcggcgagcaggagtgtggtcggggtggacagggactacctgtcctacgacgagccaaagaccgtgttcccgggcgaggcgtgcgacgacctcggcggcgagttctgcgaggcgccgtaccagggacgcgtctccagggagctggcgcacgcctgaagacctgatccatccatgtctgtccaccacctaagttacctatgtgttaaccaaagggtttaacatccaaaaaccncaaccaataaaaaattaaaccccgcctcccctttcggtcatcccgtaaggtcttggacctcccaagccccaaaacgccaaaacctcaaccctccaagctctaatttcccggccaaagctgtgttccgggttaggaaccctaaggaaactccccttttcctcacacgcttccccccggggtggggttgctgtgcccccccc

SEQ ID NO: 93488 - protein, 138 aa, Zea mays
  misc_feature: Ceres CLONE 1582818
  misc_feature (1)..(126): Pfam Name: Lir1 Pfam Description: Light regulated protein Lir1
MQAAATAAGFSAVLPAKGRPAARSRVVARVPATRRSVRAAAVVATEAAQIDYSSSVSVFPMEACDLLGGDACNGPMFPEAKPASAAAAASRSVVGVDRDYLSYDEPKTVFPGEACDDLGGEFCEAPYQGRVSRELAHA

SEQ ID NO: 93489 - DNA, 1305 bp, Zea mays
  misc_feature: Ceres CLONE 1582821
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (837)..(837): n is a, c, t, g, unknown, or other
  misc_feature (1049)..(1049): n is a, c, t, g, unknown, or other
ttaaaatttnnttttntttgttcctcgttcatttccctccctctcctctttcttgtctgtatcatattccctcctctggggctcacctcggtggcggccgctctagaacagtggatcccccgggctgctggaattcgtctcacccctagaaaaaaaaaaaaaaaaaggcgacggcaaggaatcccccgattaggaaagattctccgctccccgccttcaaatcccccaccggccaccacgacccgcctggattcgcctacgctctgtgctgccgaggtcgggattggtgctggaattcggtgcaccgagttgttccttgctcgattagacttccggttcggttcgcttcgttccaatcggggtttgctgttttgggcgccactggtgcgctccgagctgctcaagctgggcgctggataccctctcgggcttgcccgatctgattgagtccccaacaccaccccccgctccgccgctgcgggttgcctttccccctccccgcttaatttcccgcgaccaatttcgaccccgcgccggcccggaattctttggaaaggtttcagaatataattccgggtgacataataaaccccacagggctttatttttaatccttcacccccggggacccccccggcggcccggggttgggattcccactgggccctcgggagatagaaaaagtgtaacttcctcgtccgacagtgtttcagtacccctccactaatgggagaagatatttctcccaagagggtaatagacgtttccgcctttctgcgggggaagagaggtctcctcttttgtatgacccacccatcactgcggagtgggaggggngcactgcgtgggggccggtttctactgaatgccgctataatacttacaatagcgcaatgagagaggacaattgtctaaaagaaaggaccaccaatcctctgtgtcactctacgaaagtctgagcgctttcaatgatgaggtccgcggactgttccagtgactctaaaaaatatactactctctcttctcgctatttctcaacaatgttcctntctattagactgtaatctgataatgcaagggggtactcgggcgtacatgtttatttctcctactaataatatagggagagagtacagtgttttcgtgacataccgtgagattgataaaacagcctttaacattcataacaaatggcggtctaccacgtgcgggaaataaatacgggtatataaacatggtgaggaccatctcgcggttgccgcgtttttacaagtcgcaggagtagaaaataattcgagagtgtag

SEQ ID NO: 93490 - DNA, 791 bp, Zea mays
  misc_feature: Ceres CLONE 1582822
  misc_feature: Translation starting site: 116
ctcaccgcggtggcggccgctctagaactagtggatcccccgggctgcaggaattcgtctcacccctagaaaaaggggcggcgaaaaccctcgaaccctaatccttacgcccctcatggcggacgctgatgcggcgctgccaacgccgcctccgagagtagtaacctccgaggagcatcccgtgggaaccgaatccaccttatccacgccggccgaattcaataaacaggagaagatgggtgaggtctctgcatacccggaggtgactaggccgatcatccaggtcatgcaccacatgtgtcatcggaacctactcggcctctggtttgggtagctttctgtcgacgagtgctccaagggatacgaacccggttgtttttgctgtgttcaccccatctgtgatgttcgcctgcctcacgaagacggtcacccattggtcacaccttttcttggtggtctatggcaggtaacatacgcgatcacgttcatgatcggtggctatctgggctggatagcttgcgacatcttgaagcctccgcatcactttacgggcttgatcatggtcttctgcgtcaacacgtgacctcgaaaacctggtcctgatcattggcccggctgttttcgactaagacggcaacacgtttggggatgattcaagcacttgccgctcaggcgttctctcctactcgtccttgtacatggctctggggaggactcttcatatggacgcacacgtacagcctgatggagaagttccgcaaggtggtaccacaagatgtgagtcctaaagc

SEQ ID NO: 93491 - DNA, 869 bp, Zea mays
  misc_feature: Ceres CLONE 1582827
  misc_feature: Encodes the peptide sequence at SEQ ID NO. 93492
  misc_feature (412)..(412): n is a, c, t, g, unknown, or other
  misc_feature (414)..(414): n is a, c, t, g, unknown, or other
ctccccgcggtggcggccgctctagaactagtggatcccccgggctgcaggaattcgtctcacccctagaaaaacagccaaacccaaaccaagaacctgatcaatcaacttcagtcccgtccgtaggagggttttgaaaagccaacgtacacctctgagagagttcaaccggagcctgaatggcaacgcccaagctgtccccggtctcgccggtgcggcaggacggcaacgacaagccgtgcgcgccatcctccccctcctcctccccgtcgaccgttctgagtgcgcaggacgcgtacgagcagcacctgcgcctgccggagctgtcgagcctgtggacggccggatgcttcccggagtgggcgggcgagggccctgtcaagccggcgctgcaggcgctggaagtcacttncngcctcgcgtccctgggcgctctcgacccgcgcgggcacgccggccgccgcgagctcgggcgccggctggagtccctccccgcccgggaagtggaccttgtgttcgcccttttccaagggcacggccggggcccccccctccccaaactaaaacccctccgggggggttgctccccggggacccaacccgtcccaaagggggggggggggaccttccccgggaaaccccccccccgttgtgtggccggggccaagaaggacactttttccccccccccctccccgtggggaaaaaaataaaagggccctccccccaaaatatatattcccccctgaggagcaaaaaagggggggcgccctctacaccggcggccggggggaaaaccacacctccgcaggaacacctggtttaataaaaaaaccaccgtgtgccccccacacaaagtttctttctaa

SEQ ID NO: 93492 - protein, 177 aa, Zea mays
  misc_feature: Ceres CLONE 1582827
  misc_feature (1)..(143): Pfam Name: Hs1pro-1_N Pfam Description: Hs1pro-1 N-terminus
  misc_feature (78)..(78): Xaa is any aa, unknown, or other
  misc_feature (79)..(79): Xaa is any aa, unknown, or other
MATPKLSPVSPVRQDGNDKPCAPSSPSSSPSTVLSAQDAYEQHLRLPELSSLWTAGCFPEWAGEGPVKPALQALEVTXXLASLGALDPRGHAGRRELGRRLESLPAREVDLVFALFQGHGRGPPLPKLKPLRGGCSPGTQPVPKGGGGTFPGKPPPRCVAGAKKDTFSPPPSPWGKK

SEQ ID NO: 93493 - DNA, 826 bp, Zea mays
  misc_feature: Ceres CLONE 1582828
  misc_feature (826)..(826): n is a, c, t, g, unknown, or other
gcggtggcggccgctctagaactagtggatcccccgggctgcaggaattcgtctcacccctagaaaaaagcaggcaccagtgcatcgccaccgtaccggagggggcagcgcccaaaaaaggaagacgggagggtgggcgagcctgctcttcctgtctgggagagagacccaagaagaggagagagaggcgcagcgcagcgcagcgcaggcgcgcatgtcccccctccccttgccggctggcccctgttgcagttctgctccggtcggatctgcccccccgctctgctgactgctcatgccgctgctgctgtcgcaggagctccaccaacccgccaatgcgcgcgtatcggcgtaggtaccatcatcatgcatccccgagacgacgcatcaccgcacccgtggagtctgcagcatctccttccccagtcgctgctggatctgctgcggccacccctgcgccgatacacctccgctgcttcctgcctcaattatattcgcccgacgtcgacgcggccgaccccgcctcagaaggccttcgagaagcgctcgaccccttcactgcggcccgctccagtgtcgtcctcctcccgggacggccgactcccaaggccgtcgtctaggccctcccccggcaaccacgccgcggtcgcggttccagaaaagagaaaccagccctcggtgcccgggcctcttggcccccgaaaacaagggtagaggcgattattgcgggaatttaggaggaacctgcctctccaagggctcaaaccccaaggggccggaagaagttttggtcccgggccgttccgctgggccttccccccgggcn

SEQ ID NO: 93494 - DNA, 1307 bp, Zea mays
  misc_feature: Ceres CLONE 1582830
  misc_feature: Encodes the peptide sequence at SEQ ID NO. 93495
ttggggttggttgggtgggaggtaggtccctctaccccccaaaacccgcagcttcaaccagaaaagaaaccaaactggaactccccgcggtggcggccgctctacactagtggatcccccgggctgcaggaattggtctcacccctagaaaagttccgcttcgtcccagccgctagttcttcctttcctccgaagtgatggccaaatgctactcaggattggcccccgactccgcctttccatccctcgcgaaggacgccggcgcaatcccactcctccccgatcacgatcgggcgtcaactcgcgtccttcctgctccactgctccagatcctgcgctcccctcctcgcggccaagaacctgcacgatgatttcgaggccgtacgggccacgccagcgcagcttctgccgggacgccgacccggagctggggattttgcacgagttcttcggaagcctggggcggtgaaccctccacacctaggagcttgttctccaggggctacacgaagggctcctgcttgtctctaccctggttccgccgttgaagtacgatcacttggccaaccccgaaaaaatctttgctggttttaagatttgggaagaaaccacttggtgggacaccaccagcgacgacctccctgtgttcgcggtccagcttcaacaggagccccaacgaattagtcctcttccctgggcaagaaaaacagccgacactttctacatccactatgatgtaagaatataatgaattttattcgtgaatacttttaggccttactatggataacagggtttattgtaggccagcaacacgccactctacaattccttattgctggcgccgttgtgcgctccggtcgctatctctctcccaaactgagcgctcactataaacgagtgcgtgtcaaatctcgcgcccatcctctatagcagtgctagagagggctcgcggtgatgctaagaaatacatatgtcacagtttttgatataagtgtggaatatgtaaaatcctcaaaactagacgtctgaacactttttttcgcatcagagaagaatcgatacatgggtgtgtgcgcttagttagcgaacacacagtgcaatctcgcgcacacgagcgtgggtgcgaggcgagcgaaatgtgtccggcgcatagataagaatcaccacgaagagtgtcaacgataccggatgcgcctattataaaaatactatattaatttattgttgtagcgacacatctgcgcgctgtgcatcttccgctatttctctgatcgcgatgcactgtgtgtggaatagcgcagaaa

SEQ ID NO: 93495 - protein, 33 aa, Zea mays
  misc_feature: Ceres CLONE 1582830
MISRPYGPRQRSFCRDADPELGILHEFFGSLGR

SEQ ID NO: 93496 - DNA, 851 bp, Zea mays
  misc_feature: Ceres CLONE 1582832
  misc_feature (41)..(41): n is a, c, t, g, unknown, or other
  misc_feature (651)..(651): n is a, c, t, g, unknown, or other
  misc_feature (652)..(652): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
tccccgcggtggcggccgctctagaactagtggatcccccngggctgcaggaattcgtctcacccctagaaaaactccgccattagcgtgcagatctaacgatcgctccgatcccaagcacaacaacttctccaattccaatcaccagccgatcagatttatgcagtcttactgccgcgagcgccagtcatgccgcgcggcagcagcttggaccagagcttgagcgacgacgaaggctcggcaggtgttggggcggggttgggtcggcgtcgctgggcatgtccgggaatgtcgaactccctgggggtgtgcccccgggcccggaacttaaggtccaccaatttccccctcaaggggctcaagcccgtctttgccgtggggaaagcggggcccgaaagcccttttggggggccaggggggggggttttttttaagggggaagggaacaaggggggttttattttcccggttcaaaaaaacccccccccccccccccccgaggggggggttaaccccccctggaaaaaaacttgttccccccgggggaaaacccacaaagggggggggggaaaaatccctctccctaaagaaccccccccctttgttttttttggggggaaccccccccaaagggaaaagattttttttttnnaaaaaaaaaggggggggcctctttttgttgnnnnaaaaaaaaaccccctttgtgggagaaaaaccccccgggggggggaaaaaaaaaaaaaattttctttaaaaaaaaacggcgggggaaataaaaaaaaacggtttgcctacaacccgtgtgaggaggagggtgttttcaaaaaggggggcggtcgcgcgcgcccccc

SEQ ID NO: 93497 - DNA, 806 bp, Zea mays
  misc_feature: Ceres CLONE 1582834
  misc_feature: Encodes the peptide sequence at SEQ ID NO. 93498
ggagctccccgcggtggcggccgctctagaactagtggatcccccgggctgcaggaattcgtctcacccctagaaaaaaagagcaaatcacaacccgcactcgcccaaaaccctactgctcccgctccgctcctgcttggtcgagatcacttcgccgccgccgctttcgagatctccgggtggagcaagcgagcaaaggcagcagccatgtcgctccgcgtgctgaaccctaacgccgaggtgctcaacaagtcggcagcgctgcacatgaacatcaacgccgccaagggcctccaggacgtgctcaagaccaacctcggccccaagggcaccatcaagatgcttgtgggtggagctggtgacctgaagctgacgaaggatgggaacaccctcttgaaggaaatgcaaattcagaacccaactgcaatcatgattgcgaggacggctgtggcacaggatgacacaagtggtgatggcacaacctccactgtgctatttatcggggagctaatgaagcagtctgagcggtgcatcgatgaaggaactcatccaagattcttggttgatggttttgatgttgctaagagagcgtgtcttgattttctcgataagttcaagacgccagtcgttactggtgaagaacctgacagagataccttaaaaatggtagcaagaacaacacttaggacaaagttgtatgaagggttggctgatcagttgactgatattgttgtgaatgcagttctgtgcattcgcaaaccagatgaaccaattgatctatttatgggtggaaataatgcacatgt

SEQ ID NO: 93498 - protein, 199 aa, Zea mays
  misc_feature: Ceres CLONE 1582834
MSLRVLNPNAEVLNKSAALHMNINAAKGLQDVLKTNLGPKGTIKMLVGGAGDLKLTKDGNTLLKEMQIQNPTAIMIARTAVAQDDTSGDGTTSTVLFIGELMKQSERCIDEGTHPRFLVDGFDVAKRACLDFLDKFKTPVVTGEEPDRDTLKMVARTTLRTKLYEGLADQLTDIVVNAVLCIRKPDEPIDLFMGGNNAH

SEQ ID NO: 93499 - DNA, 1114 bp, Zea mays
  misc_feature: Ceres CLONE 1582835
  misc_feature: Encodes the peptide sequence at SEQ ID NO. 93500
  misc_feature (42)..(42): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ggggtgattgtgtttggttaaaaaaaaatttagggtttgtanttnanncnnnaaaaaaaaatgtaagaataaaaagtttcaaactggagctcccctcggtggcggccgctctagaactagtggatcccccgggctgcaggaattcgtctcacccctagaaaaaacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacaaacctggtctcgatgatgttgtgaaagcagtgcagggggcagggaaaccctcttcttcagcaacttgatgttgaagaaacaccgtcgcttgaggcctgaacattaatcctttgttctgcgggtgaaaacaccctcccacccaaaaaaccccgggtggggcctttgggaagccttggacaaaggggcttgccccgaaacccctcaccccctaacttgggggataaaaagacggcctggccccccggtccaattggaatttcggcccggaaaaatggtttcctccccacaagagtttccttggaaaacaaaagaaatttgggtttgggatttggaaaaacaaaagactcccaaccttggtcccccccttaggatcaaaaaaaaacccggcctttgaagaggccttaattttgaaaaaaaaaaaaatactttggagacccccctccaaccaagcgcaaagggggccatttcaaaacttaaccccagaaatcccctttgtccccaaaaccccgagaaaatgttcctctggccgggagaggggaaacatggcccaattgaaaggaaacactggttcaaaagcccttgaaacaaaaataacctttaatctcggtggtcccgggaaaaaaccccctagagg

SEQ ID NO: 93500 - protein, 72 aa, Zea mays
  misc_feature: Ceres CLONE 1582835
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYKPGLDDVVKAVQGAGKPSSSAT

SEQ ID NO: 93501 - DNA, 1282 bp, Zea mays
  misc_feature: Ceres CLONE 1582836
  misc_feature (16)..(16): n is a, c, t, g, unknown, or other
  misc_feature (830)..(830): n is a, c, t, g, unknown, or other
tttttttatgtaggtnatatacgttattcccccgctatgcctttctttaacctctttcttatctctttttctacaaaaactggaactcaccgcggtggcggccgctctagaactagtggatcccccgggctgcatgaattcgtctcacccctagaaaaagttgcggatgatttcctctcgtctcgtctcgtcccatactccagtcccgtctgtcttcacctgcgttcccggggtcccgactagcctctgtacccgtcaccacccgcctgcgcacttctccccctcccgcgcctccttcggcgctggccagtcctccctaccctcctcgagcgatctatccctctcgcgggccttctctcagcttcttccagcccaaggggaggagaaggagacgatgttgtcctcctttcgctgtagatcccccagccttccgtccatgtgggctttgtctgaaggaaccttcgttaatatccttttttttttccccccccttttaaatgagtggtcggtcccgccccgttattgaccccctgtcccctcatcctctctttttatgccataaacttgttccgttaaagtttcttttgcccgccccttaacttcctttcttcttcatcttatatattcaaacccctgtagggcttttgtgggctcgcaacctcctcgcctctccacactccttattctcattttccctctaactctcccgcgtggttttgattgtattacctccatattttttatttctcctcgcctccacgctggtctttctatctcaaccctgtcatcttgttacccgccaatcttatattatccacagtacggctctnctcagctcatttttttagataatatctacaacctgggacccgcgccacacaaaaaaccgtcctgctacacccgccttgtggcgcgcctcctatctcagagtcccccgcaatattctgattttttcatccacatcatataatcaccaactaaatctgactataaccgcaggcttgatcatcaaatgttagcaaactaccgaatactttcccagaggtattcttctttgtatcaccccgtacgccctcttccagctgtcaaggcggctagacttgatcaagacgtcagagcgatcgcccggccactccctataccactatttccacgaaacgtttaatcaatatatgtgctcctaccgcatttttacgtcgttcttttttaaattcccatttctattctgttgttaatcctcgcgattcaggtaatgtgcacctgccgctatctcccacccaat

SEQ ID NO: 93502 - DNA, 1080 bp, Zea mays
  misc_feature: Ceres CLONE 1582838
  misc_feature (1000)..(1000): n is a, c, t, g, unknown, or other
tgttgggttgtttgttgttgtgcgttccttctttttcttcccctattctcccaggcgtgttgggctactagtttttaaactgggactccccgcggtggcggccgctctagaactagtggatcccccgggctgcaggaattcgtctcacccctagaaaaaagagccatcctctgggcaagaactggcgttccgaagagaagcggggggaggcgaacgcaactcgttcgactctccaagtcgtccgttacctgatacgctgcccgttccgggtgcctccgccccgtttcgatgaccacctctccggcgccgccgtcctgagccgtcgcacgcgccacaggggtacctcccaagcgcgctccctacgcctggtccgccccgacccgacgccatgggctccagagtccttcacttagacgttcctgcaaattctgagggctatctcatgagaaatgtacctgggagagtaagtaatcctcccataaatggtgaaaagggtctctttcgagttcagaatggggggagtcactgcacttgtcatgtcctggtgagggagagaaatcgtgaaacagagtccctctactaaggtgcccttctggcgcttaatggaacaatgtactttgggaacgatgggaggaagtccctcgcaaatgaaattggtactagctgtctggcaacaaatacaccctccaggggttcgccgtgaaggatttcccggatattccaggggcttgcttccttttattcagggaggtgagatgggaggcgtaacgtgttacttacactacacatatgacaagtcacttggaatctattgcagggccaagcgaaacacttgtgggataaaaaatcgcataccctaactggggttcctccagcggcgttgacgaaagacaaagatgcgcggaaggcccccttaacccaaaagatagattgggtattcacacgaagtccccttgggctgtttactaaccgcctctgcactcttggtacgcgcgggacnttggtatccgtaactcttaactactggtgggaaatgtggcgagcggagcaacccggaggagtggaggttctcccccacac

SEQ ID NO: 93503 - DNA, 871 bp, Zea mays
  misc_feature: Ceres CLONE 1582839
  misc_feature: Encodes the peptide sequence at SEQ ID NO. 93504
ggagctccccgcggtggcggccgctctagaactagtggatcccccgggctgcaggaattcgtctcacccctagaaaaaactttcttgtaacccaagacgaactcggtgaactctttctcctcgcgcagcaccggagcacaatcaaggattccagtccagtcctgccaatggagtgcgttttgggcttggttggccgcgacttcgcggtggtggcggccgacacctccgccgtgcagagtatcctcgtccacaagactgacgaggacaaagtaatggtcctcgactcgcacaagctgttgggcgcttcaggggagcctggtgaccgggtgcagtttacggagttcatacagaagaacctccacctgtaccagttccgcaacaccatcccgctgtcaaccgccgctgccgccaacttcacacgcggcgagctcgccacagcccttcgtaagaatccatacatggtcaatgttattctcggtggttacgataaggatgttggcgcctcactgtactacatcgactacattgcgaccttgcacaagatcgacaagggcgctttttgggtacggatcgtaattctgcctgtctctgatggacaagctgtaccgcccggacatgacccgttgaggaagcgtaagacttcgttgattagtgcatttaaggagaatcgggctgcgcgctgggttttggcccccccaaaactttcgggaacaaaaaatcctccaaaaaaagaaacgggggccccggggagaatcccccgagggggggtaaaccctctggggaaaaaaggacccctcctttaaaaaaacccccccacaccgtgttgccccccccaaagagaaaaaaaaaaatattttttttgttgttttta

SEQ ID NO: 93504 - protein, 211 aa, Zea mays
  misc_feature: Ceres CLONE 1582839
  misc_feature (1)..(174): Pfam Name: Proteasome Pfam Description: Proteasome A-type and B-type
  misc_feature: SWISSPROT Homolog: EC 3.4.25.1 Proteasome endopeptidase complex
MECVLGLVGRDFAVVAADTSAVQSILVHKTDEDKVMVLDSHKLLGASGEPGDRVQFTEFIQKNLHLYQFRNTIPLSTAAAANFTRGELATALRKNPYMVNVILGGYDKDVGASLYYIDYIATLHKIDKGAFWVRIVILPVSDGQAVPPGHDPLRKRKTSLISAFKENRAARWVLAPPKLSGTKNPPKKETGAPGRIPRGGVNPLGKKGPLL

SEQ ID NO: 93505 - DNA, 783 bp, Zea mays
  misc_feature: Ceres CLONE 1582842
  misc_feature: Encodes the peptide sequence at SEQ ID NO. 93506
tccccgcggtggcggccgctctagaactagtggatcccccgggctgcaggaattcgtctcacccctagaaaaaaatactagctggaccctttccactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaggacagcctggcgttccagtcgcgtctgctggccaagtccggcatcggcgacgagtcgtacatgccgcgctgcgtggtcaagcccaacgccagctgcggccacatgat

SEQ ID NO: 93506 - protein, 191 aa, Zea mays
  misc_feature: Ceres CLONE 1582842
  misc_feature (115)..(191): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVVKPNASCGHM

SEQ ID NO: 93507 - DNA, 866 bp, Zea mays
  misc_feature: Ceres CLONE 1582843
  misc_feature: Translation starting site: 145
  misc_feature: SWISSPROT Homolog: EC 1.1.1.44 Phosphogluconate dehydrogenase (decarboxylating)
  misc_feature (849)..(849): n is a, c, t, g, unknown, or other
  misc_feature (866)..(866): n is a, c, t, g, unknown, or other
ctccccgcggtggcggccgctctagaactagtggatcccccgggctgcaggaattcgtctcacccctagaaaaaactccctctccaccgcgctgcaggggcgacgcaaggccgagcgctcctcgatccagatccaaggtaggagatggctctcacgagaattggcctcgccggcctcgcggtcatgggacagaaccttgccctcaacatcgcggagaaagggttccccatctcggtctacaacaggacaacctccaaggttgatgagaccgtgcagcgtgccaaggtcgaaggaaacctcccagtgtttggtttccacgaccccgcgtccttcgtgagctccatccagaagccccgtgtcgtcatcatgctcgtcaaggctggggcgccggtggaccagaccattgccacgctcgcggcgcaccttgatcagggggactgtatcgtcgatggtggcaacgaagtggtacgagaacacggacaggagggagaaggcgatggaggagcgcgtgctcctatatcttggcatgggcgtctcccggaggagacgagggtgcccgcaatggcccgtacttgatgcccgaggctccttcaaagggatacaataccttgaaaatattcttctcaaggtgggctgctcaggtacctgaacaccggccccgggcgtcccatattttgggcaaagggggaaataaggcaactttcgtcaagaagggttcccaatggaaattgaaaaaagggtgacctgtcaaactttatcccccgaaggctttagtaaaggttcccccaagttccgggtggggtaaaccctcccaaacacggcgaagccttgcattcaggggggtttctntcctaaagggggaaaan

SEQ ID NO: 93508 - DNA, 1199 bp, Zea mays
  misc_feature: Ceres CLONE 1582844
  misc_feature: Encodes the peptide sequence at SEQ ID NO. 93509
  misc_feature (79)..(79): n is a, c, t, g, unknown, or other
  misc_feature (1199)..(1199): n is a, c, t, g, unknown, or other
attcgccaagaacgatgtctgtttgttttcactacctccttttttataaagacccctctctgagactataaaaaaaaanaactcaccgcggtggcggccgctctagaactagtggatcccccgggctgcaggaattcgtctcacccctagaaaaaccgcaccacgtctcctacactcctccgcctgccgtcctgtcctgcgcccttactcctcggacgccccccacgccaccaatccccaaccccccattccgcactcccctctccctgccccgccgcgcttccttcgctgctaaagcggctgcgatggcgctctgggcgctgccggtcggcttccgcttccaccccaccgacgaggagctcgtcagccactacctcaagggcaagatcaccggccagatcaactccgaggccgaggtcatccccgagatcgacatctgcaagtgcgagccgtgggacctcccaggtaaagtctccgaacccgtccgacgatcctgagggggtccttcttggcgcccaaggaccgcaaagtaccccaacggttagcagggtcaaaaaagggccacccgtggcccggggtactgggaaaggctactgggctttgggacaggggaacattcaaagtcccaagggggcgacaaagaagcaaaacaagttttacctttcggggcaaaaaaaaaaaagacccctttggtcttttccaaccggtgtaaacaccgcccccccccaaaaggggcggagaccgccaccaagagggggggaaattaaaggggaacaggaaagttaactccggcacaccgcacccgggaggccccttccaaatttctctcaaagtttctctgggaacaagactcaaggggttcccgcggaagagccttatattggttttcaaaatgggtgtgcccgcgcttaatattggcttatattccaaagcatttttttgcctacgtggtattgtctctaaagggggttttcttctacacgccgaaattggtcctggaaaatttgagcacacctttgagtatagagggacacttagaagttccttgttctcttttgtgggagaatttgtagagaggagacctggttccgtggtgttccctcggtaacgaataagatggggccttaaaaaaacacacagagttttgtgatattcccgggggggtgggtaacaaagaatactgtttcctctattctccn

SEQ ID NO: 93509 - protein, 63 aa, Zea mays
  misc_feature: Ceres CLONE 1582844
  misc_feature (6)..(62): Pfam Name: NAM Pfam Description: No apical meristem (NAM) protein
  misc_feature: The sequence is a functional homolog of SEQ ID NO 22 in the 10/714,887 US patent application
  misc_feature: The sequence is a functional homolog of SEQ ID NO 22 in the 11/435,388 US patent application
  misc_feature: The sequence is a functional homolog of SEQ ID NO 330 in the 10/412,699 US patent application
  misc_feature: The sequence is a functional homolog of SEQ ID NO 2628 in the 10/374,780 US patent application
  misc_feature: The sequence is a functional homolog of SEQ ID NO 308 in the 10/225,066 US patent application
MALWALPVGFRFHPTDEELVSHYLKGKITGQINSEAEVIPEIDICKCEPWDLPGKVSEPVRRS

SEQ ID NO: 93510 - DNA, 935 bp, Zea mays
  misc_feature: Ceres CLONE 1582845
  misc_feature: Encodes the peptide sequence at SEQ ID NO. 93511
ttgttttgtttttctcttttgttggcggttcaattttggttagacagcccagtgtaattctctcttattgttgtaatattatatgtggagctcaccgcggtggcggccgctctagaactagtggatcccccgggctgcaggaattcgtctcacccctagaaaaactagacgactacgcacgcaaagagctgatgcgtatcaacgtatgcggatgcaggggcagcaccgtccacctccaccatctttcctcttcctcctcgcctccaccccttcccttccatctcctcccacccggcgactcctctccctctctgccgcgccgatcgattggcccacccatcgatcgagcacggggaagaagattccagtccggagcggtttcaattcggtcgggttcgttgcccgtgtgggtgggcgctatggcggcgatggatgcctcggcagataagaacgccgtcttccgcaagcttcgcgccaaatcggacaacaagatgtgcttcgattgcaacgccaagaacccgacgtgggcgtccgtcacctacggcgtcttcctctgcatcgactgctcggcggcgcaccgcagcctctgcgtccacgtctccttcgtcaggtcaacaaatttggattcatggactccagaacaaccgaaaatgatgggctatggcggaaataaccgggcgcaagcttttcttttagcagcatggttggacagatggtgagaaaaaatcaagcaaaagataacttcaggagctgctgaacttgtaccgacaagttagcttgctaaaaaacgttgcctaaaaagcccctcccgaagatgggaaacaattagttgggccattcttcccccagttggcaagaaccccaaagctcccaaatcaagcctggctgcaattgccaagatctcaaggctgaacagaggggtccaaaaagaaaaa

SEQ ID NO: 93511 - protein, 99 aa, Zea mays
  misc_feature: Ceres CLONE 1582845
  misc_feature (11)..(100): Pfam Name: ArfGap Pfam Description: Putative GTPase activating protein for Arf
MAAMDASADKNAVFRKLRAKSDNKMCFDCNAKNPTWASVTYGVFLCIDCSAAHRSLCVHVSFVRSTNLDSWTPEQPKMMGYGGNNRAQAFLLAAWLDRW

SEQ ID NO: 93512 - DNA, 888 bp, Zea mays
  misc_feature: Ceres CLONE 1582846
  misc_feature: Encodes the peptide sequence at SEQ ID NO. 93513
gcggtggcggccgctctagaactagtggatcccccgggctgcaggaattcgtctcacccctagaaaaaagccgtaccccgggagagccccccagcccttatcaaaccctaaatcaaaaactatccaaaaaaatccgcaaaaaactagaaaaaatcccaaaaatcaccacttgattggagatggcggcgcaagggcaggcggcggctggatccgcgtccgagtctggcggctcaccggctgcctcagctgctgcagcggcggcggctgcgttcccggcgacttctctctacgtgggtgacctgcacgagagcgttcaggacgcacagctcttcgacgtcttcagccaggtcggcggcgtcgtctccgtgcgcgtctgcagagacatcaactcccgcaagtcgctcggctacgcctacgtcaactacaacaacactaagcgacgctggcacgggcacttgaaactgcttaacttcactcctatcaatggaaagccctatcaggatcatgtatttctaacccgtgacccccgcctcgcggcaaaaacggtggccaggaaaatttattttattaaaaaatctttggattaagtccaatagaccaacaaaagcttttatattgaaaaccgttcctggtgcattttggggaaaaactcctttttcttgtaaaaaattggccaacagaaacccccttcaggaaagaaatcaagggggaaatattgggttttggttccaagtttttaaaaaggggcgggaacacccgcttccaactccgggcccatttgaaataaaaccccaatgggggtagagttttaattcaaagggaaaaaagaaaagatggtgaagttgtgggagaacctcttgtgtgtgcaataaacgcaggagacggggg

SEQ ID NO: 93513 - protein, 135 aa, Zea mays
  misc_feature: Ceres CLONE 1582846
  misc_feature (36)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAQGQAAAGSASESGGSPAASAAAAAAAAFPATSLYVGDLHESVQDAQLFDVFSQVGGVVSVRVCRDINSRKSLGYAYVNYNNTKRRWHGHLKLLNFTPINGKPYQDHVFLTRDPRLAAKTVARKIYFIKKSLD

SEQ ID NO: 93514 - DNA, 804 bp, Zea mays
  misc_feature: Ceres CLONE 1582855
  misc_feature: Encodes the peptide sequence at SEQ ID NO. 93515
acccgcggtggcggccgctctagaactagtggatcccccgggctgcaggaattcgtctcacccctagaaaaaatcgcccgtctcccccgcgatcaagctgaccagagccggcaaccgatggtggtggtggcggtgggagggggcggaggcggcggctgggggacgtgggaagagctggtgctgggcggcgcagtgctccggcacgggggcgccgcgtgggccaccgtcgccgaggagctccggacccgttccccgtgcaccttctcggccgaggaatgtgaagcaaaatttgcagagatacagttgcggtactccgcatgcaatgcttggttttgagagcttcgtaagcagagagttgctgaactgaaaagggaattgggagagtcgggaaattctatcggatccctccaatctgtgattcaaagcctcagcaatagcaaacatgttgacgggagttctgaataccacaccagtcatactgaatcatgtccccgctctgaaaatacagcagatacttattcctcagggtaaagaaactcccgggatagatcatccgctgctagtttcccagaggaaggccagcaacggtcagaaattctccgaaagtgccgcagtgtgatactggtttcaattcaagctatcaattcctccccagatggagtcatatcccccgggcccaagtttgaaaagggccggcccccaaaaatggctttgcttttgggggttcttaaaaaaacaaagaagggggggagagccttttaagggcccccttcctggaaagggggggggaatgatatgcgcggg

SEQ ID NO: 93515 - protein, 72 aa, Zea mays
  misc_feature: Ceres CLONE 1582855
MVVVAVGGGGGGGWGTWEELVLGGAVLRHGGAAWATVAEELRTRSPCTFSAEECEAKFAEIQLRYSACNAWF

SEQ ID NO: 93516 - DNA, 718 bp, Zea mays
  misc_feature: Ceres CLONE 1582856
  misc_feature: Encodes the peptide sequence at SEQ ID NO. 93517
  misc_feature (215)..(215): n is a, c, t, g, unknown, or other
  misc_feature (223)..(223): n is a, c, t, g, unknown, or other
  misc_feature (224)..(224): n is a, c, t, g, unknown, or other
  misc_feature (240)..(240): n is a, c, t, g, unknown, or other
  misc_feature (270)..(270): n is a, c, t, g, unknown, or other
ctcacccgcggtggcggccgctctagaactagtggatcccccgggctgcaggaattcgtctcacccctagaaaaaatcaggcccacgctttgttaacaaagaattccctcatagccgccgccgccgccgccgccgccgctcatctcgccgagaggtgacgggaccgaggaactcgccgagttctaagatagagaatcgcttttcacagcctgggngtctgctnngcgtagggtggtgttngaagggggaagaagttttaagaatctgttncccacagatcaccgcgtggcggcgctccgcgaaatcgggggggttccaccacataagcttccggccgttttttggaatttggagtgtgcccaaagggggaggccctaaaggggtggggaaaaaaaatttttaaaccccggagagcccttttccccggggaagggtaaggaaaaacccccccccctggggggctcccccccatttttgggggaaagatttttttcacccccttcgggggagaggggggcgccaaaaaaaaaaaaaattcccccccggggggggggggggggggttgttttccccccccccaaaagtgggggggggaaaaaaaaaaaaaaaacccaccccccccccgcgggagagaaaaaacccccccccccctcttttgggggggggggggcgccccccccccccccccccgcgttttatttgagagaaacaaaaagaa

SEQ ID NO: 93517 - protein, 31 aa, Zea mays
  misc_feature: Ceres CLONE 1582856
LTRGGGRSRTSGSPGLQEFVSPLEKIRPTLC

SEQ ID NO: 93518 - DNA, 797 bp, Zea mays
  misc_feature: Ceres CLONE 1582857
ctccccgcggtggcggccgctctagaactagtggatcccccgggctgcaggaattcgtctcacccctagaaaaaatcaggaccacgctttgttcactaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacacatcacgcgtgcgcgctcgcgaatcgggggttccgcacagagcttcctcgctttgaatttgatgtcctcttagcagtctgaaggtggcaagaaggctagcccgggaccctccatgatgaatgaagctcccctgggctacagcattgaggaccttcgacctgcctgaggcgcgaagaactgaccgtctgctgcgtactccccctgcgcaaagaagccatgctgatgtcacttttggctgcctcgggtctagagctcacgatttcttttctgacacttcgattctgagccatgcccctggcctgctgctgtcctgacaatcaacgagttccccagtgttgctgcgtgaagtcctacctcctccatctgcagcgttgtgttctgactaggcgcaccaatgattgtccttgctggtgccggtggtaccccggcctacggtatcgtgtttgagggctatgaccaccgcccttgagatgctcttgtctgatggaactgtctttgtggacccccatggaagcggcttgcggagcccctt

SEQ ID NO: 93519 - DNA, 831 bp, Zea mays
  misc_feature: Ceres CLONE 1582862
  misc_feature: Encodes the peptide sequence at SEQ ID NO. 93520
gcggtggcggccgctctagaactagtggatcccccgggctgcaggaattcgtctcacccctagaaaaaatcacacactcgactctcctctctcgcatccgcagcctctcgagctctactccatcccctcgatctcgaagcgcagcagcaacagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctccttgccatccgcaacgacgaggagctcggcaagctgctgtccggcgtcaccatcgcccacggcggcgtcctccccaacatcaacccggtgctcctgcccaagaagaccgcggagaaggcggcggccaagggaggcaagtcgcccaagaaggccgccaagtcccccaagaaagcatagaggggcgggcgcctttaccgctgtgatgttgaatgctcgtgttcagtagatctttacctctgtagtgtcgtcgttgttattgggactggttagtagatctgtgccatgtgggtggaaacgtgaatccctgatttccgaaacctaatttgcaatttgggtgccccaaaaaaaaagcaggcttgcaacaaactcacaaa

SEQ ID NO: 93520 - protein, 156 aa, Zea mays
  misc_feature: Ceres CLONE 1582862
  misc_feature (31)..(104): Pfam Name: Histone Pfam Description: Core histone H2A/H2B/H3/H4
MDASAAGAGGKAKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLSGVTIAHGGVLPNINPVLLPKKTAEKAAAKGGKSPKKAAKSPKKA

SEQ ID NO: 93521 - DNA, 804 bp, Zea mays
  misc_feature: Ceres CLONE 1582868
  misc_feature: Encodes the peptide sequence at SEQ ID NO. 93522
ccccgcggtggcggccgctctagaactagtggatcccccgggctgcaggaattcgtctcacccctagaaaaaatctctcttctcccctcgatcaacagcaacagcggcggtcagaagcttccgtcgcgacagctcccgacctcctgccggtcttcccctctcctagtcggcgcgaatcccgaggcggaggaggaagaggggagcggagtgggggtgggccccatcaaccatgagtctcacggggtccgccctggaggccgcgctacaggtggtggggtgcggcctcgacgcggctggagaccagcggctgctctacagcccgggaggtggaaggctcgtcgcgctccaagaggaccgtgcgcgggagctgccgctctcccacagcagcgtgctcccgagcgtgccccccgatgtctaggtcgagcagtggcgcgtagaccccaagcgcatcggccccttcccctctggcccaagctctgccgtagccgatgggccctttgtgtgcagcttcgataagatggctgagtatctcatggcaaggcctgggtgtccgagacagcccctctgggttgcttcggctctctcgggagcttcaacgggtcatggaagaatgaggttgcggctatcaaggcccctgtcacttgctgcgagggcgcggtccccggaatgacactgaaaatgaccagtttcgaacctaacgctgcgattacaggggtaaaaacgggatgccaacccggttggggaacccgttccccctttggtctacttttttctcggaaagttggggaaaccatttctctttca

SEQ ID NO: 93522 - protein, 62 aa, Zea mays
  misc_feature: Ceres CLONE 1582868
MSLTGSALEAALQVVGCGLDAAGDQRLLYSPGGGRLVALQEDRARELPLSHSSVLPSVPPDV

SEQ ID NO: 93523 - DNA, 1333 bp, Zea mays
  misc_feature: Ceres CLONE 1582871
  misc_feature (868)..(868): n is a, c, t, g, unknown, or other
  misc_feature (1118)..(1118): n is a, c, t, g, unknown, or other
aaagatgattttgggtagtaatatttagatgtttggtattgttgttgtgagaaggggtggcatatggagtttataaggggtattctcgacgtgggagccgctctaaactagtggatcccccgggctgcaggaattcgtctcacccctagaaaagttatttgccgaccaaggtggcagcttgttggaccacttgggttatcaaggggggaggaattccacaacatggagtctccaacactggatcatgggaattttggattaatccagcctggtgcaattcccttattttatctacagattctcccgcccgttgattaaatggatcaaaatcaatttgcaaatggtttattaaaaatcttgctttcagcctagggtccagaaatttttggtaccaaaaacaaacctcaaaaaaaaccccctttacattttataaattccggattggtaaagaaaatgaacgcccggctttgaaccaaaaattgggtccttacaataaaggttacctcctgcgaacgaaaaccagaattcccctttcttcctggggccctcatgcaatgtttaaccgtccagaaaaacacaagaaaaagttaaattttgtaatttaaaactttttttgacccttcccaaagaggcttttccctctaaaaaaaccagataggaaaaaaatgaaatattaatttctcaaaacattgtttcactccccctgaaaaatattatactttggttttcctggaaatgctcctcttaccctattcgggggaggaaactccctttcttggttttatacctctgaaaaaacactatagtttgtcctgacatatggacgataattcttggccccttttaaaatacaaatattagataggtnggtttggccttcaccacgtaacaatgacatgagaaattaatattcctcaaaatacatccccatactcttgtttcttcccttttctgagcaattggcgaatctacaagctacaatggcaaagttctgtgggacataaagttgatttacaagatagaaaaagataattgaatttctttcctctacattgaataaaataaggcggtgtgttccccctcccaatgacgcatgcgacaacctatacaaattaaanatatgccgtacaaaaacgacacagtccttttttggctcctcccactattctagcgggggtgttgcgaagaccacaaacattgatttacaaagtttttattaaacacccctcttctgccgctgtgtgtataacctcacaccccctggtgtatgtgtgggagacacacaaaatacttaggtgtcgtctgagaataacaaataacttttggtaggata

SEQ ID NO: 93524 - DNA, 1066 bp, Zea mays
  misc_feature: Ceres CLONE 1582873
  misc_feature: Encodes the peptide sequence at SEQ ID NO. 93525
  misc_feature (11)..(11): n is a, c, t, g, unknown, or other
ttcattttttntttttgtttttttttccccgcttatttccctctcccatctgtgatagtttttttctttaaaataaaaactggcactccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggaacctgggacctcagcttctcaatcaaggccccgggccgaacgaccggggaagcttcccccccccggttggccgggaagggtcccacgggcaaccaaacaaacctgtgggaggggttccttgcttgggaaccccccaatttgaaacgggcggggtcctcccctccccgggaaaacccttaattccctcttaaagggggagaagagttctcccccccccaggggcccaacccttattagaaaaaaggcttttgtaaaaaaaaacaaaaccgcgtttttttctcccccccttaaaaggggggggagaatttgttaaaaaataacccccgcgggaaaaaaacaattttctttctccccacaaaaaactggggccctctgggagggggattttgggcttaaaaaagatggttcccccccctttactctctttacccccccaccgggtaaaagaaccccctaagagttcccccaaatttttggggatataaaaaaagggcccccccccaaccccaaaaatattgtggggagaaaattctcgggcccttttttctttgg

SEQ ID NO: 93525 - protein, 107 aa, Zea mays
  misc_feature: Ceres CLONE 1582873
MAATVSSCLSLVPTVHHRAGGFPSSVALTNTLQRRRRSRRYLVVASATRAEQEAAPVTIEEPGTSASQSRPRAERPGKLPPPGWPGRVPRATKQTCGRGSLLGNPPI

SEQ ID NO: 93526 - DNA, 841 bp, Zea mays
  misc_feature: Ceres CLONE 1582877
  misc_feature: Translation starting site: 129
acccgcggtggcggccgctctagaactagtggatcccccgggctgcaggaattcgtctcacccctagaaaaaacaggcacacaacacaacacagttctccctttccactccagtccaaccaaccgtccatgggtttcttcatcccgccgcccaaggtgtacaagccggcggcagaggtcgacctcgggccggacagcgacgagcactacatcagccccaacgtgaaagcgccccgcgtggccgggttcctggtgaagatgctggcctgggtgctggagacgccggtgcttggctggatcgtgctcggcgtcctcaagagggacaacctcgtctacaagctcgtctcggacgctgagatcccggagccgccgctattcacggccacccacacatggcaagcagcgatccaggagcagagcgtgcgcgtgacggagtcgaggctgtcgccggcggagcgcgtgcaggaggccgtcgcctgcgtcccagctgctgcccaggcccagttggagccggcggcggggttcaggcgctggacggtgcgggacttccacagggcgtacagatcaggacaggctacccctaccatggtggcgcggcgattcctggcagccgtggtagaatgttcagggccggacctgaacatgggcttcttcatcagctgcgaccctgcggacgtgctgcggcaggccgaagactcacccgcagataccagcaaggggcgccgctgtccgccatggacggagtgctggttcgcgtcaaggacgagctcgactgcctgccgtacccgaccacggcgggcacacgtggctggggtcggcgcggccgttgccggcggaaccct

SEQ ID NO: 93527 - DNA, 1010 bp, Zea mays
  misc_feature: Ceres CLONE 1582878
ctagctggagctcaccgcggtggcggccgcttcagaactagtggatcccccgggctgcttgaattcgtctcacccctagaaaaaatcgcagggggcattaagctgcctgcctccgctgccggccgtactacataatcgccgagcttgtttggccaccgcccgacggctgggatgtggccggccacgctccgcgaggggcctcggcagagacggggtcgccatccgaccgaggccggcatgggctaggtgtgggatcggtcccgggggggggtggggtgtgtggggggttagataagtagtactggtggctgagccgattgtggcgtctgagcgtggcgcgtggtagtttcaagattggtaccatggtgctgcgatcccgggagccgctgagtgcgtcgagataagacgcaaccacgggctcaacgcgttatcgtagaggaaacacctcactcgacatgccggttccctaagcactctcaaagttgtggcgacggggctgtctggaagctttcctccctggactggacgtcctggatgtattcagtgcagtaagaagagtaacgggtgtatgtcggtgtgatggttaatggcagcgggggggcggtagtaagagataggctgatgctcacggtcgtcgggccaggggcaaccaaagagagtaggtagatggagaaacgccaacaatgccactgaatcagcgaccggcataaaagacgtgtaccccacccccggaaggtcattatgttgtggaggaggggcgcgtaccatcacaccccccaacataccgacgacgtggaaacgtaggttaagagaggatatgtctagacttctcgatgagactcgttgcttctagctcacacagccggcgcgctccccccgcacttacgatgttagtagacgcaatctctcaaaggaggacacaaaataagtgtgtcgagaacagtagaccgctattcgtaaccaattcttaggggatgacttcttgaggagagaaggcggcgaacagcagg

SEQ ID NO: 93528 - DNA, 803 bp, Zea mays
  misc_feature: Ceres CLONE 1582881
  misc_feature: Encodes the peptide sequence at SEQ ID NO. 93529
  misc_feature (744)..(744): n is a, c, t, g, unknown, or other
caccgcggtggcggccgctctagaactagtggatcccccgggctgcaggaattcgtctcacccctagaaaaaagttgtaaatttgatcaatgaagaagattcaagaattaccgttttactggattgccatgggatttcgccattcagatttccaatgcaaatgatgaggtcgtttatcactgtggttcaagaaaactacccgaatcgtcttggggtattgtttgtcatccgccttcctccagttgtcagagttattgcacagacatttcttcaaattgcaatatcacatggtatccgtggagatgaggacgacattgcctccaagtctgctccaccggcatccatcgacggtgcaagatccagcagatagattgatggcaaagaggacgactccatgtccaggcgtactccccgccttgcatcgagattgctaggtcataatcgaagggtttacagggaggagatctgaacatagctcttcaatcccaaagttaacatcgttggttaccataattcttactgcttgcaagcccttttagaatattactgctgcgaggttcttgcaagtccttgatgaagaagtcgaaagtgacgaacgccgaggccgtcatcctgatcgacgccaagaacctcacagcgcaccctctttgtgatgctcttttctccaatgtcttctcttatctacatgcaggaaaaaatctacatgttgaatggcgtggattcagaaaaatgtggaaaggaccngatttaaggatgcacctgccattggtttggccggtctattttcctgcattctcgaagcg

SEQ ID NO: 93529 - protein, 71 aa, Zea mays; identical to SEQ ID NO: 93443
  misc_feature: Ceres CLONE 1582881

SEQ ID NO: 93530 - DNA, 769 bp, Zea mays
  misc_feature: Ceres CLONE 1582888
  misc_feature (437)..(437): n is a, c, t, g, unknown, or other
tccccgcggtggcggccgctctagaactagtggatcccccgggctgcaggaattcgtctcacccctagaaaaagtaagtgtcaacccaaccgtccacggtccgccctcctccttcgttcacgtcttcctcctcgcgttcctctcgtcagtacggcgacgccgcaaggctcgcaccgctgacagtcccccttcccggatcgagcctctcttttcccagatcggattctaattgggctatcgccgccgccgtgccaggtgccgagtccttagccgatcttcgccggcgaggagcgcccaccaggagttacagactgaatgacaagaatgttctctatatcatcctcagtatgtgtgaagaaatagtctgtaactacacatacctttcattgcaattaccaagaactggaaatggacgatgataatggggcttgagcttnagtttgggcctatctttggggcgggtcatcaggggaagccaaggctagagaatgcaccctcctagaaccaaaagcagaacccccaagtgggaagaaagcagtagccaaagggtgtttttacaaaccccccggaaggccccccctttgggggaaaaattttatttcaaaaaagggcgtggataaccccgtgaaacaaaaattgtaaaaacaaggggccccaaccccctgtttggccccccacaaattttggggaaaaatttttggggggaaacacccccgggggaaatttcctctcccggggccccacggggggaaaaaaaggggtttctttt

SEQ ID NO: 93531 - DNA, 846 bp, Zea mays
  misc_feature: Ceres CLONE 1582889
  misc_feature: Encodes the peptide sequence at SEQ ID NO. 93532
ctggagctccccgcggtggcggccgctctagaactagtggatcccccgggctgcaggaattcgtctcacccctagaaaaatagaaaaaaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttggtttcctcgaaggatcagcatctactcttgattgtggactttgtcgcatctgatatcaacttcataaatctttatccaagatggcgctgcaaaacattggtgcttcaaacagggatgatgccttctacaggtacaagatgcccagaatgattaccaagatagaaggccgtggtaatggtatcaagacaaatgttgtgaacatggttgacatagcaaaagcacttgccaggccagcttcctacacaaccaagtactttggatgtgagcttggtgcacagtccaaatttgatgagaagacagggatttccttggttaacggggctcatgatactgcaaagctggctggtctccttgagtattcatcaagagtatgtcaaatgggtatgggtgtggaaatcctgagacagagattctcatctcaaagaccagatgatatcactgaaatc

SEQ ID NO: 93532 - protein, 122 aa, Zea mays
  misc_feature: Ceres CLONE 1582889
  misc_feature (1)..(116): Pfam Name: eIF-5_eIF-2B Pfam Description: Domain found in IF2B/IF5
MALQNIGASNRDDAFYRYKMPRMITKIEGRGNGIKTNVVNMVDIAKALARPASYTTKYFGCELGAQSKFDEKTGISLVNGAHDTAKLAGLLEYSSRVCQMGMGVEILRQRFSSQRPDDITEI

SEQ ID NO: 93533 - DNA, 1273 bp, Zea mays
  misc_feature: Ceres CLONE 1582891
  misc_feature (1)..(1): n is a, c, t, g, unknown, or other
  misc_feature (1036)..(1036): n is a, c, t, g, unknown, or other
  misc_feature (1273)..(1273): n is a, c, t, g, unknown, or other
nggcttaggttgggttttaggcttgtcgtctttttgtgtatgtgagttgttttggtcattttcgatctttgttcttaaagagtggtactcccctcggtggcggccgctctagaactagtggatcccccgggctgcaggaattcgtctcacccctagaaaaatgcagtgtcgtcgcttccggctctggttgagccctcctccttcgttcaagtattcgtcctcgcgtctctctcataagtacggagacaccgcgaggctttgaccgatgactctcccccttcccggattgagcctctcttttcccatatcggattctaattggggtatctgggatgccttgccttctgcctattccttgggcgatcttcccccgcgacgatcgccctccaggagttggagactgactgacgagaatgttctctatattcatccttcaggtgtgtgtacacataattagtccctacgaaggaccttttccgtcctattacccccaaattgtgaggtgcagctatgactaatggcgctttggggcttaagttttgggccctataccctcggggcagggttgtattcaagggtaaaggccccaacaggcctaagataaggcgcctcgccccttagaaccccgagagaaggccgaaaacccccccggggggtggttacagcaacgagccatgggccctacaaaaagggagtggggttctttgaggaaaaaacgatgccgggggaaaatgggttttcccctctgttcttgggaggaaaaacaaatttttctatgtttcccactgaatagaagaaggccccgccgcttgcagaaaaataaaaacccccgacggtggggatacgcctcgaacagaatttttgtgggttttacaatagcgagcgaaagaaaagaatctataacaaatgcccgccgcctgtggttttttggccccaaaccacccccacaatatttctatggggcggcgaaagagcgtctctcttggggtcgcgtgtaccacaagacgcctacctgcgtggaaaacttttttggggngcctcccgtggttccgcgcagacgtggggggtcacgacatatgggggtatctctctgtccttgtagaagaaccaaggctgttacagtctcatttatatacccgcgcgctctgcacagtatctcgccccagcttcccgccccgagccgatgggcggaaaggggactgtgctcatattttgagcaactgtttgtgcaaaaggagaatatgtcttgaacggggtggcgtgctacaccccn

SEQ ID NO: 93534 - DNA, 887 bp, Zea mays
  misc_feature: Ceres CLONE 1582894
  misc_feature: Encodes the peptide sequence at SEQ ID NO. 93535
tccccgcggtggcggccgctctagaactagtggatcccccgggctgctggaattcgtctcacccctagaaaaagccgcacccccaagacttccgtccgagtctgagctcatctccgcgcgctgccgccgtcgacgccgccgctcgaggcacacagggcaggctcggctgtactgctcctctacgctttttcctggcggccgccggcgctcctgccgtatatcacatgaggacggcggctacctctggcacatccacccggaactacttcaacagaggggtcctcttctgcgaaagctcctccgggcaccaggttgaaggtgcagttcctgatgtcggaagaaagtctagcatctggcgacacattctctcatgaaagctattccctggacaaaaccacaaccgatgtaactgctgatagccttcataagtacaaggtcgaacattaagcctctgcatgagacctgtgtcgtctgcccaccaggatgacgagttgcttggcctcgaatttatacctgcttggtcggcgagcaccgcaatccccaaggggcccgggagtgcttgcgaccttgtctcagtgggacgactccctaccatcgggaattaaccccttcatcgtaaaatacgtatcaagttccgccttgtcccggaaggcatttttttggtagaaagtatcagttgtgggtcgatttgtttcccatctatttctgacaaagtaatagcccgatgctttaaaccccaaaccgttgtggtcttccacttatcctcctcgcgaaacacgggttgtaattctcctggtaattccccttgttctatggaggccccctcccatcttataacgcaactcggttggtgggactggttcctgggatgagtctctttcccggcc

SEQ ID NO: 93535 - protein, 49 aa, Zea mays
  misc_feature: Ceres CLONE 1582894
MRTAATSGTSTRNYFNRGVLFCESSSGHQVEGAVPDVGRKSSIWRHILS

SEQ ID NO: 93536 - DNA, 1044 bp, Zea mays
  misc_feature: Ceres CLONE 1582903
  misc_feature: Encodes the peptide sequence at SEQ ID NO. 93537
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (734)..(734): n is a, c, t, g, unknown, or other
  misc_feature (760)..(760): n is a, c, t, g, unknown, or other
  misc_feature (990)..(990): n is a, c, t, g, unknown, or other
nnnnnnnnnccccccccccaaaaaggcggggtaggatagtgagataattgatgaataattaagatatagagacccagaaagaaaaaaaaggggtgctccacctcggtggcggccgctctagaactagtggatcccccgggctgcaggaattcgtctcacccctagaaaaaaagaaacacgcccactcctccggctcttcttctccaccggcaccagtccaccacctcctgccaccgcgcggccccaaccaaccacaccgcagcgcagcaatggcgggcaacggcgccttcgtggagagcgacccgctgaactgaggcgcggcggcggcggagctggccgggagccacctggacgaggtgaagagcatggtggcgcaggcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacagcgtcaccaccggattcgggggggaacctcccaccgccggcaccaaaggacggggcccgacgctccagagtcaaacttggttcaaggcgatttcaaacaccaaggaatctttccggcaccgagcaggcgaacggggcaacaccgcttgccccgaacggaaagttaaaaccccacgncccggctcaaatgacttggatggcanaaaatcaaaaaaacccattccctcccaaggggcttaacacccggggcaaccccagctttcccaagaatgcctccaaaggaccgatccaccgaaagacttgcctccatcaccccggtaggtcaagcccccctgtgccctgggccccttccgaggggccacccatccaccgacataaaggggggaacctgggtatcccgcactatccatatcattcggcaggggcttcattnatagaggcgggcccccaagacataaagggccgattcaccctgccatacggaaaa

SEQ ID NO: 93537 - protein, 143 aa, Zea mays
  misc_feature: Ceres CLONE 1582903
  misc_feature: SWISSPROT Homolog: EC 4.3.1.5 Phenylalanine ammonia-lyase
  misc_feature (132)..(132): Xaa is any aa, unknown, or other
MVAQARQPVVKIEGSTLRVGQVAAVASAKDASGVAVELDEEARPRVKASSEWILDCIAHGGDIYSVTTGFGGEPPTAGTKGRGPTLQSQTWFKAISNTKESFRHRAGERGNTACPERKVKTPRPGSNDLDGXKSKKPIPSQGA

SEQ ID NO: 93538 - DNA, 1281 bp, Zea mays
  misc_feature: Ceres CLONE 1582906
  misc_feature: Encodes the peptide sequence at SEQ ID NO. 93539
  misc_feature (1281)..(1281): n is a, c, t, g, unknown, or other
tataattttccaaacgagaataagagataataccaactcacccacctaaaacccaaaacacacacaaaaaatattaaaactccccccattggcagccgctctaaaatagtggatcccccgggctgcaaggattcgtctcacccctagaaaaaataacacaacaatctctctcccctcactccctctctgcagcgcgcagctttcaaagcgttgggagagatggcagaggagacgcaaccagaggtcgccgcagacgccgccgcgcccgccgcgggcgaggtagtcgtgaccgaagctgcaccagctgaggcggaggtgcctgcccccgcggaagctgaagccgaggccaaggatgagaagaaaggtgactaggcggagctcaccgccgatgacgcgggggtggggaccggctcgttcaaagaggaaagaaacctgttggaagacctgcccgacccggagaatagtttcccccaccagttcaagcagctgatttgtgccgcccttgccgcaggggagttcaatctgggtttccccgccgcctgccccgaaaagccaaagaagacaaatggtggaaggaaaaccaaaggcctaaggaaggcccacccaaaaaaaaacccaagcaggccataagccggaaggcttaccggcgggaggggaaccccaaaaggcccccaaggggtggcttggcggaaagccccccccgcgtttggaaggaagggtccaagaaaaccggaagggtgtggcctcccctcggccctctgcaaagggaaggggccccaaaggtgttttgatgaaaaaatctactgtgtgcccttgaaagtgtgaaaagagccgccaaaggggctctctatttctctcggaagaggactccccatgaaaataccgggcccaagggggaggaagtatgaaaacacgcacacccgtaggtgtggttccaccccttcgaagagataagggggaaaagacatgggtgctttactctcaaacataactatgggtcgtgaagaagcactaatatatccgaggaggaaaaaacctccggtgtcggtggtgtttcgtggccacccccgagtgtcggggagatatctcccgcgaagagggtgaaaatgaattgtgtgcggcacctctgggagaagggtggagggggggttcgatgaagtttttagaagcggatatagttccccccctctgatacccccctgtgagtaaaaatttaaggggaggcagtattaccatctggttggggggagaatagaaatataacttctccggagaaactgn

SEQ ID NO: 93539 - protein, 50 aa, Zea mays
  misc_feature: Ceres CLONE 1582906
MAEETQPEVAADAAAPAAGEVVVTEAAPAEAEVPAPAEAEAEAKDEKKGD

SEQ ID NO: 93540 - DNA, 1138 bp, Zea mays
  misc_feature: Ceres CLONE 1582907
  misc_feature (59)..(59): n is a, c, t, g, unknown, or other
  misc_feature (60)..(60): n is a, c, t, g, unknown, or other
  misc_feature (481)..(481): n is a, c, t, g, unknown, or other
gggggggctgtttttttttgaggggcgcacaaaatctgtcttataggatggtttagagnncggaaacctacggggtgttacaaaactgaactccccgcggtggcggccgctctagactagtggatcccccgggctgctggaattcgtctcacccctagaaaaaaaacacagcaagcaaagcaggaatcggaggtagacgacgaccaccacggggataacaaccaaacctcccaaataccatccacgaacgaaagggaagggaaggtccttttagcggcgcgccgaggccgtgggctatgggaccccaacgggggcgggcgacaccatcctcgggggatcccctcctttcccctctcgcaggcccagcaagcaggcagcagggatcctctttgccgggcgttctccgaactaaccttgggggggtcccgtggcaccctggaaaaactcccgggggggaaggaaggatcccgcgcccccttcntccatgggggcgtaccaagaagcgcccgggtggggtttcccccataacttcggggaattcttcctggggaaaaccctaatataccgttatcctagaaccggggttccgccttaccacaaaatatccaaaagatgcttacggagcccaccagccctgaccctaaaaaaatacacattggttatcggggaaaacggggccctgcgtatatcatttttcccccacttgtttgaggagggaacctttattgctttttcccgataaagcgccgttaacccctgtggggttcctgtccatccccgcaaataccagaggaagcattcaattttctatccataggaaacactccgtgaaaaagatacatattgagggagttataagagtggaaagggcacaaaaggatcttggtggtagcggggaaaaatgttaggcacaaggctgtcttgggagatgaaagtatttaagagagagtttgctcctcgctacacgagagaagaaaataagagtagtccccttgcgcacgatccggatagtaagatttgtgccgacccccccggtgggtgggctgctacaaagggggggaaggtattttatctttcattgtaagatgtgggctcctcattaatatacgcccatattgtacgtcaccagcgtctgggg

SEQ ID NO: 93541 - DNA, 862 bp, Zea mays
  misc_feature: Ceres CLONE 1582908
  misc_feature: Encodes the peptide sequence at SEQ ID NO. 93542
  misc_feature (683)..(683): n is a, c, t, g, unknown, or other
ctcaccgcggtggcggccgctctagaactagtggatcccccgggctgcaggaattcgtctcacccctagaaaaaacggctccagatccgccgtacgcataagccccagctgccctacctgcgcactcgcctccgcctccatctccttcgccaccagacctcaagcgcgccacacgccgccgcacgggagccgcgcgccgcacccgccgccgcttctcctcaaaaccagaggtctccccccgtcccccgatccagcgtctccatggccgcgccgcagcctgtcgcccccgcctccgaggcgccgccgtctgcgcaaatggtgggcaacgcgttcgtgcagcagtactacctcgtgctgcaccagtcgccggatctggtgtaccgcttctaccaggaggccagccgcctcgctcgccccgcatccgccgccggagccgccggcatggactcggtcaccaccatggaggcgatcagcgagaagataatggagatggacgtgtccaaagcggagatcaggacggtggactcgcaggagtctttaggcggcggcgtcgctgtgctcgtcacaggtcacctcaccggccgtgatggagtgcgccgcgagttctcgcaatccttcttcctcgcgccgcaggagatgggctacttcgtgctcaacgacatcttccgcttcgtcggggacantcctgcctctaccgccgttgaagcgcagcccagaggcggttgctgtagtcccgcctgtggctgctccacttgccacggcacagctacttctgctggggagctggcacttctgaagaacatggtgccctggcccagcaaggaacatcatgttggtggaaccgatcctgccctcaactgga

SEQ ID NO: 93542 - protein, 200 aa, Zea mays
  misc_feature: Ceres CLONE 1582908
  misc_feature (20)..(137): Pfam Name: NTF2 Pfam Description: Nuclear transport factor 2 (NTF2) domain
  misc_feature (141)..(141): Xaa is any aa, unknown, or other
MAAPQPVAPASEAPPSAQMVGNAFVQQYYLVLHQSPDLVYRFYQEASRLARPASAAGAAGMDSVTTMEAISEKIMEMDVSKAEIRTVDSQESLGGGVAVLVTGHLTGRDGVRREFSQSFFLAPQEMGYFVLNDIFRFVGDXPASTAVEAQPRGGCCSPACGCSTCHGTATSAGELALLKNMVPWPSKEHHVGGTDPALNW

SEQ ID NO: 93543 - DNA, 903 bp, Zea mays
  misc_feature: Ceres CLONE 1582911
  misc_feature: Encodes the peptide sequence at SEQ ID NO. 93544
  misc_feature (798)..(798): n is a, c, t, g, unknown, or other
  misc_feature (799)..(799): n is a, c, t, g, unknown, or other
ccgcggtggcggccgctctagaactagtggatcccccgggctgcaggaattcgtctcacccctagaaaaaagccgcttcccccctcccctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatggcggcggcggcgggagcaggggaacaggaggaggaggacgtggatgagctgctggccgcgctcgggtacaaggtgcgttcgtcggatatggcggacgtcgcgcagaagctggagcagctcgagatggccatggggatgggcggcgtgggcggcgccggcgctaccgctgatgacgggttcgtgtcgcacctcgccacggacaccgtgcactacaatccctccgacctgtcgtcctgggtcgagagcatgctgtccgagctcaacgcgcccccagcgccgctcccgcccgcgacgccgggcccaaggctcgcggtcacatcgtccaccgtcacaagtggcgccccccgccggggctggctacttccgatctcccgcccgcccgtggacttcgtcagcaatacctacgctccgaaagccatccccttccccggggggggggcccctcggggcgaacccctccacggaactcggggcggggaaccaaaaccgaaaaaggaattggggggggaaaaaaatanncccccctctttcctcggggggaaatccaggggaagggcgggcgccccttaggaactctcccgggttcaaaaaatgtccccccccgggaaaacaaaattatccgg

SEQ ID NO: 93544 - protein, 212 aa, Zea mays
  misc_feature: Ceres CLONE 1582911
  misc_feature (196)..(196): Xaa is any aa, unknown, or other
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPGPRLAVTSSTVTSGAPRRGWLLPISRPPVDFVSNTYAPKAIPFPGGGAPRGEPLHGTRGGEPKPKKELGGEKNXPPSFLGGKSRGRAGAP

SEQ ID NO: 93545 - DNA, 847 bp, Zea mays
  misc_feature: Ceres CLONE 1582912
  misc_feature: Encodes the peptide sequence at SEQ ID NO. 93546
  misc_feature (830)..(830): n is a, c, t, g, unknown, or other
ctccccgcggtggcggccgctctagaactagtggatcccccgggctgcaggaattcgtctcacccctagaaaaactctcgatcccggaaacctctcctaccctaccccgcctcctgcgagtttccatcagctcactgaatctgcgccatggcgagtgagaccgacaccttcccatttcaggatgagatcaaccatgctgctctgactcatcatacacaccttctactccaacaaggagatcttcctccgcgagcttatctgcgactcttccgatgcgctggacaagatcaggctccagagtctcactgaccagagcaggctcgatgcgcatcctgagcttttcatccgacttgtcccacacaaagacaccaactcgctctgcatcatcgacagcggcatcggcactgacaagtccgaccttgtctactacctctgtaccctcgccaggtccgggacgaatgagttcatggaagcccttgctgccggagctgatgtgtccatgattggccagttcggcgtcggtctccaacctgcacacctcgtccccgacagagttgtcgtgagcacccagcacaacgatgacgagcagtacttgtgggactccccaagcgggcgggtcgtttcacgattacccgttgacaactcaggggaagcatactggccaggggcaaccaagatacaaccgttcccttacggaacgattagctgggaattaccctggaggtagcgtccgccttctaggaatctgggtccgagaaaaagggttctggagttgtaaacgaatttaacccccatcctccccttgtggggaactgcaaagagggaaaagncccttagtaaaggaaaa

SEQ ID NO: 93546 - protein, 86 aa, Zea mays
  misc_feature: Ceres CLONE 1582912
MEALAAGADVSMIGQFGVGLQPAHLVPDRVVVSTQHNDDEQYLWDSPSGRVVSRLPVDNSGEAYWPGATKIQPFPYGTISWELPWR

SEQ ID NO: 93547 - DNA, 870 bp, Zea mays
  misc_feature: Ceres CLONE 1582917
  misc_feature: Encodes the peptide sequence at SEQ ID NO. 93548
  misc_feature (711)..(711): n is a, c, t, g, unknown, or other
  misc_feature (827)..(827): n is a, c, t, g, unknown, or other
ctccccgcggtggcggccgctctagaactagtggatcccccgggctgcaggaattcgtctcacccctagaaaaaactcccaccgtatcctcccctgcgtagggtttaaccactcgcagcagccgccgtgactcgagaatcatgtcagcgccgccgtcgctcaagaccccggcaaccgccgtagcggtctctcggcgctcggtcgccaccccgagagccaccgggcttcgcggcgcctgtgctcccccgactcggcgcctccggtgctcagcctccgccgccgtggccggggcttccaccgagatggctgatgctccgctggactgggcagagaggtcgctggaggagttacacagcttgccggaccacgacacgttctgcttgatggcgctctcgccgctggacgggcggtacgatcgcttcgtcaaggagctgatgccctttttcagcgagttcggcctaatcagataccgcgttctcatcgagatcaagtggctactgaaactttctcaaattcctgagatcactgaggtgcctcagttcagcaaggaagctcagtccttgttgaatgccattattgagaatttttgcatagatgatgcaaaagaagtaagaaaatcgagaaagtaacaaccatgacgtgaaagccgtggagtactttctgaagcaaaggtgcagctcaaatcagagattgcaaaggtgtcggaattcntccccatttggtgtacctctgaagatataaacatctatcacatgcattggctttggaagagggggaaataaagtatgttccctgccatgatcgatctatgcggagcatgtggtccnttggcacacaaattcaggctaccctatggtggctcgaactcag

SEQ ID NO: 93548 - protein, 108 aa, Zea mays
  misc_feature: Ceres CLONE 1582917
  misc_feature: SWISSPROT Homolog: EC 4.3.2.2 Adenylosuccinate lyase
MADAPLDWAERSLEELHSLPDHDTFCLMALSPLDGRYDRFVKELMPFFSEFGLIRYRVLIEIKWLLKLSQIPEITEVPQFSKEAQSLLNAIIENFCIDDAKEVRKSRK

SEQ ID NO: 93549 - DNA, 829 bp, Zea mays
  misc_feature: Ceres CLONE 1582919
  misc_feature: Encodes the peptide sequence at SEQ ID NO. 93550
  misc_feature (68)..(68): n is a, c, t, g, unknown, or other
  misc_feature (71)..(71): n is a, c, t, g, unknown, or other
tctccgccggtggcggccgctctagaactagtggatcccccggagctgcaggaaattcgtctcacccnctngaaaaaaaaaaaaaaaaaaaaaaaaaaaaaaaaaaaaaaacccaaaaaaaaaaaaaaaaaaaaaaaaaaaaaaaacctatttctggggctagctatgggccggaagcaacggaaactctgctgctcgcactccaaatcgtcctcttctgccccctcccctccggggccaccaccttgctccctctcgtcaaaaggccatgcccctactccctgccaaaaacaatcctcgccgccaggggcctcaaccctcgcctcatctcctgcgcgaacaacggctcccccaaggcccacctgtcgaatggcaatggaggccacaacaaggccggtagcggcggcaggcccatagtcaccaacctgctgtcgtgcggaaagccccgcctccaatccaaggggctcccgcctttccgttgctgcccgccaaccccggcgtccaacgctgccgtccccaacttcacgttccccaacccaggcaagccgctccggacgcggcagccagcgcacggggccgccggcgcgaacagcgtctccaggtacgcccgcgcggtggccctaataaaggcccttccggaatcgaaccccgcgcagcttctaccagaagggccaacatccacggggccctactgcaccccgggggtaccgggaaaggcggggcggcccgaaaaccttccccttgccaaaacccccttccttcgggggttttttctttccccctttccaaacgggggccaaaccctttaatttttttttagaaaggggat

SEQ ID NO: 93550 - protein, 268 aa, Zea mays
  misc_feature: Ceres CLONE 1582919
  misc_feature: SWISSPROT Homolog: EC 1.10.3.1 Catechol oxidase
SAGGGRSRTSGSPGAAGNSSHPLEKKKKKKKKKKKKTQKKKKKKKKKKPISGASYGPEATETLLLALQIVLFCPLPSGATTLLPLVKRPCPYSLPKTILAARGLNPRLISCANNGSPKAHLSNGNGGHNKAGSGGRPIVTNLLSCGKPRLQSKGLPPFRCCPPTPASNAAVPNFTFPNPGKPLRTRQPAHGAAGANSVSRYARAVALIKALPESNPAQLLPEGPTSTGPYCTPGVPGKAGRPENLPLAKTPFLRGFFLSPFPNGGQTL

SEQ ID NO: 93551 - DNA, 1277 bp, Zea mays
  misc_feature: Ceres CLONE 1582923
  misc_feature: Translation starting site: 185
  misc_feature (263)..(263): n is a, c, t, g, unknown, or other
  misc_feature (281)..(281): n is a, c, t, g, unknown, or other
  misc_feature (282)..(282): n is a, c, t, g, unknown, or other
  misc_feature (284)..(284): n is a, c, t, g, unknown, or other
  misc_feature (299)..(299): n is a, c, t, g, unknown, or other
  misc_feature (300)..(300): n is a, c, t, g, unknown, or other
  misc_feature (314)..(314): n is a, c, t, g, unknown, or other
  misc_feature (322)..(322): n is a, c, t, g, unknown, or other
  misc_feature (329)..(329): n is a, c, t, g, unknown, or other
  misc_feature (331)..(331): n is a, c, t, g, unknown, or other
  misc_feature (338)..(338): n is a, c, t, g, unknown, or other
  misc_feature (355)..(355): n is a, c, t, g, unknown, or other
  misc_feature (358)..(358): n is a, c, t, g, unknown, or other
  misc_feature (363)..(363): n is a, c, t, g, unknown, or other
  misc_feature (507)..(507): n is a, c, t, g, unknown, or other
gggcgcgtggctccctccctgagaaatgaagaagaggacaccaacctgtgttcttgggataaataacaaatcatacagaaaaaactgggactccccgcggtggcggccgctcttgaactagtggatcccccgggctgcatgaattcgtctcacccctagaaaaaagtcagacagccagccagccatggagacggcctccttcctctcagtggcgctggccctggcggccctcgtccccgtctcgctgctccttgtgaaccggntcctctacgggaaaatgnncncggggccgcggcggnntcccggggggggtnacctgttngacgtgnancccatgnggtgccggtgctaccanaantgggnccgcccggaccggcccatcttgactgtctgaatagacacgtcggggacggtggtggagaccacggcggaagatgaaaaaagaggagcaacaagaccctctttcagcttttttgttttaaaaaaacccccccacagggtccaccncaaaagctctcacccctacgtcaggcgagggaccttcactctgtgggccgaacttacgagccctcccaattaataattcaaagaagaaaagcagttccttcgtgactaaacctgcggaaggcctcctttcccacctccaaagcgacgccggtcccctgcaggagtgaccatccaatcgaaaggcctcacaaattaccgcaccgtatagggtaacccttaacggggtccatccaccgaagctctagtgtcgataattccgtggaaggttccctcgcacataccgatataccccagaaaaatgttaccccggatgttcgaagctgacgaggccaaagcgttcttgagggtcgaaaacaatgagatctctgaatgaggaataaaatccctcctcgctcttcggggacttgtgaggtaaaaataagtaaaagctgccatgcgctcttcacttccctaaatgtagtagtcggaccaccatagttcaaaatcaagaaaacaaatctcaacagagctgaggaattggtgacggcctctatgtcggggagacaaaaagatcaatgaaatatcacagcgggaacacccgacgtgacgacccatggtcatatgaaccctagcggaacactaaatacaaacatggaaccactcagacaaaatataccaataagcggggcagatttgaccgcctcatcacaatccgtgcaactgccaacgcaacacgcagtttgccgatatccctttattcgacaatcctgttatacaatattcgacttact

SEQ ID NO: 93552 - DNA, 1212 bp, Zea mays
  misc_feature: Ceres CLONE 1582924
  misc_feature: Encodes the peptide sequence at SEQ ID NO. 93553
  misc_feature (12)..(12): n is a, c, t, g, unknown, or other
  misc_feature (14)..(14): n is a, c, t, g, unknown, or other
  misc_feature (54)..(54): n is a, c, t, g, unknown, or other
  misc_feature (55)..(55): n is a, c, t, g, unknown, or other
  misc_feature (1206)..(1206): n is a, c, t, g, unknown, or other
tttaactatatnanttatcacttaaaatcaacaaaaccacaacaaacaaacacnnaaaaaatccttttcatctccatctggaactccccgcggtggcggccgctctagaacagtggatcccccgggctgcaggaattcgtctcacccctagaaaaacgcaccacgtctcctacactcctccgcctgccgtcctgtcctgcgcccttactcctcggacgccccccacgccaccaatccccaaccccccattccgcactcccctctccctgccccgccgcgcttccttcgctgctaaagcggctgcgatggcgctctgggcgctgccggtcggcttccgcttccaccccaccgacgaggagctcgtcagccactacctcaagggcaagatcaccggccagatcaactccgaggccgaggtcatccccgagatcgacatctgcaagtgcgagccgtgggacctcccaggtaagtctctgatccggtccgacgatcctgaatggttctttctttggcccccaaggaccgccaagtacccccaacggtagccaggttcgaacaagggccacccgagggcccgggtacctggaaagggcttacttggctttggaaaaaggaaaaccatcaaaaatcccaaagggggcgaacaaaagaagcaaaaacagcgttttacccccttccggccaaagaaaaaaaaacaaaccccctttgtgttccttctcccaacaccctgtggggaaaccccccccccccccccaataaagggggccccaaagaccgctcaaaaacaaggggggcttcgggcgaaaatttatattgtgcgccaccccaagaaagttataccctccgcccatacccctctccccgggagaaaccccctatcacagattttacccaaaaagtttcttttggggaaacaaaacacacaaaggtgggtggggggttataaagggttattccacttttaaaaagccggcccaccactctttcttgtgggaaaaaaccccgtcaaggggaaaagaaaaaaaactgcggttggccccccctcccaaggccccccctaaaaaaataaaattgggaaattataaatagtggggcaaaaaaatctgacccttataaataaaatctcccccgcgtttcttttaccaggtgtaaacaaacccccgaaatgcctcaataatatgggaaaaccttaatataacccacatnttaaaa

SEQ ID NO: 93553 - protein, 79 aa, Zea mays
  misc_feature: Ceres CLONE 1582924
  misc_feature (6)..(80): Pfam Name: NAM Pfam Description: No apical meristem (NAM) protein
MALWALPVGFRFHPTDEELVSHYLKGKITGQINSEAEVIPEIDICKCEPWDLPGKSLIRSDDPEWFFLWPPRTAKYPQR

SEQ ID NO: 93554 - DNA, 1291 bp, Zea mays
  misc_feature: Ceres CLONE 1582929
  misc_feature: Encodes the peptide sequence at SEQ ID NO. 93555
  misc_feature (749)..(749): n is a, c, t, g, unknown, or other
  misc_feature (1199)..(1199): n is a, c, t, g, unknown, or other
  misc_feature (1223)..(1223): n is a, c, t, g, unknown, or other
aactaggtggacacataccggaagagattacaatccttctttctcggttgagggctctaaccacaggagagaaataaaaatactaacactccccgcggtggcggccgctctagaatagtggatcccccgggctgcaggaattcgtctcacccctagaaaaaatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcacctacaatccaagtttatgagggaaagggggcccccctccaggttaatgacccttgtattgagaaacaagaaaaccctccttttcagttgaattggggacctggaaattcctttggaaactttttttgacgggaatcccagccggcctttaaaaaacccatcgggcttgtttaaggtcccggggagaatggtggataattcccctccctgggtagtatttccagattctcttggcccctttgaaacaaaagagttgttatttgggggggggaaaaatttcctgccccgaaccaagagactttngagggtggtttgggggagaattgttctatcttctcccaggggtgtggggaggaaaccctcttttacgccgcgtatcgcagggtgtttttgttgtagtgaaacacccacagacatttgggacagtgccccgacgcagcacccccacagggaggttgttatgtcccctttagtagagcagcggggtggggtattgctcaatggggagggggaagaaaaaaataataaaggtttgatcccattttgtgagcacctacgcgcactgtgtagagtcgatatagtacaaactccctgatgcgcggggctatcacagcgttcgtgccccacagagagtattgggataaattatctgccggggggcgcgttaggagataaacggaaaaattgtcaaccagtggcgcgcttgtgagaaagagggggggacggttgagggtggttatcaacacaacaggnccatgtgtgtgtacaagtcggaancgctttgtctgtagcaagaaatagcctcgcctgtttcgcggataaagagggagacatcgtgatctctg

SEQ ID NO: 93555 - protein, 104 aa, Zea mays
  misc_feature: Ceres CLONE 1582929
  misc_feature (22)..(85): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MAYGDRVTTFEDSEKESEYGYVRKVSGPVVVADGMGGAAMYELVRVGHDNLIGEIIRLEGDSPTIQVYEGKGAPLQVNDPCIEKQENPPFQLNWGPGNSFGNFF

SEQ ID NO: 93556 - DNA, 847 bp, Zea mays
  misc_feature: Ceres CLONE 1582930
  misc_feature: Encodes the peptide sequence at SEQ ID NO. 93557
  misc_feature (41)..(41): n is a, c, t, g, unknown, or other
  misc_feature (56)..(56): n is a, c, t, g, unknown, or other
  misc_feature (847)..(847): n is a, c, t, g, unknown, or other
acccgcgggtggcggccgctctagaactagtggatcccccngggctgcaggaattncgtctcacccctagaaaaaaaaaaaaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctcgcttggtgagcaaagcggggggcaacagcagcgggatccccgtgctggtcgacgaagacgacccgctcgcgctcgaatcgtttctaaacatcactctggtgaacaaggcagggcgctccgtaagctttaaagatggatgtatccagagcctactttcgtggcttacgtaccagggcagcgcttcgtgcctcctcaagagattcaagccgcacgtttcttcgtcggggatctgttactacggggggccccgtggggaaaaagtttcgggtcctggttgtccgcgaaccggggtccacttcccaggggcaatgaaccgtttttgtttcccggggaaaaggaaaagggaaagaaaccttgggggtcccgccccatggcccaagccaaaaaaatctcggaaaaagggccacctcccgcccccgggtttccctgttttcccccactggggaaacccn

SEQ ID NO: 93557 - protein, 222 aa, Zea mays
  misc_feature: Ceres CLONE 1582930
MKGGTQAVSLMVHLAVPWLCLASWAALLPALASGNVGAAAPILRADYIKLNFSTASATPDKYKSFIASVRARLVSKAGGNSSGIPVLVDEDDPLALESFLNITLVNKAGRSVSFKDGCIQSLLSWLTYQGSASCLLKRFKPHVSSSGICYYGGPRGEKVSGPGCPRTGVHFPGAMNRFCFPGKRKRERNLGGPAPWPKPKKSRKKGHLPPPGFPVFPHWGNP

SEQ ID NO: 93558 - DNA, 1156 bp, Zea mays
  misc_feature: Ceres CLONE 1582931
  misc_feature: Encodes the peptide sequence at SEQ ID NO. 93559
  misc_feature (468)..(468): n is a, c, t, g, unknown, or other
  misc_feature (469)..(469): n is a, c, t, g, unknown, or other
aaacgggggaacaaaaccacaaatatacaacccccctaatcggttccccattacaactcccccaccccaataatactaaaaatcaccgccgtggcggccgcatcccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcaaatcttctcggagggcgggctggactacctggggaaccccaaactggtgcacgcgcaaagcanncccgccggctgggcgtgccaaggggggctcatgggctttcgtccagggcttaccgggttcgggggcgggcccccctcggggaaagggttccaacaagggggtaccccgggggggggccctttcaacccccttgggggcctctccccgaaaaaacccggaaaaaccggcccccccgaaagcttctagggggggaaaggaaggtttcaagaaaaccgggccgccccccttggtccacagggtgttctcccaagggtgttcggggggttttctttttcttgtggaagagagccccatatccttctcatcctcgtggaaaagaggaggggggccccccattctcggagagaaaaactctttcttgtttgaacaaacaaagtttatcgctcgaaacacccccgcttttgccccaaaaaagatacgcccccgggggggtaaaatctcccccaacaaaaaattttttttttctccccggggaaacataaaattggttcctgaggagcacgacccgcgggaaaacggtgggttatatccccccgcttgagaccccaccccactttttctccccccccccttcaagagggaacacatggtggggcttctcccgggggacctctactcttgtaataaaaaataaaggcggctataaattttcgcccccgccggcgatattatccattgctaagatgg

SEQ ID NO: 93559 - protein, 182 aa, Zea mays
  misc_feature: Ceres CLONE 1582931
  misc_feature (28)..(177): Pfam Name: Chloroa_b-bind Pfam Description: Chlorophyll A-B binding protein
  misc_feature (121)..(121): Xaa is any aa, unknown, or other
MRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPKLVHAQSXPAGWACQGGLMGFRPGLTGFGGGPPSGKGFQQGGTPGGGPFNPLGGLSPKKPGKTGPPESF

SEQ ID NO: 93560 - DNA, 808 bp, Zea mays
  misc_feature: Ceres CLONE 1582933
  misc_feature: Encodes the peptide sequence at SEQ ID NO. 93561
  misc_feature (808)..(808): n is a, c, t, g, unknown, or other
acccgcggtggcggccgctctagaactagtggatcccccgggctgcaggaattcgtctcacccctagaaaaactttccagccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtggggagagggatctgttcccgctgttaccggaggccttcaagggaatcaaacagatcggtgtaatcggctggggctcgcagggtcctgcgcaagctcagaacttgagagactcacttgttgaggcaaagtcagatattgttgttaagaatggtctcccggaaagttctaaatcttttggaaaagcccgagcagcaggattcacccaagagagtgggacgctgggtggatatatgggagactgtattcaacaagggatcttggtttggctacggaaatctgaatccgcccagggcgaataactacgaaaaaattttctcgcacatgaaaccaaaccatatttctggggtttgtcacaatggatttctccttggaaaattggcaaacccccggggttttgaatttcccttaaaaan

SEQ ID NO: 93561 - protein, 127 aa, Zea mays
  misc_feature: Ceres CLONE 1582933
  misc_feature: SWISSPROT Homolog: EC 1.1.1.86 Ketol-acid reductoisomerase
MPSLDFETSVFKKEKVSLAGHEEYIVRGGERDLFPLLPEAFKGIKQIGVIGWGSQGPAQAQNLRDSLVEAKSDIVVKNGLPESSKSFGKARAAGFTQESGTLGGYMGDCIQQGILVWLRKSESAQGE

SEQ ID NO: 93562 - DNA, 986 bp, Zea mays
  misc_feature: Ceres CLONE 1582935
  misc_feature: Encodes the peptide sequence at SEQ ID NO. 93563
  misc_feature (19)..(19): n is a, c, t, g, unknown, or other
  misc_feature (20)..(20): n is a, c, t, g, unknown, or other
  misc_feature (29)..(29): n is a, c, t, g, unknown, or other
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (58)..(58): n is a, c, t, g, unknown, or other
  misc_feature (59)..(59): n is a, c, t, g, unknown, or other
  misc_feature (64)..(64): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (91)..(91): n is a, c, t, g, unknown, or other
aaaaaagaaaaaagaagannaaaagaaannaagannnttnnaagaattaaannntttnnctccntttnnnccaaagcggagctcacgcggnggctgccgcaatcgaacagtggatcccccgggctgcatccaacggcgcacccctagaaaaatctcctctctggacgaacagaaaggttaccagcagcaccacggcgagatctccccttggcgggccaaaaccgacggcgagcttcaccggcgttggtcggctcccatctcttcgccgttttattttcctcccaggttaaggttgcaggcttttagcttgggattctgaaagatggggacctcttctggcgcgaatttccatcagcaacctcctccgacccaggggatgttgcctccaaggcatggtccacgcccctcagggttgcagacctcgctctcgctggcctcttcggagcaggttggctcgcctgacatgcaggagcctggttcaaactcggagccagggcatgattccgccactgagagcgccagttccaaagacacatggccagctgagccgaaccagagcaatggtggggtggctgccagtgatgttgtgagtaaggcggcggagaaggaggtggcaaatggtgtatccaagccgcaggttatccatggaccctcctcccgtgggagtgggatgcttctgcgggaagttgcacggggagaggggtgatctgggtcgccgaaaagaagaaaaggaagtccggaggaacacccaagaggagggcaaggaagaagccccaggcgaaacccgggagggcactgggagggttctcccaaccacgcaagaagaccctggtacttgcagaaaagccgggcccgggaacagggaatggaattggaacccactcccggggcttttccagtgggcacaccccagggggcaaccttggaaaaacccttgggtggcgaatccaaaaacgggggaataacggggccttgtccggcccacc

SEQ ID NO: 93563 - protein, 127 aa, Zea mays
  misc_feature: Ceres CLONE 1582935
MGTSSGANFHQQPPPTQGMLPPRHGPRPSGLQTSLSLASSEQVGSPDMQEPGSNSEPGHDSATESASSKDTWPAEPNQSNGGVAASDVVSKAAEKEVANGVSKPQVIHGPSSRGSGMLLREVARGEG

SEQ ID NO: 93564 - DNA, 1274 bp, Zea mays
  misc_feature: Ceres CLONE 1582940
  misc_feature (71)..(71): n is a, c, t, g, unknown, or other
  misc_feature (820)..(820): n is a, c, t, g, unknown, or other
  misc_feature (984)..(984): n is a, c, t, g, unknown, or other
  misc_feature (1026)..(1026): n is a, c, t, g, unknown, or other
  misc_feature (1074)..(1074): n is a, c, t, g, unknown, or other
  misc_feature (1094)..(1094): n is a, c, t, g, unknown, or other
gagcaagaggataaacgtaattcctctcatttacaccccaacgcgggccgaaccgccgcccgagccgcgtntttatagagctggagctccccgcggtggcggccgctctagaactagtggatcccccgggctgcaggaattcgtctcacccctagaaaaaatcacggagcacgcagcataccatctctcgctcgaagttattattttgatcaggaacggatatggcttctggaaggagtcttctcgctcgctcatcagaatcgagaaccggctgaaggccaccaagcaatgtgctgagtccgatcgaacgccctcgccgttgccgccgctgtgggggacctctcctactccgtggccgcctaggcctatgcgcccgcggccaaagccgtatctgccaccgtcgcggcggccaccgccaacaccgcgggtctcaagatcatcgacgacttcttcctctttggcgccatccgccactcaccccaaggggatctgggccctccagatacctagcctcaattaggggccttcgccccccatcctccggggctaaatcaagttgattcgaaaaagcaaaattcaggtattaatttattaaaaggggggagaaattaactctggggggccaaaaaacaggtgcgggccgctccccaatttttcttaagttgaaaacatccttgggttttccgcgttttttcgtatcaccggtgaggggcgattttccccgaatcccctcaaagaacaccctggggggtttctccccgcctcatattacaaccgcggatatccctcttagtgtttctcgcccacacacgcggttctnttaacacaacctatttatgggacacaccgcccccacctcctaatattaaaaaaacgggtgcttaaagtggttacctgggaaaaacacaaccgagatgtgtgatatattcttaagagcaagggggggtgttccacacctaatatattggaggctaagaacccgtnaacttttttgtctcgccccccctgtattttttttcaggtggntgtgaaagaacacccccacaggctattttatttaatgtaataagaatnggggggcggcccctcacacnacacattgaagaaaattttctctgggtagtatgttgcgaacataataagatgtgggcgcggggaattttttttctctagtgaccaccacgagagaggaggaggggggcggaaaaataatcacgaatactcctcccctacaaggagtgctcggagaattgatgggtgtaaatacacgccgg

SEQ ID NO: 93565 - DNA, 876 bp, Zea mays
  misc_feature: Ceres CLONE 1582942
  misc_feature: Encodes the peptide sequence at SEQ ID NO. 93566
ctccccgcggtggcggccgctctagaactagtggatcccccgggctgcaggaattcgtctcacccctagaaaaactccaccaccagtccaccgcctccatccagcactctccaccgcagcgacccctaaaatcctcgtcgctacgaccaggggatccctcccccaatgcggctgctcccgctcctcctgctcctcctcgccggcgccggcgcccgcgcctccgacgaccccttcctctccggcgcggcgaaccacagctacaacatcgactgcggcggcgcggcggacttcacctcggccttcgggcggcggtggctcgccgaccggttcttctccgcgggcggggccgccggcatggtggcggagccgcaccgcttcccgcagccgcaggagcgcacgctccgcttcttcccgccctcctcggccggcaagtcctcctgctactcgctcccgctcccccccggccgctactacctccgcctcttctccgtctacgacaactacgactccaagctgcgcacgccctccttcgacgtctcccgcgccggcacgcttgtggttctcttccgctcgccatgggccgagcccggcgcgcgctaagggggcttattccgacctaatcttccccttccgcaacggagcccgccctccaacttttggttttaattgggtttccaccgaagcggccccgccgttcgcctccattgagggtttcccccgtccaacccggttgccttaaaaaggggggccccccccggggcccaaaattctgttctttgtaaaataaaggggcgcggttaactcgggggggaaaaaaccctttttgtgggccccgggattttcccaggggggccccgacacccctctttctgcggt

SEQ ID NO: 93566 - protein, 144 aa, Zea mays
  misc_feature: Ceres CLONE 1582942
MRLLPLLLLLLAGAGARASDDPFLSGAANHSYNIDCGGAADFTSAFGRRWLADRFFSAGGAAGMVAEPHRFPQPQERTLRFFPPSSAGKSSCYSLPLPPGRYYLRLFSVYDNYDSKLRTPSFDVSRAGTLVVLFRSPWAEPGAR

SEQ ID NO: 93567 - DNA, 1333 bp, Zea mays
  misc_feature: Ceres CLONE 1582943
  misc_feature (54)..(54): n is a, c, t, g, unknown, or other
  misc_feature (1071)..(1071): n is a, c, t, g, unknown, or other
aaaagaacgaaggagaagaaattatctgactccgcatactactcagggatcaanatacttcaatgggtaatataagtggagctccccacagtggcggccgctctacaatagtggatcccccgggctgcaggaattcgtctcacccctagaaaaaatcactccctcgcctcccccgctgtgccggcctgctcacacagacacacacaccacagcctacagcgcttctgctgctccagctcctcgtaataccgcgcccgcgcgctgttcgttccctggcctctgcttgcttggctcgacgagcccataggttggtggagagggggggcttattgccccacataggagatcgctggacgcgggagggcgcgttgcgcttcggccggtcttcggttcaacgggatcacttggccgcggccgcggttgggccttcggtggccaatgttgacaaataaacaaaagccctcgatacccccccccccaaacatttttgactttgtatcactgaacgccggtttggccggcctcttgttctgtttccgcaccccgaaccggagcctgaccccccatgggcttccccgcccaactacggttcacgttttaaactaacttccaaacggggggagggctgccttaaatcccccgcaatttgagtttcgtccccctccccaaacttttcgaaaccccgggggtcggttcaaccccccgctattctattgtcggggtggtaaaccagtgaatcccccttattgtaatcccatgcgtataccggggagccctcgaaaatatttcttcgggaggattccggtgtattgttcacaagcggtaccgccccccagtgatgaaggtgtggtcattcgaacgcccccccgcagtataaaatagcgcgggagaggcctatctgcacttccgcggcatatacataacatactagacccgtagatggtattagcgagatatcgcccgtttattcgacctcagcaggagttcttgtcactgagttcaccacaccgacaatgacgctctcacaagagagacacgcccggttcgtgtcacttagtctcgtgtacgacntgagtttatggtctggtcgaggatagttagtgttatctaccctccacgtgttgtcatatatattctcgcgtataccctatttctcctcgctaggtggaggagttccaccccgcgtaaaatgttcgtggcgagcccctagattcatataacggatgactgacgggagtgagagtgcctctcagatgtgattgctaggcggagagaacggcgttaacttacccagaccgtatatttatggggtagtgctgaatgcaggaactat

SEQ ID NO: 93568 - DNA, 874 bp, Zea mays
  misc_feature: Ceres CLONE 1582947
  misc_feature: Encodes the peptide sequence at SEQ ID NO. 93569
  misc_feature (874)..(874): n is a, c, t, g, unknown, or other
acccgcggtggcggccgctctagaactagtggatcccccgggctgcaggaattcgtctcacccctagaaaaagcttcgcttccttgctggctgtggctgcttcgtccgtcccacccaatcgccctctcccctccgctccccaggccccagcaggagcagccagcccagccctgacgcttcctccccacccggtgcaatcgctcccagtcctgactcgttcgctggaccgaacaccgcccggtggtgctcttccgccgtgcttctccgggctcctcctcgccgcccggcgcccggcggcgccgtcctggaggttccgtgcggcgccggtcaggcgcgatcggccgtgcggccacccggctctcaggagagatatattgtaaaatggaagtactgcgtgatatgcacctgccaccaggatttggattccatccttcggatactgaacttgtttctcactacctgaagaggaaaatacttgggcagaaaattgagtacgatcttataccagaggttgatatatataagcatgaaccatgggatttaccctgcaagtgcaatcttccaatcgaggacaaacagtgggcattttctttgcctctcgtgacaggaaatacccctactgggctctagggtcaaacaggggcaacactcgcctggttacgggaaaatcaactggggaaaggaccgaaacccctaaaagctgaaagaagccgaactcctaggaaacaaagaaagaacttttattcttttccatgaagggtccggccctcccctcctgggcgaaaaacccccttgaggggggaattatggcctgagagggattccccatggggtggaaaactgaaaagggtaaaaggcccgccccctgtattan

SEQ ID NO: 93569 - protein, 82 aa, Zea mays
  misc_feature: Ceres CLONE 1582947
  misc_feature (9)..(83): Pfam Name: NAM Pfam Description: No apical meristem (NAM) protein
MEVLRDMHLPPGFGFHPSDTELVSHYLKRKILGQKIEYDLIPEVDIYKHEPWDLPCKCNLPIEDKQWAFSLPLVTGNTPTGL

SEQ ID NO: 93570 - DNA, 820 bp, Zea mays
  misc_feature: Ceres CLONE 1582948
  misc_feature: Translation starting site: 328
  misc_feature (384)..(384): n is a, c, t, g, unknown, or other
ctccccgcggtggcggccgctctagaactagtggatcccccgggctgcaggaattcgtctcacccctagaaaaaaggcagagcactgcacgccaccttatctctaaccggagatcaaagaagtagccgttaacgatggcttccgacgagctcgcaaaggccgtcgagcccaggaagaagggcaacgtcaagtatgcctccatatgtgccatcctggcctccatggcctctgtcatccttggctatggtacccacgcaccctttcgttgctgtcaaaatattttcctttttttgcttttaagagttcgtaggtgaagttttttttgtgatgctgttcaccaacgctgtagacattggggtgatgagtggagcggccatgtacatncagaaagacctgaatatcacggacgtgcagctggaggtcctgatcgggatcctcagtctctactcgctgttcggatctttcgctggcccgcgacgtccgacaggatcggacgccgcttgaccctcgtgttccccgctgtcatcttctttcgggggctcgtgcccatggggttcgccgtcaactacgcatgctcatgggggggccctttctggcccggaaatcggtggggcttccggggaatgaatccccccctgtaaccgggcgaaaatttccctgggggggccccggggtttctaaaccccttcccgggggggtgttaaaaattgggaaccgggtggggaacacggcaaaatttggtttgggggggtttccgttaaaaatggggggggggcgtttagtcccccattgggggaattcccccccccccccccccccc

SEQ ID NO: 93571 - DNA, 797 bp, Zea mays
  misc_feature: Ceres CLONE 1582958
  misc_feature: Encodes the peptide sequence at SEQ ID NO. 93572
tccccgcggtggcggccgctctagaactagtggatcccccgggctgcaggaattcgtctcacccctagaaaaaaaaaaaaaaaaaaaactagaaaaagcttgcacggaggcggggtagtagaggacggcctcgcaaggtagctctgctcgagcgaggcagcagcactactcccgttcaggagaggaggcgttctccaccgggtcataggaatcctgacgagatggacggcaatgctaggtcgacggcggcgagtcagaagaagtccatcgtcccggacgacgacctcgtggagctgctctggcacaacggaagcgtcgtggcgcagccccaggggcaccacaggccggcgccgccctccgaccgcgactgcccgggcaccagcggccttactgccgaggagaccgccgcgtggttcccggacaccctcgacgactcgctggagaaggacctgtacacgcagctctggtacagcacgatcgccgacgccgccccgcaacacgagggcatgttcccgggccctacctcgcagccttcgccgccgccgcccgttgcgagcagcggcgtcaagtcgagctgggccggcgacatctgctcgaccttctgcggcagcaaccaggtgcccaggacgccggcagggatcagggggaaggtacgcgcattgcagccggaagtgccgagcggtgccggcgcgcacgacggcacatcgtcatccggtggggtcggaagcaactatgggggatccgggctgcccagtgacagcgtccatgtccacaaaaagaaggggatgtgttgagac

SEQ ID NO: 93572 - protein, 190 aa, Zea mays
  misc_feature: Ceres CLONE 1582958
MDGNARSTAASQKKSIVPDDDLVELLWHNGSVVAQPQGHHRPAPPSDRDCPGTSGLTAEETAAWFPDTLDDSLEKDLYTQLWYSTIADAAPQHEGMFPGPTSQPSPPPPVASSGVKSSWAGDICSTFCGSNQVPRTPAGIRGKVRALQPEVPSGAGAHDGTSSSGGVGSNYGGSGLPSDSVHVHKKKGMC

SEQ ID NO: 93573 - DNA, 881 bp, Zea mays
  misc_feature: Ceres CLONE 1582959
  misc_feature: Encodes the peptide sequence at SEQ ID NO. 93574
  misc_feature (689)..(689): n is a, c, t, g, unknown, or other
tacccgcggtggcggccgctctagaactagtggatcccccgggctgcaggaattcgtctcacccctagaaaaagcccctcctgcccccgctcgccgcgagagctcccgtcccgacgaccttccctcctgtagcactctacagtctacaccaagcagcagcgtctcctgttgcatgttgcactgcacctatctacgacgtccgttcccagtgctttgctcatccaccttcatcaagccaagcgtgtgtcctctccagctgcgagctccgacccccggcaccatgtccgacagcagcgacttcgccgagctgctatgggagaacggccaggcggtggtgcacgcgcggacgaggaaacagccgccccagcagcccgccttcccgcccttcacccccacctgcagcagcagagctcaacaaaggcagccggtgccggcgctgctcaagacgggaggaggtctctttgccgacttctcctcggccaccgccggcctagacgccccccgtcacaacggcgacctcgacgacaccgtgccgtggatccactaccccatccccatcgtcgacgaagccagtcccgccgcgcctgccctggcagatagcttcatcccagatttcttctcggagctgcatgcggcggcggcgacgacgaagctcgggccttttgccaccaccacaccacaccaacagnagtccagcacacccgcgacgacaacgaacaacggaagcaccccggttcccaatcccaccaccgggagaggaacagagcccttcaaggaaacccacggcgcaccaataacaagttccagccgggaagtcttgacccacaacacaagctgtagctcccgcccgcccaggagccctctgagggagaacggcggga

SEQ ID NO: 93574 - protein, 200 aa, Zea mays
  misc_feature: Ceres CLONE 1582959
  misc_feature (137)..(137): Xaa is any aa, unknown, or other
MSDSSDFAELLWENGQAVVHARTRKQPPQQPAFPPFTPTCSSRAQQRQPVPALLKTGGGLFADFSSATAGLDAPRHNGDLDDTVPWIHYPIPIVDEASPAAPALADSFIPDFFSELHAAAATTKLGPFATTTPHQQXSSTPATTTNNGSTPVPNPTTGRGTEPFKETHGAPITSSSREVLTHNTSCSSRPPRSPLRENGG

SEQ ID NO: 93575 - DNA, 830 bp, Zea mays
  misc_feature: Ceres CLONE 1582961
  misc_feature: Translation starting site: 189
  misc_feature: SWISSPROT Homolog: EC 1.4.1.2 Glutamate dehydrogenase
  misc_feature (810)..(810): n is a, c, t, g, unknown, or other
ctccccgcggtggcggccgctctagaactagtggatcccccgggctgcaggaattcgtctcacccctagaaaaacctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatcgctggggtgattgctggcctctatgtgctgcgtatcatcaatgagccatacgctgctgctattgcctatggtcttgacagatggcaaccagcgtcgggtgagagaatgtcctcatctttgaccttgggnagtggtaccttcgatgtctc

SEQ ID NO: 93576 - DNA, 920 bp, Zea mays
  misc_feature: Ceres CLONE 1582976
  misc_feature: Encodes the peptide sequence at SEQ ID NO. 93577
  misc_feature (838)..(838): n is a, c, t, g, unknown, or other
ccgcggtggcggccgctctagaactagtggatcccccgggctgcaggaattcgtctcacccctagaaaaactagaaaaaaagtgatcgtgcacctattcctattggcaaagtggagtctgcaacctccattgttgaacgtttttgtactggtggaatgtccctaggagccatttcaagggaaacgcatgaagctattgcaattgcaatgaatagaataggtgggaaatctaattcaggagaaggtggtgaggatccaatccgttggaatcccctcactgatgttgtagatggttattctccaacacttcctcatctcaagggtcttcagaatggtgacacagccacaagtgccattaagcaggttgcatctggacgttttggagttacaccaacattcttagtaaatgctgaccaaattgagataaagattgcgcaaggtgcaaagcctggtgaaggaggtcaacttcctgggaaaaaagtcagtgcatacattgctcgtctgaggaactccaaacctggagttcctctaatctccccgcctccacaccatgacatttattctatcgaggatcttgcacagttgatttatgacctccatcagataaaatcctaagctaaagtatctgtaaagcttgtgtctgaagctggaattgggactgtagcttctggagtttcaaggcgaatgcagacattattcagatatcaggtcatgaatgtggtactggagctagcccaatcagcctcatcaaacatgctggggggtcgttgggaacttggtcttacagaaacaaatcggacccttatacaaaatggattgaaagaaaaggtagtacttanggttggacggtgggattcgggaaggggcaagagggtcctaattgcggcgggcaagggaagccgaagaaataggcttgtggtt

SEQ ID NO: 93577 - protein, 152 aa, Zea mays
  misc_feature: Ceres CLONE 1582976
  misc_feature (1)..(152): Pfam Name: Glu_synthase Pfam Description: Conserved region in glutamate synthase
  misc_feature: SWISSPROT Homolog: EC 1.4.7.1 Glutamate synthase (ferredoxin)
MSLGAISRETHEAIAIAMNRIGGKSNSGEGGEDPIRWNPLTDVVDGYSPTLPHLKGLQNGDTATSAIKQVASGRFGVTPTFLVNADQIEIKIAQGAKPGEGGQLPGKKVSAYIARLRNSKPGVPLISPPPHHDIYSIEDLAQLIYDLHQIKS

SEQ ID NO: 93578 - DNA, 825 bp, Zea mays
  misc_feature: Ceres CLONE 1582979
  misc_feature: Encodes the peptide sequence at SEQ ID NO. 93579
gcggtggcggccgctctagaactagtggatcccccgggctgcaggaattcgtctcacccctagaaaaagttccccaattcgaaatcgaatcgagtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaacatccccaactccagtttgaggctgcatgggcactcaccaacattgcatcaggcacatcagagaacactaaagtggtggtttgaagagtgttgctgtgccccatcttttgtcaagctactcaactccctcagcggaggatgtttcgtgaaacaggctgttatggggcttttagggtaaagtttgcttggtgaactcccccaaaaatggccgtggatctgggg

SEQ ID NO: 93579 - protein, 157 aa, Zea mays
  misc_feature: Ceres CLONE 1582979
  misc_feature (4)..(97): Pfam Name: IBB Pfam Description: Importin beta binding domain
  misc_feature (106)..(147): Pfam Name: Arm Pfam Description: Armadillo/beta-catenin-like repeat
MSLRPSEREQMRKGNYKQTVDAEESRRRREGQMVDIRKAKREESLQKKRRDGFPASAAGVPPMGHSTALQQKLDGLPAMVQAVHSNDPSVQLEATTQFRKLLSIERSPPIEEVISTGVVPRFIEFLTREEHPQLQFEAAWALTNIASGTSENTKVVV

SEQ ID NO: 93580 - DNA, 1280 bp, Zea mays
  misc_feature: Ceres CLONE 1582983
  misc_feature (998)..(998): n is a, c, t, g, unknown, or other
ttctttttttatttttgattggtatattaccgaaaagtcgtacccagggtattgcggggtcggttttatatttattcaacttccctttcttgaggccggtctataatagtggatcccccgggctgcaggaattcgtctcacccctagaaaaaaggcggacgcgaacaaacccccttattccatagcgagcgcgagcagcggcgcctggaggacgaggactgctgcgatggggggagacgccagcatcataagagggggggccgttcccgcatctctgcggccggtttggtctacccgcgtgcccaacacccccctggtgcgcacggcgtggcgattttacgcgcatggcccgttgagattccaatctcctccgcggcattggggtgtgcattgacgtgggggatgcaccattatttaagataataagttgccaacttcaaagttatttatcgggacataataggatagactagtattggggctccccaccatcgacaagccttatccctgtgtagagcgtacccaagcgaggtaagggattattttttcttgatatgtgagatgaggtacccctctgagtattctttatttttagtactacatagtttcccgcgcgtcccggtggtttataacttgaacaataattaattgcaggcaactttgcgcacctttttttgttttttttggagacccctctatgatttagtttttaccgacttgtgcgcggtgtcgcggaaaatgaagacaccagcgctgcgttgagtaactgtatattatagatttttggtcggcgaaggactaccgtgcggtttcgtaatctataccctcttataactatatccccctgaccctttattgtgcgacggcgtgaccagatctcccgtgcaaagagagcgtatttatcagtatcccttagatatttatgtcccccaccccttattctcttgtaacacacccccctgtatagatatgtatatcgactcgcttattggaaattncgctcgtagagggagtaatatatcgcacgtctactctctacaaaatcatcacggggtatacattagcgcaggacaagtagtatatgaaactatgttatcctcttacgagctagttacgaccacgctgtcatgttttttccgccacgtattttcttacatcgacgacacccgcgtatatattcacaatactgaacttatgacggacggcgtagccataaattcttttgctagtttataccgttcccgctcatcacttcacaatatatacgcgagtaatatttg

SEQ ID NO: 93581 - DNA, 913 bp, Zea mays
  misc_feature: Ceres CLONE 1582987
  misc_feature: Encodes the peptide sequence at SEQ ID NO. 93582
  misc_feature (597)..(597): n is a, c, t, g, unknown, or other
  misc_feature (692)..(692): n is a, c, t, g, unknown, or other
  misc_feature (748)..(748): n is a, c, t, g, unknown, or other
  misc_feature (759)..(759): n is a, c, t, g, unknown, or other
  misc_feature (796)..(796): n is a, c, t, g, unknown, or other
  misc_feature (803)..(803): n is a, c, t, g, unknown, or other
  misc_feature (804)..(804): n is a, c, t, g, unknown, or other
  misc_feature (818)..(818): n is a, c, t, g, unknown, or other
  misc_feature (836)..(836): n is a, c, t, g, unknown, or other
  misc_feature (892)..(892): n is a, c, t, g, unknown, or other
acccgcggtggcggccgctctagaactagtggatcccccgggctgcaggaattcgtctcacccctagaaaaacccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccntgacatggtccacgctttcaagccgaatccaagaccaatttgcaggagaactggagaatagtagatttcttctctcaccaccagagagcctacancatgtcaccttcctctttgacgatgttggcatcccactcaactacaggcacatggnagggctttggntgtcatacctacaccttgatcaacggggatggaaaangctcacnntgtgaaaatccatnggaaagcctacttggggntgtgaaatgctttgctcgacaatgaagctgtgactgttggaagcacctgccacagncatgcgacgaaggatctataa

SEQ ID NO: 93582 - protein, 171 aa, Zea mays
  misc_feature: Ceres CLONE 1582987
  misc_feature (18)..(172): Pfam Name: Catalase Pfam Description: Catalase
  misc_feature: SWISSPROT Homolog: EC 1.11.1.6 Catalase
  misc_feature (152)..(152): Xaa is any aa, unknown, or other
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFXDMVHAFKPNPRPICRRTGE

SEQ ID NO: 93583 - DNA, 2320 bp, Zea mays
  misc_feature: Ceres CLONE 1582991
  misc_feature: Encodes the peptide sequence at SEQ ID NO. 93584
tgagcgctggggcctgggtgggagccaccaggtatgggtctcttccttggctcgcactcagatcggtttcgatgcgtttcctccgtcgacaaggcgcttgcttgtccagtctgcaggaaccaggaacggggctggtgctggtcccagccagtttctctctgtctctccctctccgtgcatgggcccgcccaacttgcaaatatttgaaggcttgcagtgatgttccactgcgtcgggcaggctcggccgctcgggcacaaggaaggctggctggtgcaagtaaagtattattaccgctaccgccacttcaccacgccgtgacagaacagagtgacacttcctcctagagtcctagcgtttcgtttttattacgcggtgatggtgaatgatgaggagcatcatctggactgaaaccaccccaggccccgactccggccaataaccacgcaaccgccaagattagcagaaccccaggattaaccaggccacccccgcgctccagcctcccgcgcccgggccgccctcgggcccttcccccctccccgcgcgatcgccgccgcagcatcaatgcctccacctccgccgccggccgcctgcagcagggggcggtgcagcgcgctcagcttcgcggcggcgcgggaccgctgcttcagccaccgcttccgcagggcggggctgcgcccgctcgccgtgccgctccctggcccgggcccgggccccgacgccgacccggccaccaccgtccacatgtgggtgcccgcgggcccgccgccgcggaacccgctgctcctcctgcacggcttcggcgcctccgccacgtggcagtgggcgccctacctccgcccgctcatcgccgccggcttcgaccccatcgtgcccgacctcctcttcttcggcgcctcctgcacgcgcctccccgatcgctccgacgccttccaggcctccgccatcaaggccgccatggacgccatcggggtccccaggttcggcctcgtcggcgtcagctacggcggcttcgtcgcctaccggatggccgccatgttcccggaggcggtccaccgggtcgccctggtctgcgctggggtctgcctcgaggagagagacctggcggagggcctcttccccgtggccgggatcggggaggccgccgcgctgctcgtgccgcaccgcccggaggaggtgcgccgcctagtccgcctcaccttcgcgcgcccgcccctcatcatgccctcctgcttcctatgggactacatcaaggtgatgggctctgatcatatccaggagaaagctgagctgctatacgctttgattaacgggaggcaactctgtactcttccaaaattgacccagccgacgcttataatctggggagagcaagatcgggtgttcccaatggagctggctcacagattgaatcggcatctagaggggaattctcgattagttgtcataaaaaatgctgggcacgcggtcaatatcgagaagcccagggaagtgtgccggagcatcattgagttcttcaaggagccggtcgctggagctgcaaatgcggacgacaaggtgtagtagcttccaccaatggcggacgtggataggttttcgctgggcatcggcagacggcacacccgcttgtggaacgcaaacacaaggcagatacgtggcattgtacatctacatccctctgccattgttctgatgtacttaaagggtgtatgtagagtcattgcagtagcgattcataaagcatgtaacggggaacagagggaaaccatagtggctcaaatccgagtgaaaccactgtgttgttgccgttctcggatccctgcccgtatcgcatttctcctgccatgacgaccacatggcaaatcgcgggtgacatccggcactcatgcggcaagccggcaacgtgtcgcagaaactatggagtgttggtgcatggaatggaagcatacgagtacgatttgatcggtccctgtctaaaatccagcatatgatcccagcgactacaacgcgaccctcgcgtagtcgcgtgtaagagcagtcttttattcatgggccgccgcagtccattgttcgttgaacacacccgaccccacggcccgtcagcccaacaaagttaagctggaggacaaaaaaattatggggtgagagaggctcgaactctcgacctcaggataactcaacttagctatgagacctacgcgctagccaactgcgccaccacccctttgtgataaagtgtactataaatttaatgtaactatataacaggccggagacattatgcttcagttaactccaagaaaaaaaaaaaaaaaaa

SEQ ID NO: 93584 - protein, 332 aa, Zea mays
  misc_feature: Ceres CLONE 1582991
  misc_feature (99)..(316): Pfam Name: Abhydrolase_1 Pfam Description: alpha/beta hydrolase fold
  misc_feature: SWISSPROT Homolog: EC 2.3.1.12 Dihydrolipoyllysine-residue acetyltransferase
MPPPPPPAACSRGRCSALSFAAARDRCFSHRFRRAGLRPLAVPLPGPGPGPDADPATTVHMWVPAGPPPRNPLLLLHGFGASATWQWAPYLRPLIAAGFDPIVPDLLFFGASCTRLPDRSDAFQASAIKAAMDAIGVPRFGLVGVSYGGFVAYRMAAMFPEAVHRVALVCAGVCLEERDLAEGLFPVAGIGEAAALLVPHRPEEVRRLVRLTFARPPLIMPSCFLWDYIKVMGSDHIQEKAELLYALINGRQLCTLPKLTQPTLIIWGEQDRVFPMELAHRLNRHLEGNSRLVVIKNAGHAVNIEKPREVCRSIIEFFKEPVAGAANADDKV

SEQ ID NO: 93585 - DNA, 1214 bp, Zea mays
  misc_feature: Ceres CLONE 1582994
  misc_feature: Encodes the peptide sequence at SEQ ID NO. 93586
  misc_feature (10)..(10): n is a, c, t, g, unknown, or other
  misc_feature (14)..(14): n is a, c, t, g, unknown, or other
  misc_feature (755)..(755): n is a, c, t, g, unknown, or other
attaattttnattnttaataatatccctcttttttccccaccttcattatttattgcttatttcgtgtcataccggattaaacatctctatgtggtggccgccgctctaaactagtggatcccccgggctgcaggaattcgtctcacccctagaaaaacctgttccccgcccggcgcccgcggcccgccgctcaaacccctaaaccctagccgcaccagcgccctattccctccttcggcggctccggcagcgagcggtcactagcaaccagcatcgtacggcgaagaagcgccgtttacacccatctggcggacatgccgctggggcagcgtccgggggacaagagtgacgcccgctactgcggggtggaggtgctctacttccctgccggcgagagactccccgccgttctcaaccactccctcgcctccagcccttcgaacttcatcctcgtccctctggctgaccccccagtacccggggcggtgcccggggacccgattacttgaccccgagacgggcatccgaccctcatccccttatgtgaccccggcccaaatggaaaccaaaacccaccttcctcgggggaaataatcaaccgcaagggggaattggatattttgcaattcctgaaagaaataaaccgggattccccaacccttgaaagttccccaaatctttatacccattaaaaagcaggggtagaaatttggccgggggggagggcggttatccatccacagagcttctcacntttttgcccatggggcaaatggtgggattaccccttctccttctcatggccccccctccccgcagtgaagaaagataccttctgttttatggggtggggcgcgaaaactattgaagggcgcgcagatactaaccgcgctgcgagaataataaaatagattttgtgcgcaaagaggggccgcgcgcgcaacccaccattattagactcgttcttgttgtggatctaatacaagctcagtgttctcccacttagttggaaaaagaagtctcgggacgcgccttcttggggatatggaaataacaaacacgttgtgatccacagacataagagacgaatatgaactagaacgctaccccctccttgtaccatcagaagcgtacaaacaatgtggtttaagaactcatcagggggtaatccccgagagggagatgtaccacttcctgcaaattaggggtttcg

SEQ ID NO: 93586 - protein, 64 aa, Zea mays
  misc_feature: Ceres CLONE 1582994
  misc_feature: SWISSPROT Homolog: EC 2.1.1.125 Histone-arginine N-methyltransferase
MPLGQRPGDKSDARYCGVEVLYFPAGERLPAVLNHSLASSPSNFILVPLADPPVPGAVPGDPIT

SEQ ID NO: 93587 - DNA, 819 bp, Zea mays
  misc_feature: Ceres CLONE 1582995
  misc_feature: Encodes the peptide sequence at SEQ ID NO. 93588
ccccgcggtggcggccgctctagaactagtggatcccccgggctgcaggaattcgtctcacccctagaaaaaatcggacttcccaagggtcggctaggtggtctccaagctttccgcctttccacgccaccattctccccacccgcgcctcagcaatccagcatcgccgtttcgccgcggcaccgacacctcaccggccatgggcgcgtcctcctcgactggtaacccgtccccagaggcgcacgagcagcgggagcaggagaccctcgcctccgccgccctctccctcccgctcctccgcgccgccttctcccgctccgccgccaacgcgctgtcggatgccctcgcgccgccgcccgcctcctttcgtctgcccggatccccggcgccgccgccgccgcacttccacgacatcctcggggggctcggccccgccatcgcctcccaattctttggccacgaagctgccgcggtgacggacgggggcgccgggtgggtccagttcctcagggggttcaaccgctgctgcgcgcgcgtgacggcctcccgctcgctcgcactgctcctccgcgtgtacgctgccgcctgcgccggcgcgggggcaccctgcggcgtccagctccagccggacgagggcggtggtgacgaggatgggaaggtcgtgggggagctcgcgccggaggagatcgcagtgttcctctgggtgtgctgggtcatggcgtggagcgcttcggcctcgagggtggtcagtgacggaagagaataatcggagcccgtcacggtgctcctcccggacgtgacgcacctggtgctgtcggc

SEQ ID NO: 93588 - protein, 188 aa, Zea mays
  misc_feature: Ceres CLONE 1582995
MGASSSTGNPSPEAHEQREQETLASAALSLPLLRAAFSRSAANALSDALAPPPASFRLPGSPAPPPPHFHDILGGLGPAIASQFFGHEAAAVTDGGAGWVQFLRGFNRCCARVTASRSLALLLRVYAAACAGAGAPCGVQLQPDEGGGDEDGKVVGELAPEEIAVFLWVCWVMAWSASASRVVSDGRE

SEQ ID NO: 93589 - DNA, 894 bp, Zea mays
  misc_feature: Ceres CLONE 1582999
  misc_feature: Encodes the peptide sequence at SEQ ID NO. 93590
  misc_feature (15)..(15): n is a, c, t, g, unknown, or other
  misc_feature (16)..(16): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
tttctttattatttnnattatattctcggtttatttttattatagaaatgtatagtaccctcaccttggtgtgttnnnncaagttggagctcacccggtggcggccgctctagaatagtggatcccccgggctgcaggaattcgtctcacccctagaaaaaagaccccaggctctcccacccacctttcccctctgcctccctcctccccgtcccacgccgccgcacccccgcctggctgcttgggtggcaatccgccgtagaggaggagggtgtaggagcttgatccgggccacctgccccctgcgccgtcgggatgtacgtgacgccgccgcccaccggtggcgccggatagcagcctagggtttaccacgtctggtggggaagcaacgaattcttcttgcagggaagattcatattagacgcctgaaagagagatcagggaatctcactatgttcctcatcatcgaacatggggggaccttccgtgtatacgtacgccgggatcgaaacagagatcccccccaacgccggggaatctcagggatggtaggacccgctgtccaccatgggtctcaggggaccctccttcattatccctgtggcagagatcatcgaactattgaccacactactcatcctcctgaacctgaatacattgatgagatgcacgatacacgtgttcaaactccacaccaatttcgttggcctcgaccaaaggaacacgttctacatgggatcactgctcgggggaaaatattggaaaacctgttccggtggcacccgaccctcctcaaaggctatcactgacctccctttggagaaccactgggcgtgggaacagtcctgaaaccaatcccctggacgcagggggtccgggggccctacgggtagt

SEQ ID NO: 93590 - protein, 118 aa, Zea mays
  misc_feature: Ceres CLONE 1582999
MFLIIEHGGTFRVYVRRDRNRDPPQRRGISGMVGPAVHHGSQGTLLHYPCGRDHRTIDHTTHPPEPEYIDEMHDTRVQTPHQFRWPRPKEHVLHGITARGKILENLFRWHPTLLKGYH

SEQ ID NO: 93591 - DNA, 1162 bp, Zea mays
  misc_feature: Ceres CLONE 1583010
  misc_feature: Encodes the peptide sequence at SEQ ID NO. 93592
  misc_feature (7)..(7): n is a, c, t, g, unknown, or other
  misc_feature (907)..(907): n is a, c, t, g, unknown, or other
  misc_feature (1019)..(1019): n is a, c, t, g, unknown, or other
taagacnttgtttgttttttcagttttataccggaacacgccaacatccaactatacataataaagaggagatatttaagctggaactccccgcggtggcggccgctctagaacagtggatcccccgggctgcaggaattcgtctcacccctagaaaaatcagtcatcacataccaccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcacccccatgtccacgcagatcttctgcggccagctcggcaacctcgagctcgccgcctcctcgctcggcaacaccggcatccaggcccttggcctacgggcctcatgctggggcatgggcaagccccggtgggagacgtctgtgcggggcaaggcgtaacgggcgcgccacaaagccaccgccattgcctgggggggtgtaaccctggcaagccgcctccgaaacgggtggcctgtgcttcaatggggccccaacccggcccggtggcccgcgcgctgaaaacccgatatccggttctaaacggccccttttttccttcgggaaagccggaccatttccctgtgagatccccattcccttacccggggcgaaagatcccaggaagcacgccctatttcctccccaaggggggcacgcgcccacgaccgatntccatttccgattctcaacgcggggggtctctaattcctcccgccacaaaaattctcttgcggccggtgtaccgcgcgggagccaaaaaattttttcctccccccaaccccnagaaaaaaaatttcctccttgcccagagggcgccacacgaaaaccaactccctgtgggagggaccccccaaaaaacagctctttacatattctcttcgcgggggggcccacacacactctgcgcgccccctctcccccccccc

SEQ ID NO: 93592 - protein, 129 aa, Zea mays
  misc_feature: Ceres CLONE 1583010
MDSTTTAPLLQPSAASSKEGPGPAPAQHGEGSRELEAILADASKPWAWRAWEGARLELPLLLRVALPAVAVYMINFVTPMSTQIFCGQLGNLELAASSLGNTGIQALGLRASCWGMGKPRWETSVRGKA

SEQ ID NO: 93593 - DNA, 804 bp, Zea mays
  misc_feature: Ceres CLONE 1583012
  misc_feature: Encodes the peptide sequence at SEQ ID NO. 93594
  misc_feature (696)..(696): n is a, c, t, g, unknown, or other
  misc_feature (795)..(795): n is a, c, t, g, unknown, or other
  misc_feature (796)..(796): n is a, c, t, g, unknown, or other
ctccccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtccctcacactggctcccccatcaccgtgcctgttggcagggctacccttggacgtatcattaatggtatcggtgagccgattgatgagaagggtgatantacgacaaacacttcccctcctatcatcgtgaagcccctgcttttcgtgagcaggcactgagcagcaaatcttggtactgggatcaaagtcgtggatcnntctgcacc

SEQ ID NO: 93594 - protein, 199 aa, Zea mays
  misc_feature: Ceres CLONE 1583012
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (180)..(180): Xaa is any aa, unknown, or other
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVPHTGSPITVPVGRATLGRIINGIGEPIDEKGDXTTNTSPPIIVKPLLFVSRH

SEQ ID NO: 93595 - DNA, 706 bp, Zea mays
  misc_feature: Ceres CLONE 1583015
  misc_feature (289)..(289): n is a, c, t, g, unknown, or other
  misc_feature (353)..(353): n is a, c, t, g, unknown, or other
ggagctccccgcggtggcggccgctctagaactagtggatcccccgggctgcaggaattcgtctcacccctagaaaaaggtttcgactttcgagctacagagaattcgtcccggaaaagaaaaaaaatcacccttccatccgcgagagagagagagaggagtgggaggaccggaggaggagttcaggagggagaggtcggcggcggcgcggcagatcgggttgcaccgtgcagctcgggccttaggcgcaccagcggtggggggatccgcgcgcccatgcgccggtganggtggtggggcccgcttggcgctcgagttggaatggcggcgtcggcgtcggctgggaggtggtngggcggtggtccttgcggtcgcggtgctgctcgggccgggacgggtcgtcgccaacaccgagggtgatgccctgtacagcctgcgtcaaagcttgaaagatgctaacaatgtctttgcaaagttgggatccccctcttggttatccatgtacatgggttccttggttccgtgtaaccacgataaccggtggttttccggagtttgacccttgggaaaatggcccaaatttttcctgggcggttttcttgttgggcccccacccctttggggccccggctggaaaaaaaattctcccccaaatttttttgggggaagcctttttttaccgggggaaaacccaacccctttttgt

SEQ ID NO: 93596 - DNA, 1028 bp, Zea mays
  misc_feature: Ceres CLONE 1583016
  misc_feature (67)..(67): n is a, c, t, g, unknown, or other
  misc_feature (480)..(480): n is a, c, t, g, unknown, or other
aaacaataatacacaaaataagaaagtaacatccccccccacccccccccccccccaaatacccccnaaactcaaaaaactggactccccacggtggcggccgctctagactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgaatagctacctcgcggcgtcagcgtcggcgtccccaccanccacaaagaacgacggagcggcgtcggtggcggccagcgaccccgacaagctcttgagcctgctgccgtcgccgcccatgaagctccccatcatcgggcacctgcacctgatggggggaaatcccctacgtggtcccttcgccgcgctcgccaccaggtacggcccggacctgaagctgcttccgcctcggcgccgtagccgaccgtgggtgggtcttcttcgcccacgcgtcgcccaaaggcccgtgcctccgcaccctttagaaacaagttcttttcacctcccagtccggagattccctgggtgtccgaaaattaatccatgaccgggcccccccccaacaccgggcttttcgcggccctacgggagtaccacttaccccccaagggcgcggaaaacttgggtcaccgggtgacccccgtcttcaaactcccacacaatggggacgggttctccaaacgggccccacccctgggaaaaaaataaaaggaggcctcactccaccacactcgcaataaggttggagcccctcagactccacccaccc

SEQ ID NO: 93597 - DNA, 852 bp, Zea mays
  misc_feature: Ceres CLONE 1583017
  misc_feature: Encodes the peptide sequence at SEQ ID NO. 93598
ctccccgcggtggcggccgctctagaactagtggatcccccgggctgcaggaattcgtctcacccctagaaaaaacggggagcagggcacacgcggcgtagtagcgccaagcgaggccgcggccacgccttctccaccgttcgtccgtccattcccattctcatttccatttgcctcgctcgccttcctcctccccactccactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcatttttgggtggtggtaccgggactcagcttttccctctcacaagcacaagggccacccctgctgttcctattggaggatgttacaggcttattgatatccccatgagcaactgtttcaacagtggcataaacaagatatttgttatgactcagttcaactcagcttctcgtaaccgtcacattcatcgttactatcctgtgatgggggggatcaacttcacg

SEQ ID NO: 93598 - protein, 100 aa, Zea mays
  misc_feature: Ceres CLONE 1583017
  misc_feature: SWISSPROT Homolog: EC 2.7.7.27 Glucose-1-phosphate adenylyltransferase
MLAQTLLSSEHPFGGIMLILMKSLPSFLGGGTGTQLFPLTSTRATPAVPIGGCYRLIDIPMSNCFNSGINKIFVMTQFNSASRNRHIHRYYPVMGGINFT

SEQ ID NO: 93599 - DNA, 1150 bp, Zea mays
  misc_feature: Ceres CLONE 1583018
  misc_feature: Encodes the peptide sequence at SEQ ID NO. 93600
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (1146)..(1146): n is a, c, t, g, unknown, or other
gcgggggggggcggggggcccatggacccccgtctccatattttcccaatccaaaccccccctnnnnngaaannnnnnnaaactggagctccccccggtggcggccgctctagaactagtggatcccccgggctgcaggaattcgtctcacccctagaaaaaaagcacggtttcagttcaaaaccattctccactgttcctccgactccctctgtctcgtcgtctcccaatctacgagctagaggatgcccattacaccacgaccaactcctacctcacacgccccactgcacggaccaaagatgtctcaaccgcaaggtgtggaggagccgccccccgcaccgctgccgagccgcgaaggcgaggcacaaccaggcgccgatatccccatgagcgaggccgcggcggtggaggatgaggaggaggaacccgtcgtgggggaaggggaggaccgttcacacggggcctccgaccccgacgattccgtcaatgcttcaacgaaaccccaatcatacggcgcgcgacgaaggggggcaacaacctggcaagagccttaaatgggggcccgaaccgcacgattttggttggcccaggtatcatgaaatctcgcagaaaatgggggacacggcccctgtacaaacagggttgggatcagcactcggtttagcccctgagcggcaacgtcccggtaagtatattctttgcgccggtttgccccaaaactagacacaggccacacatgatcggttggactaacatcttggaagatcaaggcaaccgcgcccccatgaacgaaataaccgagaggagggcttgtttgtaacctggcgaacgccccccttggcttttgtatgggggagcggggatataccactgtccccctcttgcgctataacaagacttatcgcggccgaatacaccaaagaaatctcgaatactccggtgtggttccccgaattcatgaggaacacctcctcctgtatctcgcagatccacactctagtcttgtcgtgctgtgtcactcgtaaaggatttctctgggaccacatgcggttgtcgggcgtagtaaccttagtggtacactcaccacactcacctgctttctcccgcatcgctcctagaaacaaatagacacatcagccatantcaa

SEQ ID NO: 93600 - protein, 84 aa, Zea mays
  misc_feature: Ceres CLONE 1583018
MSQPQGVEEPPPAPLPSREGEAQPGADIPMSEAAAVEDEEEEPVVGEGEDRSHGASDPDDSVNASTKPQSYGARRRGATTWQEP

SEQ ID NO: 93601 - DNA, 1269 bp, Zea mays
  misc_feature: Ceres CLONE 1583019
  misc_feature: Encodes the peptide sequence at SEQ ID NO. 93602
  misc_feature (1022)..(1022): n is a, c, t, g, unknown, or other
  misc_feature (1116)..(1116): n is a, c, t, g, unknown, or other
attaaaaataagtattgttaaaaaatatataatggtcatcttttacattagaaataacccccacctctattatctaaactccccgcggtggcggccgctctagaatagtggatcccccgggctgcaggaattcgtctcacccctagaaaaatctcaacgcaaacccaactgtcttggttgcgcaagcaccaagcatgtggaagatgatggaggtggcgggctcaggcccgcgcggttcccctcctgctccgcaacaccgcctccctgcggacctccgtctccgtctcctgcacagaatcccgtcgtgactgggtggcggcggccacggcggagggggacgagacccgcggcttctacaaggtgcccatggacacccccggcgcgtaccgcctggtaaaccgggacaccggccgcagcgtcatcgtgtggggaggcaccgatgacagcgaccaaggcctcaatgccccccccgtgcggtgctctttcggatccaccgaccgccgcctcagcccaaggtgtttggggaaagcaacgggtcattggggaaatttcctggcaggtttcaaggttgccaaaaaataaaataccattggtttcaaaagggtcccttttactccccaagtaaaggaaaaaaattcccaatccggcccgaaagaaccttgccgtggggtgtgaagatgaaaacttacctttccagatggcgcctccgggatggaatgtaaataaaggaaaaagtgcttatcttctcggaagattataaataaaaaccccactgggtccttctaataaacactctcggaataccgctcgcccccccctccgaatggaaatgagaatctcatgttgcgcaccctcctccccggaagaatatggcaaacggaaaccttcgccgagaaatgagcgcgcaatatttgtcgcccggtaaacggatttcggttgatatcgtggaggtctcccatctacatccctaataacgttcaacagagatgtattattaccggagactatttgcgcctttatgngtactctcaaacagagactaattctttttgtgtggggtatctccctccgctccctatgagagcgggtgtaaaatttgctacacgcccgcaacantatcgaatacttaatattgagaccggagcgataacgatcccaagtaattcacttactcgaatagagccgcgcccgcatcagaataatacagccctgctctagagaaaaaaaaagtgactacctctatctgtgtaagaggcgacccgtcttttt

SEQ ID NO: 93602 - protein, 71 aa, Zea mays
  misc_feature: Ceres CLONE 1583019
MDTPGAYRLVNRDTGRSVIVWGGTDDSDQGLNAPPVRCSFGSTDRRLSPRCLGKATGHWGNFLAGFKVAKK

SEQ ID NO: 93603 - DNA, 878 bp, Zea mays
  misc_feature: Ceres CLONE 1583027
  misc_feature: Encodes the peptide sequence at SEQ ID NO. 93604
  misc_feature (416)..(416): n is a, c, t, g, unknown, or other
  misc_feature (417)..(417): n is a, c, t, g, unknown, or other
  misc_feature (425)..(425): n is a, c, t, g, unknown, or other
  misc_feature (428)..(428): n is a, c, t, g, unknown, or other
  misc_feature (431)..(431): n is a, c, t, g, unknown, or other
tggcggccgctctagaactagtggatcccccgggctgcaggaattcgtctcacccctagaaaaaagccgcttcccccctcccctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatggcggcggcggcgggagcaggggaacaggaggaggaggacgtggatgagctgctggccgcgctcgggtacaaggtgcgttcgtcggatatggcggacgtcgcgcagaagctggagcagctcgagatggccatggggatgggcnngcgtggcngcnccngccctaccgctgatgacggggtcgtgtcgcacctcgccacggacaacgtgcactacaatccctccgacctgtcgtcctggggccgagagcatgctgttcgaggttaaaggggcccccggggccgcttcccgccggggaaggcgggcccaagggttcgggtccaaattggccaacgtaaaaaaggcgcccgccccccgggggggggaaacttaaattccccgccccccgggggacctcccccacaaaacccaccctttcgaaaaccaaacccccccccgggtggggggccctttgggccaaccccttccaagaataggggggggggaccccaaaccataaaagaaatggggggggggaaaaaaattttccccccttttcccccgggaaaaaaagggagggggggggccacataaaaaactcccggtgtaaaaaaactcccccccgcga

SEQ ID NO: 93604 - protein, 110 aa, Zea mays
  misc_feature: Ceres CLONE 1583027
  misc_feature (71)..(71): Xaa is any aa, unknown, or other
  misc_feature (74)..(74): Xaa is any aa, unknown, or other
  misc_feature (75)..(75): Xaa is any aa, unknown, or other
  misc_feature (76)..(76): Xaa is any aa, unknown, or other
MKREYQDAGGSGGDMGSSKDKMMAAAAGAGEQEEEDVDELLAALGYKVRSSDMADVAQKLEQLEMAMGMGXRGXXXPTADDGVVSHLATDNVHYNPSDLSSWGREHAVRG

SEQ ID NO: 93605 - DNA, 978 bp, Zea mays
  misc_feature: Ceres CLONE 1583028
  misc_feature: Encodes the peptide sequence at SEQ ID NO. 93606
tcaccgcggtggcggccgctctagaactagtggatcccccgggctgcaggaattcgtctcacccctagaaaaaacacaggcagtccccccacccacccagcgtgcgaggcgatcaaaccgtgtgcggccgtgcgggcatggcggccacgctgctcctggcctcggcgaccgcgctcctggcgctggcggcggcgtggttctgggactacgtcgtggtgcgcctcctttggcggccccgcgccgtggccggcatgttcagggcgcagggggtccgcgggccgccctacagcttcctcagcggctgcaaccgcgagatgaggaggatgaaggcggaggccgacgacgggctccggctggacgtccgcgaccacaactacctccccagggtgaccccccacttccttccctgggaagcagcaatacgggaaggatgccctgtctgtctgtttcccccagtcatcccaggatggttcccccttattctatagcggcctcccggattccggaacccccttcccggatttggtgggttttaaaaacacttatggccccggtggaaacggtgcccccccccgcgccccggaaaatattttttacaccccttcccccgccggggggctttgttttttttttttctctttcatttgaaatttggtccccgggccaaaacaggaacccgcgaaatataagaattctttgggtgggggggggcgcgggggtttaaaaatcctttctccccctttcccgtggagataaaaaaataaaagagagttatttggttcttttctccgcccgggggcggcccccccctgcactttttgtgtgggggcacggggcgcgccgggatctctcttttttctcctctattagtgaaagaaaaacttttttttattatattcccgcaccctttttttgtggtgccccccccccacccccctccccccctaatttaaaaagaattgttcttgttggggggcc

SEQ ID NO: 93606 - protein, 116 aa, Zea mays
  misc_feature: Ceres CLONE 1583028
  misc_feature: SWISSPROT Homolog: EC 1.3.3.9 Secologanin synthase
MAATLLLASATALLALAAAWFWDYVVVRLLWRPRAVAGMFRAQGVRGPPYSFLSGCNREMRRMKAEADDGLRLDVRDHNYLPRVTPHFLPWEAAIREGCPVCLFPPVIPGWFPLIL

SEQ ID NO: 93607 - DNA, 1333 bp, Zea mays
  misc_feature: Ceres CLONE 1583033
  misc_feature: Encodes the peptide sequence at SEQ ID NO. 93608
  misc_feature (906)..(906): n is a, c, t, g, unknown, or other
  misc_feature (994)..(994): n is a, c, t, g, unknown, or other
  misc_feature (1042)..(1042): n is a, c, t, g, unknown, or other
  misc_feature (1097)..(1097): n is a, c, t, g, unknown, or other
  misc_feature (1110)..(1110): n is a, c, t, g, unknown, or other
  misc_feature (1228)..(1228): n is a, c, t, g, unknown, or other
  misc_feature (1296)..(1296): n is a, c, t, g, unknown, or other
tacccggaaaaaaaggaggtcgtggattccccccccccctccttcctccgacccggatggtaaagaggacccccacccaggggagctcccccacgatggcggcctctctagcaatagtggatcccccgggctgcaggagttcgtctcacccctagaaaaagaggtaagccatggcagagttgcctttggcagcggggctgatggaccttcgcaactgcaagctctctccgaagccagcgccgcctttgttactccccgcgctccgccgcatgcacacaagcgccacggctacgactgccccgtccccgcgccatgcggtccccgaactccactccactaccgagctggcggacgggagcatattattacggttcggccatcctaattttaaggcgctgtaggccgagcctgcgaagctaaagaccagtccttactccagagttgcccctgtcgactggcgcggtgcccagattggtacatcccaccctgaatattgacttctgaacatgggatttaaaccggcggtcctaatggggccctcaccgcctggggggtttagaaaagctgaagacctaaattgccgaaaactctaaaggacctggacccgaaaaccacccccagtctcatatgaactccgggcacgcggagagaacagcggtgccccacttttctgattttggtccttgaggagagaaatggcaccaccacgtaattcaaggaggggcccgtgggtttctcactagtggtttcggcaccctatatatattgaagatggtggagacaccccgcaacggtgggttatctatagacgcgcgcgcactggaagaggtcctcactcagattgtaagctcgccctgctctcagaggggagtctccttaacagaacgatataatcggggcggcctncccactactagtgtgtggtggcacgactatacgaggtgctgcgactcagatctctcatctagtgtgtgatgagcaccgcatcatgcgnatattgatgatcgcgcacgtgcatactctgtggggcgtgtgcgaatgntactcgcccccttctgagagatatatacgcgatctgatacgtgtgtggctagtgnagcgcgctctttntgtcgtctcctacaagatgaaagacgcactgcggacggctatctcacttttacgtctgcggaggaagtgatatccatctacgtgtgatctatagtataatctatatagatgaacacanaggagcgagcaggcgctatttgtgaaatcgattcgcgagaacgcactgacgctactagatgatctgcncggggcttgtacgaggtgacagactagttctatgaga

SEQ ID NO: 93608 - protein, 76 aa, Zea mays
  misc_feature: Ceres CLONE 1583033
MAELPLAAGLMDLRNCKLSPKPAPPLLLPALRRMHTSATATTAPSPRHAVPELHSTTELADGSILLRFGHPNFKAL

SEQ ID NO: 93609 - DNA, 793 bp, Zea mays
  misc_feature: Ceres CLONE 1583034
  misc_feature: Translation starting site: 104
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaaaaccagtaaaaggtcgggaaaaatccgaaatggccgctagtggcctcggtctctccacctccttcctccccggccacgacaccctcctccggcgccggcgccggcggccggcgggccacgccgccgcgtcgttccggccggtgacggcggagctcggcggcgtcgcgacggagctgggccgccagctggtggaggcggtgggcgtggggctcccctgcaccgtcatgcagtgcggcgacgtcatctaccgcagcacgctcccccggaacgacgggctcaccatcacggcccccggcgtcacgctcgcgctcgctaccgtgtcgtacctctggtccacgcccggcgtcgcgccggggttcttcgacatgttcgtcctcgccttcgccgaacgcctcttccgccctaccttccgcaaggatgacttggtatttggaaagaagcttggggagggcgcattcggggtcgtgtgtaaggcttcactgggcgaaccccgaagcggcgaagaagcatggggatttggtcgtgaaacaagcaacagagtatggtgcagtggagatttggatgaatgaacgtgtcaagagggcatgtgcttagtacctgtgcggattttatttatggctttttacaagaccaaaccaaaaggtaaaggaagctgaacaatattggccttattttggccttttttaaggccaaggattacctttaaggatctccctcca

SEQ ID NO: 93610 - DNA, 908 bp, Zea mays
  misc_feature: Ceres CLONE 1583035
  misc_feature: Encodes the peptide sequence at SEQ ID NO. 93611
  misc_feature (304)..(304): n is a, c, t, g, unknown, or other
  misc_feature (315)..(315): n is a, c, t, g, unknown, or other
  misc_feature (323)..(323): n is a, c, t, g, unknown, or other
  misc_feature (328)..(328): n is a, c, t, g, unknown, or other
  misc_feature (345)..(345): n is a, c, t, g, unknown, or other
  misc_feature (352)..(352): n is a, c, t, g, unknown, or other
  misc_feature (846)..(846): n is a, c, t, g, unknown, or other
tccccgcggtggcggccgctctagaactagtggatcccccgggctgcaggaattcgtctcacccctagaaaacagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccangcgggcactgncaccccgncgccnggccaccgggaagaccngggggcnggcaagatcacgacgaagtcacccggcgctgggcgccatcgggccaggtgtgcccaggtgatcggggcccgtcctttgacgtgccctttctatgaagggcctcccggcccttccttcaagggggccttgaagggggtttgaaaaaaaaaacatccgccctctggggttctaaggggggggcccaaccccctttggggcgaaaaaattggggggggccccccccccccccctttttggacacggccccccgggagggggggtttttttcctcggggggacaaaggggggtttccttcaaaaaagggggggtcccccccccaaaaacaatggcctttttggtggggagggggggcatccccttgggggggcccccctcccaaaaaaaggttgttttttggggggcaaccccccttttttttttaaaaaaaaaggggggggcttatatataaaaaaaaaaaaaaaaaaaattccctccccccccacttttttttttnggggagaaaacccccccccccccccctcttttttttgtgaaaaggggggcgccccccctaca

SEQ ID NO: 93611 - protein, 116 aa, Zea mays
  misc_feature: Ceres CLONE 1583035
  misc_feature: SWISSPROT Homolog: EC 3.6.3.14 H(+)-transporting two-sector ATPase
  misc_feature (54)..(54): Xaa is any aa, unknown, or other
  misc_feature (58)..(58): Xaa is any aa, unknown, or other
  misc_feature (61)..(61): Xaa is any aa, unknown, or other
  misc_feature (68)..(68): Xaa is any aa, unknown, or other
MASRRVVSSLLRSASRLRAASPAAPRPRAPPHRPSPAGYLFNRAAAYASSAAAXAGTXTPXPGHREDXGAGKITTKSPGAGRHRARCAQVIGARPLTCPFYEGPPGPSFKGALKGV

SEQ ID NO: 93612 - DNA, 2448 bp, Zea mays
  misc_feature: Ceres CLONE 1583036
  misc_feature: Encodes the peptide sequence at SEQ ID NO. 93613
gccgagctcagtagcgagagcttgtaacctaagcgggggcattaaggtggtgtggatgtttcctgacggattctgggcctgggcctgtatgtgccactggccggcctgcccgttccaagttggttgtggctggtggggctcgggcgaaggcctgggcctctttagacctgaagcggcaggcatggcgtgaggctggcttcacagagcagcgatcactgcccgcttccaacggtgggaggataacaggccgctgcattgcaagcccaactcggtccagagcctcattaaacagaccaccatctttgacaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatgggcatctccatgaacctggtgacgtacctcgtcggcgagctgcacctctccaactccaagtccgccaccgtggtgaccaacttcatgggcacgctcaacctgctcgccctcgtcggcggcttcctcgccgacgccaagctcggccgctacctcaccatcgccatctccgccacaatcgccgccacgggcgtgagcttgctgacggtggacacgacggtgccgagcatgcgtccgccggcgtgcctggacgcccgcgggccgcgcgcgcacgagtgcgtgccggcgcgcggcgggcagctggcgctgctgtacgcggcgctgtacacggtggcggcgggggccggcgggctcaaggctaacgtgtccgggttcgggtcggaccagttcgacgggcgcgacccgcgggaggagcgcgccatggtgttcttcttcaaccgcttctacttctgcgtcagcctggggtcgctgttcgcggtcaccgtgctggtgtacgtgcaggacaacgtggggcggggctggggctacggcgtctccgccgtcgccatggcgctcgccgtcgccgtgctcgtggccggcacgccccggtacaggtaccgccgcccgcagggcagcccgctcacggcggtcggccgggtgctcgccgcggcgtggaggaagcgccggctgccgctgcccgccgacgccgccgagctccacgggttcgccgcggccaaggtcgcacacactgacaggctcaggtggcttgacaaggcggcgatcgtggaggccgagccggcggggaagcagcgggcgagcgcggcagcggcgtcgacggtgacggaggtggaggaggtgaagatggtggcgaagctgctgcccatctggtccacgtgcatcctcttctggacggtctactcccagatgaccaccttctcggtggagcaggccacgcgcatggaccgccacctccgcccgggctccggcggcttcgccgtcccggcgggctccttctccgtcttcctattcctctccatcctgctcttcacctcgctcaacgagcgcctcctcgtgccgctggccgcccgcctcacgggccgcccgcaggggctcacctcgctgcagcgcgtcggggccgggctcgcgctctccgtcgccgccatggccgtctccgcgctcgtcgagaggaagcggcgcgacgcggccaacgggccgggccacgtcgccgtcagcgccttctggctcgtcccgcagtacttcctcgtcggcgccggcgaggccttcgcctacgtgggccagctggagttcttcatccgcgaggcccccgagcggatgaagtccatgagcaccggcctcttcctcgtcacgctctccatgggcttcttcctcagcagcttcctcgtcttcgccgtcgacgccgccaccgcgggcacgtggatccggaacaacctcgaccgcggcaggctcgacctcttctactggatgctggccctgctcggcgtcgccaacttcgccgtcttcgtcgtcttcgccaggcggcaccagtacaaggccaccagcttgccgtcgtcggtggcgcccgacggcgccgggcacaaggagatggacgacttcgtcgcagtcacggaggccgtggaaggagtggacgtgtagggcgcgcatgtcagactcacacttcatcggtgggtgtgggtggcctctgctgtttaattttgcctttgggtagtgtgtatgtgtatggcgaagttttctttctcttgccagtttccagtttgctgctgcttcggcctgctctcctgtaaataacataggagacatgctaattgaggccaagtctttatccgaaaaaaaaaaaaaaaaa

SEQ ID NO: 93613 - protein, 594 aa, Zea mays
  misc_feature: Ceres CLONE 1583036
  misc_feature (102)..(501): Pfam Name: PTR2 Pfam Description: POT family
MVSGAGHGGYGGGDDGQAVDFRGNPADKSRTGGWLGAGLILGTELAERVCVMGISMNLVTYLVGELHLSNSKSATVVTNFMGTLNLLALVGGFLADAKLGRYLTIAISATIAATGVSLLTVDTTVPSMRPPACLDARGPRAHECVPARGGQLALLYAALYTVAAGAGGLKANVSGFGSDQFDGRDPREERAMVFFFNRFYFCVSLGSLFAVTVLVYVQDNVGRGWGYGVSAVAMALAVAVLVAGTPRYRYRRPQGSPLTAVGRVLAAAWRKRRLPLPADAAELHGFAAAKVAHTDRLRWLDKAAIVEAEPAGKQRASAAAASTVTEVEEVKMVAKLLPIWSTCILFWTVYSQMTTFSVEQATRMDRHLRPGSGGFAVPAGSFSVFLFLSILLFTSLNERLLVPLAARLTGRPQGLTSLQRVGAGLALSVAAMAVSALVERKRRDAANGPGHVAVSAFWLVPQYFLVGAGEAFAYVGQLEFFIREAPERMKSMSTGLFLVTLSMGFFLSSFLVFAVDAATAGTWIRNNLDRGRLDLFYWMLALLGVANFAVFVVFARRHQYKATSLPSSVAPDGAGHKEMDDFVAVTEAVEGVDV

SEQ ID NO: 93614 - DNA, 1248 bp, Zea mays
  misc_feature: Ceres CLONE 1583037
  misc_feature (66)..(66): n is a, c, t, g, unknown, or other
agggtgtgttttaccaattattttattttctccgcacatctctttcctcatccaaaaataaaatanacaccaacacaaaaaaactccccacggtggcggccgctctagaatagtggatcccccgggctgcaggaattcgtctcacccctagaaaaagtgggcgggctctgtcggtgctgctcctggtctgattgtcttctgagagtgagtgccacctgagccaccgggagttcgctctacgataactgccgtgtgcagtcagtggaattacatcttcatgcctggattcccttagaccccgacccgcgtgccctcactccctcggaggtggccacctgctcaaggctgctttgcggtgcccatgggcatgggtggcgcgagctctgagagaagcagaacaggagaaacggcgctcagggaggatgatgttcgtgaacctgggctcgaagcgggatactttcctgtaagtgtaccccccacctaatatatggcctatgagatggtgccagatgatcttggaccctgcggatgaggtcaggttgtcgctcgccgaagtggccctctcgggatacaagagccaacaggttttgcaaaggggtaaaatttttcccggccgcccaggggaggaagtatcgatcgtggggcgcacatggtattgaaccttcttcggggcgggtagggaataatccggattataactattattggtggtcccaattgggctttccttgtcccgggggaagaagtaggtactattccctataaagttttcgcctatctcatcaggtttggagtaccacaagggcttagaaaatagcggggcatacgccgggtggacgagttcccccacagtggaaaaaatatataacgccgcgggtgcgcaacttaatggggggacaagaaacgggggggtataatttggtgggccacctcattaggctctaaatattattaaaaagagatggtggtgccccttgtgagagctcagatgggggatatatatacttcgcgcgagagtgctgtggaatagggcccctctcatttacggtgtgtgcctgtctcccggaatgtaaaagaaaagaattttctttcggagagaaccatggtgaactgctttcaaacgggtggttaaaaggaggtgtgcgggggacacggtgtgaaattctattaggcgatattgtgcttgcaggaagaactatttgggggagatttcctaccccatgagtggagaatgggggggatattagt

SEQ ID NO: 93615 - DNA, 743 bp, Zea mays
  misc_feature: Ceres CLONE 1583040
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (476)..(476): n is a, c, t, g, unknown, or other
  misc_feature (561)..(561): n is a, c, t, g, unknown, or other
  misc_feature (563)..(563): n is a, c, t, g, unknown, or other
  misc_feature (568)..(568): n is a, c, t, g, unknown, or other
  misc_feature (572)..(572): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (628)..(628): n is a, c, t, g, unknown, or other
  misc_feature (629)..(629): n is a, c, t, g, unknown, or other
  misc_feature (632)..(632): n is a, c, t, g, unknown, or other
  misc_feature (644)..(644): n is a, c, t, g, unknown, or other
  misc_feature (653)..(653): n is a, c, t, g, unknown, or other
  misc_feature (656)..(656): n is a, c, t, g, unknown, or other
  misc_feature (657)..(657): n is a, c, t, g, unknown, or other
  misc_feature (660)..(660): n is a, c, t, g, unknown, or other
  misc_feature (661)..(661): n is a, c, t, g, unknown, or other
  misc_feature (666)..(666): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (692)..(692): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (726)..(726): n is a, c, t, g, unknown, or other
  misc_feature (731)..(731): n is a, c, t, g, unknown, or other
  misc_feature (732)..(732): n is a, c, t, g, unknown, or other
tggagctccccgcggtggcggccgctctagaactagtggatcccccgggctgcaggaattcgtctcacccctagaaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcgggcgtcgcccctcccgcggcggttgctgcagcggggggggggccttttcctttaaaaaagcccggcggcgtgtttttttttttgggggggggggggcccccggggggcccccccccccccnnntttttcttctnaaaaaaaaaaaaaaaaaaaaaggggggggccgccttttttttgtggggggggggggggggggttttttttttttttttttttttntnccccnaccncccccaaccacaacattttttttttttccccnnnnnnggggggggggggggggggnnggntggtctctcccncccttcccnccnnccnnccttncccacccccccccccccccnnnnntncccccccccccccccccccccnnnntcgtggggnggtannaggagaaaaaa

SEQ ID NO: 93616 - DNA, 824 bp, Zea mays
  misc_feature: Ceres CLONE 1583041
  misc_feature: Encodes the peptide sequence at SEQ ID NO. 93617
  misc_feature (728)..(728): n is a, c, t, g, unknown, or other
ctccccgcggtggcggccgctctagaactagtggatcccccgggctgcaggaattcgtctcacccctagaaaaaaaaaaggttcgagacgcgcaccgccagccgatacgaatccgacgagctcgatcgctccacttccccgatcgcacgccaatcagcaccagccaccgtggcgatgacggaggaggcggaggcgaaggcgaagggcaacgcggcgttcgcggccggccgtttcgaggaggctgtccagcacttcagcgacgccatcgcgctcgcgcccgacaaccacgtcctctactccaaccgctcggcggcgtacgcgtcgctctggcgctacgcggaggcgctagatgacgcctagcggaccgtggcgctgaagccggactgggccaagggctactcccgcctcggcgccgcgcaccttggcctcggtgacgcgcccaaggccgtcgaggcctacgagaaagggcttgcgctcgagccgtccaatgaggcgctcaaatccggcctcgcacaggcgcgccagtccgcatcggcgccgagacgtccggtgggctccggggctgacgccgttggcaagatgttccagggcccggagctatggagcaaggtcgcggccgatcccaccacgcgtggctacctcgatcagccagacttcgtgcagatgctgcgggatgtgcagcgtaaccccggcagactgaacagctacctttctgaccatcgaatggntcaggtgctccacctcatgctgaacatcaagttgcagaaacagagcagtgggggcgcctgacccggcagcagcacaatcgatcccgccggcaccaa

SEQ ID NO: 93617 - protein, 61 aa, Zea mays
  misc_feature: Ceres CLONE 1583041
  misc_feature (4)..(37): Pfam Name: TPR_2 Pfam Description: Tetratricopeptide repeat
  misc_feature: SWISSPROT Homolog: EC 3.1.3.16 Phosphoprotein phosphatase
MTEEAEAKAKGNAAFAAGRFEEAVQHFSDAIALAPDNHVLYSNRSAAYASLWRYAEALDDA

SEQ ID NO: 93618 - DNA, 960 bp, Zea mays
  misc_feature: Ceres CLONE 1583045
  misc_feature: Encodes the peptide sequence at SEQ ID NO. 93619
  misc_feature (395)..(395): n is a, c, t, g, unknown, or other
  misc_feature (475)..(475): n is a, c, t, g, unknown, or other
ggagctccccgcggtggcggccgctctagaactagtggatcccccgggctgcaggaattcgtctcacccctagaaaaactctacaagcccttcttttttttgttatccggtccgcccaggctcctcctgttctccggcgcttccctctctgtcccttggctcgctctggcgtggttctcccgtcccctggtgcgtgcgcgcttctcgctcgctcgctctctcgtggcggcgactgggcgacagccgcctccgccctacaccagttgctcaggtcttctttgggcccttcgccggggacaagcacccaccggagaaaatcataaatacatcggcctgaaagaatgggttatggcatgactaggctagaagatgaatactatgaggctgaagggcanaatactggtggatctggctcagtttcagtgaacgatgagttttgcacactacataatgatattttttcatatggacccgnatgagagcaggacctactgaaagctacaagttcatggggtaccgaccgaggcttaattatcaactgcccaggttataatctccaaggggaaaatggattgttctgggaaaaggggatgttttcctttttggggacccgggcatttgtttcttaggggcggccttttttcccaatgaacaaaccctagatttattggaataaggaaggggattcccccggcgttacgttttcaacagtttttctgcgcgagggggaaccctctttctttttggcgggggtttcccggggaggcccccaaacaaaaattccaatcttttttataggggtggggggttcccaaaaaacaattttctgtcttggggggtttaaaagggcacaaccaccggggggtgtttccttttcccccccacacacgggggtattgtgcccaccccacatctgggggggccaccttaaaaacatatttttaaagtggttgggaagag

SEQ ID NO: 93619 - protein, 44 aa, Zea mays
  misc_feature: Ceres CLONE 1583045
  misc_feature (18)..(18): Xaa is any aa, unknown, or other
MGYGMTRLEDEYYEAEGXNTGGSGSVSVNDEFCTLHNDIFSYGP

SEQ ID NO: 93620 - DNA, 942 bp, Zea mays
  misc_feature: Ceres CLONE 1583046
  misc_feature: Encodes the peptide sequence at SEQ ID NO. 93621
  misc_feature (297)..(297): n is a, c, t, g, unknown, or other
ctccccgcggtggcggccgctctagaactagtggatcccccgggctgcaggaattcgtctcacccctagaaaaaacgcactcgctcgctcgctctcatacccagctgacaacgaagaggtttagagagagagagctgagagaatggccgacagcaggagaagtgtagtgtacgatgctgaaggcggcgacgatcatgagaggcaagggacggcgtggacggcgacgtcgcacatcgtggcggcggtggtgggctccggcgtgctggcgctggcgtggacggtggcgcagctggggtngggtggtgggtcccctcgtgctggtgggcttctcttgcgtgacctactacacgtcggcgctgctcgcagactgctaccgctacccggaccccgtccacggcgccgtcaaccgcgagtacatcgacgccgtccgatgctacctgaaccgggaagaacgtgttgctgtgcgggtgcgccccagtacgtgaacctgtgggggactctcgtcggctacaccatcacccgcagcgcaagcatgatccgcattaaaccgcgtcaactgcttccaccgggaacgggtacggggccccccgggttgaaaacctttggggaagaccgcaccatggggggggtttggggttttttccaagttctgtgttttttcaatttccccaacctccaaaaaaaccccgggggttttccccggggggggccgggggccccctccccggggggaaacccttttaaaaacctggggggtggggtcccccccacaaggggccctcccccggggggggccatgtggcgggcaactttttgtggggccccccccccctgggggggcgggggggggtaaaaaaaaaaaaaagggggggctctttaaaagggtcctccccccggcggaaaaaaaaccccttttcttccccccctcccgcgagggggtgc

SEQ ID NO: 93621 - protein, 103 aa, Zea mays
  misc_feature: Ceres CLONE 1583046
  misc_feature (42)..(42): Xaa is any aa, unknown, or other
MLKAATIMRGKGRRGRRRRTSWRRWWAPACWRWRGRWRSWGXVVGPLVLVGFSCVTYYTSALLADCYRYPDPVHGAVNREYIDAVRCYLNREERVAVRVRPST

SEQ ID NO: 93622 - DNA, 847 bp, Zea mays
  misc_feature: Ceres CLONE 1583047
  misc_feature: Encodes the peptide sequence at SEQ ID NO. 93623
  misc_feature (778)..(778): n is a, c, t, g, unknown, or other
ctccccgcggtggcggccgctctagaactagtggatcccccgggctgcaggaattcgtctcacccctagaaaaaaaaaaaaacaattcgtgcctgcctccctgcctcggcctcctccctcgtcctcccctcctccgccgcctcaaacccggccccctcgcgcgcgtgcgcggcgctcgaggcgacgaatccagccacctcctccgcacccatccccgccgccggtcgccgatattggaaggagctcggaaggctgggacgctgacccgaattttatggggagaggatgccagagctgcgaagcaatactcgtcaagcacgcttaaggtctaagaagcttgacgatctgcagccaggagagccgcttgcgaaaccggtgtcacctgctctgccgagcgcacggaagcgtgctcctacacgtgctgctaggggcagaaagggtgctgctggggagaggagtgcctcccgcaccaaagcctagaagaaagggggttgatattgtcgtcttagaagctgatcctgcttgtgaaaccccacttaaagctttcaagggactggaagttgctgctgctgcgcccaagaaccttcctttgaagcaggtagcccgagttggtgttccgaaaatgaatggtgaaagtggggaagagattgttgggggctgagatgaatcgacagctacacctgtcccagaaaggggtccagtaggtaattctccagagtacatacctgacaggaaagtaggtaaaaggtggttttggttcaaggggtattgttggtcnaaaggggtttcctggtggggctgctcgcactgggtccgaaagcatatgaggttggcattgaaattcgaa

SEQ ID NO: 93623 - protein, 64 aa, Zea mays
  misc_feature: Ceres CLONE 1583047
MPELRSNTRQARLRSKKLDDLQPGEPLAKPVSPALPSARKRAPTRAARGRKGAAGERSASRTKA

SEQ ID NO: 93624 - DNA, 792 bp, Zea mays
  misc_feature: Ceres CLONE 1583048
  misc_feature: Encodes the peptide sequence at SEQ ID NO. 93625
ctccccgcggtggcggccgctctagaactagtggatcccccgggctgcaggaattcgtctcacccctagaaaaagcgctgcttcgctgtctttcggcaacgccctttaccacatctgaatctcacccacccacccccgcgccccccgccaaagcatggcgcccgcgatggggatgaagcggcctgcggctgccgcggcggcggcgggcagcgggggcagcaccagcgcagacggtcacgctgtccgcgccggccgtgcgggacgcggtgcgcgccgccgagagggatgccgaggccaccgccccgggcgccagggtcccggcgaccgctgcagccaccgcggacatcgctagggacggggtgctgtgcctggaggacgtccaccggaggcggtggagctacgtgggccacgccggccgcgccgcagtcaatgctaagggaagggcgtccgtccgcgccgccttcaaggttgtcccactccagtcaccgctgccgccagtcgaggaaataatgtgctttataagatcatatgttgtgcccgaaggctttcctgatagtgtcacaccttcatatgttccatgcatgacatgcagagcattgaagcatttctttggtggagcaatgtggcgtgtttacaacaagaacattgctcaactctgctggagtctcccacagcaggcctgcatctgggtgctgaggctatcatctggatactcaatgatggggtctgggcagtgttggtacagatgctttgttgcccgccaacggcaagaaatttgaattctggacctgt

SEQ ID NO: 93625 - protein, 89 aa, Zea mays
  misc_feature: Ceres CLONE 1583048
MCFIRSYVVPEGFPDSVTPSYVPCMTCRALKHFFGGAMWRVYNKNIAQLCWSLPQQACIWVLRLSSGYSMMGSGQCWYRCFVARQRQEI

SEQ ID NO: 93626 - DNA, 1157 bp, Zea mays
  misc_feature: Ceres CLONE 1583052
  misc_feature (1)..(1): n is a, c, t, g, unknown, or other
  misc_feature (45)..(45): n is a, c, t, g, unknown, or other
  misc_feature (790)..(790): n is a, c, t, g, unknown, or other
ngggttggggtgggggtgttggtggccgctgtctctcggcacctnaaacagaaaaacggactacctctcttttttatgtggagctccccgcggaggcggccgctctagaacagtggatcccccgggctgcatgaattcgtctcacccctagaaaaatcccctgccacttcccaaatccgcctgccattcatgcactcttctgtgcactgtcagcgccaccattagctcgcagctcaagctcgccactaccagttttcgtcggttctcgacgaaatccatcgaaccgttggagtgccaccacctggcagaggctgttgcattcttgacttgagcacgaataggaaaggaagcaatggctctgtcgacgttctctgtcccaagggggttcctcgggatgccggatcacgactcccattttccttcggcggtcgagcttccatgttcacaaggatgctcctggccaggcctatcaatctcccccccccggcggaagcacggcatgccgtgttggcccccactggccgtccgaaccgctaaggcggaagtaacttttccgcagaagggcgacccaacccccccttgctgggagccccattcaaactatcctcccctcccccttttaaagaaaccttggttcggtgaaaagaaaaccttccctaccaactttgggccctaaaaccaaggtttccgcggtttcccaaacaggataaatattatacccccgagtccctcgccaaagaaacaccggggcgggggcccctacctacgcgggagatccacagagacctcntccctaggctggtggcgcagaagaacccctaataaacagtctccttgccgctcttagaacagtaatagcggtcgtgtaaaaagaagccggaatcgcgttaagagaaacacggcacattcccgctcatagcggacaccggctgggcgggcattactactttcctttaaccccccttcactcaataaattttcccagacaaatggggcgaactccacacccattacaaataggggtcccgaaaaccatacccacctcgcagacatctcataaaggcctcttgctctcggaatattccagcccagaaatcgtctccccacaagtcacgtgggatacccaacgaccctcttcaccgcccatgggcctcaca

SEQ ID NO: 93627 - DNA, 1135 bp, Zea mays
  misc_feature: Ceres CLONE 1583053
  misc_feature: Encodes the peptide sequence at SEQ ID NO. 93628
  misc_feature (58)..(58): n is a, c, t, g, unknown, or other
  misc_feature (1135)..(1135): n is a, c, t, g, unknown, or other
ataatttataccttttaggggggcggaaactgtccacacggtatgggggagttggccnaacacttattattaccaaaagaactccccgcggtggcggccgctctagaactagtggatcccccgggctgcaggaattcgtctcacccctagaaaaaaccaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaagtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgaccaacctgggcgagctcggcgccaaagctcacggggctgggcccctgccgacgccatccttcgtggcgagcttcatccctggaaatgctcaaaacctcgcccaccttgggccgaggaagggtgcaagattcgcgcacccgcccgccggcaaacagcaaaacttcaagaaaaagggtgggcttcccccgaaaccaaaaggctccccgcccaccaacccgaagattcccaaacattcccaagggaagaacgccctccaaagcccgcccttcccgggtgttccccaaaaaggtccgcggccaaaggatccccctcccccaaaaagagaagggggtggttttctcaaaggggcggccttctaagaaaaacccacgaaacccgcggcgaaacccctctgttcctttccacccgggcggcaatttccccacgggccagatttccgggcccccggcccgggttttggttttccttggagaaaaaaaaaaaccgccaggggaatccccgggaaatttgtttttgaacccaccccttgaaaagcgccaagggaaaatttccttttgaccaaccaaacagagcggggggactctccataaaggccttctttccagaaaaaagaaaccacagcggccctttcgaaacctgtggagaaaccgggggggggcccaccccn

SEQ ID NO: 93628 - protein, 196 aa, Zea mays
  misc_feature: Ceres CLONE 1583053
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTNLGELGAKAHGAGPLPTPSFVASFIPGNAQNLAHLGPRKGARFAHPPAGKQQNFKKKGGLPPKPKGSPPTNPKIPKHSQGKNALQSPPFPGVPQKGPRPKDPPPPKREGGGFLKGAAF

SEQ ID NO: 93629 - DNA, 820 bp, Zea mays
  misc_feature: Ceres CLONE 1583057
  misc_feature: Encodes the peptide sequence at SEQ ID NO. 93630
  misc_feature (659)..(659): n is a, c, t, g, unknown, or other
ctccccgcggtggcggccgctctagaactagtggatcccccgggctgcaggaattcgtctcacccctagaaaaatccacccattcctcgttcttccttaattcctcatttcctccacgtacgcgtgcatactctgcgagtccaggaggtattttcccccttcttcacgatactctcgacgagagcgtctccatggccggaaaaggagacgggccggcgatcggcatcgacctcggtacgacctactcgtgcgtcggggtgtggcagcatgaccgagtcgagatcatcgccaacgaccagagcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacgcgtcggtgcagagtgacgccaagctatggcctttcaaggtgatcccgggctgcggcgacaagcccatgatcggggtgcagttcaggggcgaggagaaacagttctcggccgaggagatcagctccatgatcctgaacaagatgaaggagacggccgaggctttactcggcaccacatccagaacgctgtcgtcaccgtcccggcctacttcaacgacntccagcgccaggccaccaaggacgccggcgtcatctccggcctcaacgtcatgcgcatcatcaacgaagcccactgcgccgccatcgcatacgggctcgacaagaattcgagcagcgacggccaagagacctcctcatcttcgactctggcggcggtacta

SEQ ID NO: 93630 - protein, 209 aa, Zea mays
  misc_feature: Ceres CLONE 1583057
  misc_feature (9)..(207): Pfam Name: HSP70 Pfam Description: Hsp70 protein
MAGKGDGPAIGIDLGTTYSCVGVWQHDRVEIIANDQSNRTTPSYVAFTDSERLVGDAAKNQVAMNPINTVFDAKRLIGRRFSDASVQSDAKLWPFKVIPGCGDKPMIGVQFRGEEKQFSAEEISSMILNKMKETAEALLGTTSRTLSSPSRPTSTTSSARPPRTPASSPASTSCASSTKPTAPPSHTGSTRIRAATAKRPPHLRLWRRY

SEQ ID NO: 93631 - DNA, 1029 bp, Zea mays
  misc_feature: Ceres CLONE 1583059
  misc_feature (678)..(678): n is a, c, t, g, unknown, or other
ggggggggggggggggggtcggtgctgcctgttttgggtgggggggtgggattctacgatgggtaaaattttatgttggggatttggtgctcacgcggtggcggccgctctagactagtggatcccccgggctgcaggaattcgtctcacccctagaaaaaccccgcttgtcgagagagtgatccccccgcgtgctctccgcctgccgcctctgtatcgcgtctcctacaactaccccccaatccatcaacaaaaccccatcatcctcgagatctatcgatgtcgatcgacttaccaatcatattgctagggtgttagtttcgcaaaattctgaataaaaattctggtcaaggggaggacgccatctcggcccaagtggcggtggtgcctaatgggggcccgggccctgtcctcacggtggtgacgtcagagactgtccgtgtgggctactacctggcgatcacctcactctacctggcacgacctggagggggaccgactcatactccctgcatgtccgaactctacgtgcccctggggccggtggctgtccgtcgcgcgtctgggtggattggtcacctttcccccggcttggcccggaatatgccccatcgtggaagctacggccgggtctcccctggatgggggccccaaaaggcttttatggaagttgtctcntaaaccttttggctggaatctttaaaaaaaaaaagccccttaatccccggggcggggatgaaacttgcccacaccccgctggaggccccatggccaggttcccgcggggaactttgggaatgcttgccatacactatttttcccatgaaaaaaaaattccctgggaacctgtgtccccctggcgaccctagtgggaacccccctgtccctgggacgaagcgcttgttatctcccaatttttgggggtcccacatatcctccctcttggggtaaagggaaaccccccgccgcgatgtgaaggagaggggtccaatttcccaaagaggtctttgtagggtttagcgttcccct

SEQ ID NO: 93632 - DNA, 845 bp, Zea mays
  misc_feature: Ceres CLONE 1583061
  misc_feature: Encodes the peptide sequence at SEQ ID NO. 93633
  misc_feature (845)..(845): n is a, c, t, g, unknown, or other
ctccccgcggtggcggccgctctagaactagtggatcccccgggctgcaggaattcgtctcaccccgaagatttttaagagaactatcttaaaatattttgaaaaaaatatattctttagaaaaactaaggattttctgatccttctgacccgccgccgcccaagatgggcttcgacgtgggcctcgtcccctacttccccgacgggtggggtccacctgaagttgccgccgcgccgccttccctcggtggtggctcctcgtctgtccccttcgctcccttctcccgctccgacaagctgggccgcatcgccgactggacgcgcaacccgccgggccccggggctttcgccgcagctcgcgacgccgtcttcgatttcgcggggctcgaggactccatcgggctcgcgtccgcggacgactcgtccttccgcctcgtcgatggcaaaccgccgccgcggcacccgcggtttggacctcgctggcgcttccggcagcggcccctactcccgcagcgccgcgacgaagaggtcgaggctcggcgtctcgaggccgagaaggagcgcgcccgccgcgaccgccactggcagcagaaccgccgcacgcaccaaccgttcaaccgcggcgggcccctcctcggtcgtctgccaaacccgtcccgttggaccttccagccccgaggtgggtcggggggaaaggagccagaatccaccttttcttcaattcctttcctcacaagacttcctccctttccggcccggtgccgccacgaacctaaggccccgagaggggaattcttcccctcgcggttcctgggtgggggcagcctaaggtccggagaagtttn

SEQ ID NO: 93633 - protein, 226 aa, Zea mays
  misc_feature: Ceres CLONE 1583061
MGFDVGLVPYFPDGWGPPEVAAAPPSLGGGSSSVPFAPFSRSDKLGRIADWTRNPPGPGAFAAARDAVFDFAGLEDSIGLASADDSSFRLVDGKPPPRHPRFGPRWRFRQRPLLPQRRDEEVEARRLEAEKERARRDRHWQQNRRTHQPFNRGGPLLGRLPNPSRWTFQPRGGSGGKEPESTFSSIPFLTRLPPFPARCRHEPKAPRGEFFPSRFLGGGSLRSGEV

SEQ ID NO: 93634 - DNA, 931 bp, Zea mays
  misc_feature: Ceres CLONE 1583064
  misc_feature: Encodes the peptide sequence at SEQ ID NO. 93635
  misc_feature (249)..(249): n is a, c, t, g, unknown, or other
  misc_feature (344)..(344): n is a, c, t, g, unknown, or other
acccgcggtggcggccgctctagaactagtggatcccccgggctgcaggaattcgtctcacccctagaaaaaccaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacnagctcatcgagtacgatgcgctgctcgtcgaccgcttcctcaacatcctcagggactccacgggcccagccctcgcgaatttgtccaggagtgcntaccaggtgtcgggccgactatggagggcaagggagacccgacgaaacctgggcaaacttcggccccaagcttcacgggggctgggcccccgcccgaacccatccctcgtgggggaggctccatccctgcaaaaggcttcaaactcccccaacctgggcccaaggaagttgcagaattggggcaacgggcgcccgcaaacaagcaagacttaaagaaaaaggtgggggttccgccccaacaaaggggctcccgccccacccacccgaagtgccccaaacatccgaggaaaaaccccttcaagggcggccctccctggttccccaaaggtccgggcaaaagtccccccccaaagaaagaggggtttccaagggcgcctccaaagaaaacacagaaacctttcggaccctcggttcttttcaaccgcgggcattctctcaagccaagttccgggcccgcgccggtttgggttccctgggaaaaaaaaaaacccccagggatcccccggaattggtcttgaaaccccggctgaaatggcccaaggaaaactctctctggacgcgaccaaccaaggcgggaagcctcaaag

SEQ ID NO: 93635 - protein, 134 aa, Zea mays
  misc_feature: Ceres CLONE 1583064
  misc_feature: SWISSPROT Homolog: EC 4.1.1.31 Phosphoenolpyruvate carboxylase
  misc_feature (33)..(33): Xaa is any aa, unknown, or other
MASTKAPGPGEKHHSIDAQLRQLVPGKVSEDDXLIEYDALLVDRFLNILRDSTGPALANLSRSAYQVSGRLWRARETRRNLGKLRPQASRGLGPRPNPSLVGEAPSLQKASNSPNLGPRKLQNWGNGRPQTSKT

SEQ ID NO: 93636 - DNA, 904 bp, Zea mays
  misc_feature: Ceres CLONE 1583068
ctccccgcggtggcggccgctctagaactagtggatcccccgggctgcaggaattcgtctcacccctagaaaaaatccaatcaaatacacaccttcccttgttcctctcttactcgaaacatagctatggtgactcggccgcggggggtcgtcctccccccatgcgtggtgatgcttgtgcttgtgatctccccttgtctcgcaccggcttcgatgtgatccaccccttccttggagacgaggagccgacctctggggcgggctaatttgtttccacctgccaggacggggtaccatttccaccgggccttgagtcggataacggcccctacccttcgctgtgacttaaaggaagggtttacccgggtttttgcactcccaccccctggggcccgttttaggggaaacccggctttggggcgcccctcttgtgtgtgagagaaacccgcctttaaaggggtggggcctggagaccccacttttttttccaaagaaattcccctcaaaaaaaaatacgccccccctagttgggggattggcccaaaaaaattcttttagagaaaagggaaagccccggctcttttctttttttccccagtgggaattccaaaacgggttggggaacccctcattttttcccaaatcccaggttgtttggggaaatttccccccaaggaacccccctcctcataccactttttttctccggggatttggtgggaaaaacccgggaggttttttaatcccccgggggggaaacccccgggggggggggggggcctttatagccctatcccaattttcctcttacccaaaaaaaaaggtttgggggggataacacggggtctcctgggggcaaaattcttttttgggaaaaaatggcccccccgccgcccctgttatg

SEQ ID NO: 93637 - DNA, 824 bp, Zea mays
  misc_feature: Ceres CLONE 1583070
  misc_feature: Translation starting site: 243
  misc_feature: SWISSPROT Homolog: EC 1.14.13.68 4-hydroxyphenylacetaldehyde oxime monooxygenase
  misc_feature (362)..(362): n is a, c, t, g, unknown, or other
  misc_feature (544)..(544): n is a, c, t, g, unknown, or other
  misc_feature (794)..(794): n is a, c, t, g, unknown, or other
  misc_feature (824)..(824): n is a, c, t, g, unknown, or other
ccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctanctcgcggcgtcggcgtcggcgtcggcgtcggcgacaaagaacgacagagcggcggcggtggcggccagcgaccccgacaagctcttgagcctgctgccgtcgccgcccatgaagctccccatcatcgggcacctgcacctgatgggggacatcccctatgtgtccctcgccgcgctcgccancaggtaccgcccggacctgatgctgctccgcctcggcgccgtgccgaccgtggtggtctcgtcgccgcgcgtcgccgtagccgtgctccgcacctacgatcacgtcttctcctccagccgcgctccctggtgtcgacatcatcatgtacggcgccaccgactcgtgcttcgcgccctacggcgaacacttccgcaaagcgcgtaagctggtcaccgtgcacctgctcaacgcagcaaagtgcggtcgcanctgcccccggaaaaaaaaaagagcgcccgn

SEQ ID NO: 93638 - DNA, 911 bp, Zea mays
  misc_feature: Ceres CLONE 1583073
  misc_feature: Encodes the peptide sequence at SEQ ID NO. 93639
ccgctctagaactagtggatcccccgggctgcaggaattcgtctcacccctagaaaaaaaaagaaatctccctcccgttcccgtcctcccccgctccgcctttccctttcctcccccttcctcttcctatctccttgggggcgcggcgagatcgggcggaggagccctaccgcccccctcgccgcaggccgcagcccgcagcggaggcgggtgctcagctccgcggaaggttaaaggtgcggggctgcgtttggaaccggcggtgggcgcgggagatccggccagcggggatgcagcaggaccagcggaacaagacttctgcagaggccgacttcttcacagagtacggggatgcgaaccggtacaagatccacccaccccatcggcaagggaagctacggggtcgtctgctctgccatcgatctccacactcggcagagggtggcgatcaagaagatacatggcatcttcgagcacgtctccgatgccgcgaggatcctccgcgagatcaagcttctgaggctcctgaggcaccctgacattgtcgagatcaagcacattatgctgcctccctcgagaaaggacttccaggacatttacgttgtttttgagctcatggagtccgacctccacccaagttataaaggccaacgatgactttggacccaaggagcattacccggttctttcttctatcagtttacttcgggccctcaaaaaacctttcatacgggctaaggtttaaccaccggggacctctcagccccaaaaaatattttaggcagaacctctaacttgcaaacctgtaaaatatttggaatttttggaacaagccccgaagtccgcatttctagtgatatcccccaaacaaccaggtcttttcgtggagcggggaatgacatattggttgg

SEQ ID NO: 93639 - protein, 101 aa, Zea mays
  misc_feature: Ceres CLONE 1583073
  misc_feature: SWISSPROT Homolog: EC 2.7.11.24 Mitogen-activated protein kinase
MRTGTRSTHPIGKGSYGVVCSAIDLHTRQRVAIKKIHGIFEHVSDAARILREIKLLRLLRHPDIVEIKHIMLPPSRKDFQDIYVVFELMESDLHPSYKGQR

SEQ ID NO: 93640 - DNA, 810 bp, Zea mays
  misc_feature: Ceres CLONE 1583074
  misc_feature: Encodes the peptide sequence at SEQ ID NO. 93641
  misc_feature (502)..(502): n is a, c, t, g, unknown, or other
  misc_feature (571)..(571): n is a, c, t, g, unknown, or other
  misc_feature (595)..(595): n is a, c, t, g, unknown, or other
  misc_feature (789)..(789): n is a, c, t, g, unknown, or other
ctcaccgcggtggcggccgctctagaactagtggatcccccgggctgcaggaattcgtctcacccctagaaaaatccccgcgtcttttcctctcgactctcctctctctctctctctctgcgctgctcctgctctcggtttaggtcgaggagttgctagctagctagggggtttggatccctgctggtgctggctgctgcgtgctagtcctactccagccccccagccccagcgaagcaggcaagcatagatagaggctggggtgggcagggaggtgcgcggacggagatccatcagatcagaatcagatcacatcatcggccctcggatgcgatgcagcaccggcgcaagcccgcttccgccgcggcgccgccggccgccaagcagccggccgcgcgcaggcccacggcgcggctgtcgctcgcgggcctcgtcgtctccatcttcctcgtcgccaccttcctgtacaacgaggacgtggtgaaggcggcctccggctccntcagctcagcaacaacagccgacgccgctgaggtaggcgtctccgggcgggcgaggtcacccgacctanggtgctgcaggaggcggcgcaccnagggggtggaaaactgagagcgggaagtttggaaatcctacggaacccgagcagatgcagaaacccctgaacctccccatccccattccccttggttgcgcttgcggaggaaagaacctcctggagaatacctaagggaagggcgaaaccacccacccccccggaggaggagccaacccccgaaaggcaccggncaccggccgggcgccttcttt

SEQ ID NO: 93641 - protein, 92 aa, Zea mays
  misc_feature: Ceres CLONE 1583074
  misc_feature (57)..(57): Xaa is any aa, unknown, or other
  misc_feature (80)..(80): Xaa is any aa, unknown, or other
  misc_feature (88)..(88): Xaa is any aa, unknown, or other
MQHRRKPASAAAPPAAKQPAARRPTARLSLAGLVVSIFLVATFLYNEDVVKAASGSXSSATTADAAEVGVSGRARSPDLXCCRRRRTXGVEN

SEQ ID NO: 93642 - DNA, 1253 bp, Zea mays
  misc_feature: Ceres CLONE 1583076
  misc_feature (1)..(1): n is a, c, t, g, unknown, or other
  misc_feature (67)..(67): n is a, c, t, g, unknown, or other
  misc_feature (829)..(829): n is a, c, t, g, unknown, or other
  misc_feature (889)..(889): n is a, c, t, g, unknown, or other
  misc_feature (969)..(969): n is a, c, t, g, unknown, or other
  misc_feature (995)..(995): n is a, c, t, g, unknown, or other
  misc_feature (1127)..(1127): n is a, c, t, g, unknown, or other
  misc_feature (1129)..(1129): n is a, c, t, g, unknown, or other
  misc_feature (1181)..(1181): n is a, c, t, g, unknown, or other
  misc_feature (1253)..(1253): n is a, c, t, g, unknown, or other
nttttttcccctattacctttgtcggatgtggagggcgagaccccaaagcaaccatcttggctcttngacggggaaaaaagaaagctggagctccccgcggtggcggccgctctagaactagtggatcccccgggctgcaggaattcgtctcacccctagaaaaatccccgcgtcttttcctctcgactctcctctctctctctctctctgcgctgctcctgctctcggtttaggtcgaggagttgctagctagctagggggtttggatccctgctggtgctggctgctgcgtgctagtactactccagccccccagccccagcggagcaggcaagcatagatagaggctggggtgggcaggaaagtgctcaggacagagatccgtcagatcagaatgagatcaaatcttcggacctccggattgcgatgcaagcatctggtccaagacccgtttttcccccgcccgccaccgggccggccccccaaaaacaaaccagaaatggtgccacagttgaaaagggttgtgtttcacttttggtgggtgggtggggggggagtcgcgagccgtataatgtgacacgctgttcgctttcgtctctgttaaccccgctgcgatgtaagtggcctgccatgaagcagcgggcggagggtgggggcggggctggccgtcttggccgggctagtaccgtctcgtgcgaaacagtgagactaccgcgccggtcaaagtaacatgagacgtgatagtttggagccttgcagtatgccagggacacgaggtgtagcagagggttaacgcggtgcacgcaagcgatacatatgtctcaaacnaataacacggcatgcattatatagacatattcaatccaccacgcggaaccgctcgtgtangctcgggcgtaggaacctttaagaaagagatgtacaccgtctaattatgtgactgctggccttgctatctagggtgtggnagcgcggctgtgatacttgctctctntgcattttctatagactcactaagtataatgggtgtatgtagtatcgttggaaatatatatcgattagtgtagatggaggctgtatattatgtgatatataatatgatgaataagaatagacagaaattatntntgaaagaatgtagaaaatcgttctgtttctcacacgtagtcgaacacagaangctgatgtaagtataataagagcattgagcccgcgtttatgtgtgaacgaaataatcttatacttttgactn

SEQ ID NO: 93643 - DNA, 895 bp, Zea mays
  misc_feature: Ceres CLONE 1583077
  misc_feature: Encodes the peptide sequence at SEQ ID NO. 93644
gcggtggcggccgctctagaactagtggatcccccgggctgcaggaattcgtctcacccctagaaaaaacccgcgcccgcgcccacgcccacggccgcaccaaccaccagccccgatttcctcctaatcaatcacaccccccaaaccaaaacccaaacagcacttctcctgcaatcgccgacgtcgccggaggcttcgccggccgaagcagcgccgaaggttgttttgcccctccctcgtccggccaagcagcccaggcgagcatgccttcgattgcgccaccgtcttcctccgtcgctgccctcacccgtcaaccggtgcaattcttcaaagggtgcagtgtatccaaggagacaaagggaccggtccgcagtttcttcactgcaaacccaaagagcaccaaggtgaaatcagcgggcttgaaagtagcatcatccttcaaaaatgatggtggttatccagctggcggtgtctcttggaaggacgacactctattgccaaaaagcacaaccattcgtggccaggaccatccggttgctgaccccgtactcccaatggattccatgattacgccagaaatcctctctgctaatgtggaacgtgttatagacatggtttgcagatgatgacactgatactgaacttggattggaatagccccgacgaagggcttcccatcaatttgcagaaacccattggaggacttacaaccaaggaaaaccttggtgattggtttgtttaatgaagaaatccaggggaaaaatgaaaggagaatctgataaaagggcttgccccccttgggttaaccccaaaaggcttaggggctctttttatgtaaaggtctgggggacagggaaattgtgttgtggttcaccgctgtaaaaaaaagaaggat

SEQ ID NO: 93644 - protein, 120 aa, Zea mays
  misc_feature: Ceres CLONE 1583077
MPSIAPPSSSVAALTRQPVQFFKGCSVSKETKGPVRSFFTANPKSTKVKSAGLKVASSFKNDGGYPAGGVSWKDDTLLPKSTTIRGQDHPVADPVLPMDSMITPEILSANVERVIDMVCR

SEQ ID NO: 93645 - DNA, 1304 bp, Zea mays
  misc_feature: Ceres CLONE 1583080
  misc_feature: Encodes the peptide sequence at SEQ ID NO. 93646
  misc_feature (1)..(1): n is a, c, t, g, unknown, or other
  misc_feature (23)..(23): n is a, c, t, g, unknown, or other
  misc_feature (37)..(37): n is a, c, t, g, unknown, or other
  misc_feature (1304)..(1304): n is a, c, t, g, unknown, or other
ngatgtgggcaaaaataagagtntgtagagggatacnaccccccacaattataggcaaagcacaacacacccaaaagctggactccccgcggtggcggccgctctagaactagtggatcccccgggctgcaggaattcgtctcacccctagaaaaaactatatgaaacccttctttctcaatcttcccaccaccctcacacttcgccctcctcccggcgaggtcgcctctgcttccgactgcgcccgaccccagtctcgcctgcgtccaccggcatggcctcacccacggtcgcctcccctacccgggcgagccccgccgacatccccaccgccgcaccctcgtcggacccccggccgcggggcctcgcgtcggcgccgcccgcaggctacgcgtttggtacttcttcccgggctcccactactccggggaacaatttttagcccccaagcctacaaacccggtggcccccccccccaacgaagaagaaagggtttctgtttccggtgggccccccaacaagggtcttcgtgggaaaaaatttaaagggtgccccctccagagaaaaaaaatttgttttttcaggggagaagaggggaatttaatttttttccacgccaggaagtggtggtgtgcgcgccagaaaccattttttggggcctgtggatagaacgaaaaaaacaaacaacccgtcccgttttgcgcggggaggggggaatcacaaaataggttttctttcaaataacgataaagaaacgcgggaggcgccccaattttgtttgttctagacaagcacccgctagttgaggaataaaagtttcgtcagaatgtggtgagtgagagattacaatggggacgcgccgacgcctcctctaggggagaacatgatgtgttgtatttcaataacaccgaaaggatgtatcggatcttcgcctcacacgcatgagtatctaattgtgtaataaatgaggtgtggtacgacaaaacaagactagctgtttctcatggatatgagagggagcatatactgctttaatatatgagagagtttggtggaggaaagaaaaataagagagtctttggataggacaagtcatcggcgtacaaaagaaacagaggtattgtgttgtttcctcctgggcgggggagaacagatcagcaaggacaccgtcacaagttatgtgatgaggttaggcgatctttaccctcgggtagcggagtgatctaaagtaaatggacatccactgctctgcattcacgctacgaggctgaattgttacagtagagtcactcagagaacataan

SEQ ID NO: 93646 - protein, 55 aa, Zea mays
  misc_feature: Ceres CLONE 1583080
MASPTVASPTRASPADIPTAAPSSDPRPRGLASAPPAGYAFGTSSRAPTTPGNNF

SEQ ID NO: 93647 - DNA, 1333 bp, Zea mays
  misc_feature: Ceres CLONE 1583082
  misc_feature: Encodes the peptide sequence at SEQ ID NO. 93648
  misc_feature (1039)..(1039): n is a, c, t, g, unknown, or other
  misc_feature (1200)..(1200): n is a, c, t, g, unknown, or other
taaaattaaaatacctccgtaattgctatttaatttgtctcttggcccacgtcagccattcgaacccaaccactcaccgagaaacaccaacatgccggccgctctacaactagtggatcccccgcggctgcaggaaggcgtctcacccctagaaaaaatacatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatgaatctgccttgcttcttgggcagctctgctaccatcgctagcatctggaaatgtgggtgcagcagctccgatactgagagcagattacataaaattggacttcagctaccgttttcgcgacccccgacaagtacaagagcttcatcgccttctgtttgaggtggtttttccccccccaaactggtggcaacagtagcgggaaccccctgtctggttgaacaaaaattaaaccgattattagatcgaaaaaagagtcctaaaacggttaactctgagttgaaaaaaaggtaatgggcgcgtcccgttaagacttttaaagaatggaatgagtctcccgggaagtcttaatattttgtcggggccatatcattaagaaaggggacttaccggccatcgtgcgccctcccccttgaaaatgaaaatcccagggtgccccacaacagagtacgctatgtatatgggtgtaaaattcttgaatgtctccaaccccgagtagaggtgtcccacacggaggggggagaaatatatagatatattgtaggggggagtccacctgagacggaccacacgcctgctcaacgcgatgtgctctcgtagttataatgttctgctgaccgaggtacgatacacgactgtgactagatggagaataccatcaagagtggcggtatatcataagggatatatatagcggaattaaaacaaaaggagaagaaagacacgctctgatatacncaagagggtacacgtatatattaactatgtcgaagaggacgaactcccctatgttctccatccttatagatgtgggcaagaggaccaatatacctcacaactaaaaggagagatatactgttggaagacatggtgtgtgagatctctatcccgccccgcanattgagaatgagatgtatatttaattatcgacacatcaacccactacgcgataacaaatcattttttattagatatatatccactagctcccgcttctaattagtaatacacgctcacatcacttgtgtgggt

SEQ ID NO: 93648 - protein, 61 aa, Zea mays
  misc_feature: Ceres CLONE 1583082
MPAALQLVDPPRLQEGVSPLEKIHPQPNKFRYKNIASPALWRVWILLNLQAASDERRDASN

SEQ ID NO: 93649 - DNA, 1213 bp, Zea mays
  misc_feature: Ceres CLONE 1583087
  misc_feature: Encodes the peptide sequence at SEQ ID NO. 93650
  misc_feature (12)..(12): n is a, c, t, g, unknown, or other
  misc_feature (37)..(37): n is a, c, t, g, unknown, or other
  misc_feature (46)..(46): n is a, c, t, g, unknown, or other
  misc_feature (1143)..(1143): n is a, c, t, g, unknown, or other
tttttttttttngtttttgtgttgtgtgtggtgtttnaggtgggtnctggggtttttttttttttattttacaaactggacctcacgcggtggcggccgctctagaactagtggatccccgggctgtttgattcgtctcacccctagaaaaaatcctcgctcctcttcggagcctccctttcgccggcggcgtaggaagagatggcagagcgtttgacccgtatcgccatcgtcagcgaggacaagtgcaagcccaagaagtgccgccaggagtgcaagaagagctgccccgtcgtcaagactgggaagctttgcattgaagaaacttcagcatcaaaactagctttcatttctgaggagctgtgcatcggttgtggtatccgtgtcaagaaatgtccatttcgatgctattgaattcatcaaccttccaaaaagattttgaaaaggactaccactcaccccatgtggggctttaataccttacaaagttgccacaggttacctccacttcagtcgcagtcttgagtgcttgacaggtgggtggggaatacttttttaaaggagactgtttgactcactcctgaatcggtttcttccaattcattattcctagggcatttggataagatgatgtgccccactttaccggggggtcgttctctccttcattcttaagtacccccggctacgccgatcatagtgtccccgatgtttcttacagaggatccgccgggggagaaagaggggctacgcggtcgagcaccgaccagcgtaatgttataaaatattagattatcggtagcaactttgaaggtacgaaagtgtaccgaataccacggttactcatcaatgaggggtgtggggtgtgggcacaatgtgctaggaaggtggttgtggtgcatccccccactctccctctgatatgggacattcgctcttatcaatatttgtatcatattttcattacaagatctcaacgagccgtcccctaagcaacaaccatgtcattttctccgcaataatagaaggcgcgtattgtatgttgggaatattcctctatagtctaaagagaaatcatcatgtggatcacgtcttgtgggagcgaggaagggccctacctcttctcgtctgcgcttctgcccnacatatgactaaaccatgagtccctgtatgaataataggacaggcagacgatattactacctctactatg

SEQ ID NO: 93650 - protein, 70 aa, Zea mays
  misc_feature: Ceres CLONE 1583087
  misc_feature (6)..(37): Pfam Name: RLI Pfam Description: Possible metal-binding domain in RNase L inhibitor, RLI
  misc_feature (48)..(71): Pfam Name: Fer4 Pfam Description: 4Fe-4S binding domain
MAERLTRIAIVSEDKCKPKKCRQECKKSCPVVKTGKLCIEETSASKLAFISEELCIGCGIRVKKCPFRCY

SEQ ID NO: 93651 - DNA, 1303 bp, Zea mays
  misc_feature: Ceres CLONE 1583088
  misc_feature: SWISSPROT Homolog: EC 2.7.2.3 Phosphoglycerate kinase
  misc_feature (74)..(74): n is a, c, t, g, unknown, or other
ctttaataacgtatattattaatatatatgaccccaccctctccccccacacccccaatccctccccttactcntaccaatttaactcaccgcggggcggccgctttagaactagtggatcccccgggctgtatgaattcgtctcacccctagaaaaaaacccgaagcacatcccgtcgcatcccatcccactaccacccatctcgtcgtccgccgattcgatccggttcttccaacccacggtgcagtgatggctacgaagaggagcttgggcaccctcggcgaggcgggatcttaaagggaataaggtggttcgtgcgcgccgacctcaacgtcccgctcgacgatgccccgaagattatcgactacacccgcattcgagccctccgtccccaccatcaatgtttcttcctccaaaaaggcgccaaggtttttttttttcaagacaaatacgaacctcccaaaaaggtgggccacccctaaaaaaagggcccccccccccccccttgattcaacccatgtgtcgaacccccctttggaggtttaaaaatttgcgtagggggccacaagattggcactcagggtaaaaaaaaatttgaaaaaaaatcgactaaggccgcctattgtaacaaaaaaagtggggaatttttttatccccccaccaaaaataaggtataagcgtattcaccccatcggtacgtgcgacgtgagatattatctcttacccccctccgacttcttggggtgaaataaaatacttcagagcgcttattactggtctgcgtgtgcgactactttaatgtgttcccacacacttagtctacctaggatttttggagacgaacgggtcagccccacccctattcttcgtactaccggctttgtctcttccagacccccctcacatgaggtgatttgttacgctcagctctaactctctctatttagcgcaataattattatgtttgttggattagcagtcccatgctctctctgcttgttatatgtccctatacgaggagagaatctatgctccttcacatctccccggtgtatagaataatgcacttgatgtgcctgagatcaccgccatacagtagtatgcattgtctttgtagctgcacctcttattatgagatgaaatctaggccgatattaacgtagtgtgatgaacaattctactaccgtatcttgtctctatagtattgtgagtcacgccatattgtccatcgccgctacctccatcaagttatatattcccctcctattatttatccatgatagagacggctcgcggtagtat

SEQ ID NO: 93652 - DNA, 1246 bp, Zea mays
  misc_feature: Ceres CLONE 1583093
  misc_feature: Encodes the peptide sequence at SEQ ID NO. 93653
  misc_feature (63)..(63): n is a, c, t, g, unknown, or other
  misc_feature (67)..(67): n is a, c, t, g, unknown, or other
atacccgagtaacactaaattgtatcagccgccacccttatcattatttcacgtcgtgaattncccncaccaaactggagctccccgcggtggcggccgctctagaactagtggatcccccgggctgcaggaattcgtctcacccctagaaaaatctttatacgagttcctggcgaaaaaactcacaactacactagttgtggcgactcagtcacacacagacacacacgactacacgagccgccgcagccgccgagccgagctccaagcggaggagaataggagagaccaccgatccgccgtcggagatgagggaggaggcgctggagcggctgcgcggggtggtacgggacagcgccgggaagcacctctacacgtcagtcatcttcctcgccgacaaggtggcggcggccacgggggaccctggcgacatctacatgctcgcgcaggcactcttcctcgggcccccccccggggatgcgctccaccttcttaaaaattctcacctgctcccccaacttccggtttcagatttcttcgccccccaaagtgccctcagggagttgaaaaaagtgggatctcacggtttgttttaatgcttgggggaatgcaaaaagggggatgaggccatgggaaaatgtgcctttgaattcatgaaaggaatgaaccgggtggataattttcacttttttaaatataagggaccgcccggaaaaaaaatcccctgtaggagtttaactttttttcaagatatcccagcgctcccagaattgaggtgtgtctcctataaaaccctgggggggcttaaatgaggggcgttcttatattttgtaaaaagatcctcttttgtgtgaaaacacaaaccccggggggggacatacgcttatggtggcggtcgcaccgccaaaatgtgtggttggaacatgaggggggtacaactgttggttttttaatagaactcggagagaatccttctcgggggggggtgctaaagtgggaggggttattctctccagaaaaagcctccttgtgggggtgggacaaagtatataatataagcttttaacaccactctgttatgatggagagaaaaattctccctgaggtatgataagtttcctctcgattgtgggacacttatgtagtggaaaaaaaaaaaaaagcgggggcacaattaatataccgatgtcacgccgccgccgttgttctattccaaagccgtgaggagaaaaaataatatttattt

SEQ ID NO: 93653 - protein, 95 aa, Zea mays
  misc_feature: Ceres CLONE 1583093
MREEALERLRGVVRDSAGKHLYTSVIFLADKVAAATGDPGDIYMLAQALFLGPPPGDALHLLKNSHLLPQLPVSDFFAPQSALRELKKVGSHGLF

SEQ ID NO: 93654 - DNA, 847 bp, Zea mays
  misc_feature: Ceres CLONE 1583094
  misc_feature: Encodes the peptide sequence at SEQ ID NO. 93655
  misc_feature (482)..(482): n is a, c, t, g, unknown, or other
  misc_feature (631)..(631): n is a, c, t, g, unknown, or other
  misc_feature (637)..(637): n is a, c, t, g, unknown, or other
  misc_feature (769)..(769): n is a, c, t, g, unknown, or other
gctgtggcggccgctctagaactagtggatcccccgggctgcaggaattcgtctcacccctagaaaaactctccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaggactcccaattcgcttcggcggtcgagctccattgtcacaagctgctccaggccaggcctatcaatctcaagcctcggcagaggccggcatgcgtgtcggcgtcgctgtcgtcggagcgcgaagcggagtactactcgcagaggccggccacgccgctgctanatacccatcaactacccgttcacctgaagtaactgtctgtgaaagagctgcggcagctggccgaacagctccggtccgaagtcatctttcacggtttcaagatcgggcggccacctcgggttccggcctcgggcgtgggggagattcancgtcgncgcctgcattaagtcctttcaaagcggcccaagaatcccctttcctctggggaagttccggccacccagttcgtatccccccaaagaatcctgaaagggtccggcgcgaaaaagaatgccgacccatgcggncaagaccaaaagggcccgtgggggggcttcctccaaggcgcgcccccaaagggcaagtaccaacagcccttccggcag

SEQ ID NO: 93655 - protein, 82 aa, Zea mays
  misc_feature: Ceres CLONE 1583094
  misc_feature (73)..(73): Xaa is any aa, unknown, or other
MALSTFSVPRGFLGVPAQDSQFASAVELHCHKLLQARPINLKPRQRPACVSASLSSEREAEYYSQRPATPLLXTHQLPVHLK

SEQ ID NO: 93656 - DNA, 862 bp, Zea mays
  misc_feature: Ceres CLONE 1583097
  misc_feature: Encodes the peptide sequence at SEQ ID NO. 93657
ctcaccgcggtggcggccgctctagaactagtggatcccccgggctgcaggaattcgtctcacccctagaaaaaccgccaccgccaccgccggctcctgctgccaccgcccgctggctggcttagcgcgtaggctgtgactgactgactgactgcgagaccacagcaccggaggacgcccgcgcgcgcgaaccgcagcgcagaggcaggggaaccttgtccgcggctcggccggcatgaagctcccgctgctgcgtccgctgtggccgggcctggggcctgcggcggcggggccgcccgacgcggcgccggagccggccaagccctcgctgccggccacgtggctgctgctgcacgcgctcttctgcgccacatccatggccgtcggcttccgcttctcccgcctcatcgtccttcctcctcctccctgcccaccccggcccattaaacccccgccgcggaaccttggttttcgctcgtggtcctccgccccccccgggggggcctcgccgggggggccaaacggccccggggcccccgattctccctaggtaacccccttcccacctaccctcctttcgggtttcacccaccccccacccacccccccgggggggccgcccaaaaattttgggggggggccccaacccgagaacaacacaccaaacaacgggggagggggcccccttttttttttgtgggcgcacccccctatttcccggtttccccccccctgggccccccccccggggccccccccgcggagtgccccctagggggggtaccccctttttttctctccccgccgtcttaaaaaagggggggggcggggctacaataaactccccccgtgggggtggagt

SEQ ID NO: 93657 - protein, 104 aa, Zea mays
  misc_feature: Ceres CLONE 1583097
MKLPLLRPLWPGLGPAAAGPPDAAPEPAKPSLPATWLLLHALFCATSMAVGFRFSRLIVLPPPPCPPRPIKPPPRNLGFRSWSSAPPGGASPGGPNGPGAPDSP

SEQ ID NO: 93658 - DNA, 1118 bp, Zea mays
  misc_feature: Ceres CLONE 1583098
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (1041)..(1041): n is a, c, t, g, unknown, or other
nnnnnccccccnncncccgggaggggcgggcgcgggggggtgggaaagggtggggtcggggaaagtgtaaaaaaattggagctcccgcggtggcggccgctctagaatagtggatcccccgggctgcaggaattcgtctcacccctagaaaaaaccgccaccgccacatccggctcctgctgccaccgcccgactgcctggcttaactcgtacgctgtgactgactgacagactgccagaccacagcaacggaggacgcccgctcgcgcgaacagcagcgcagagacttgggaaccttgtccgcggctcggccggtatgaagctcccgctgctgcgtccgctgtgaccgggcctggggcctgaggcggtcgggccgcccgacgcggcgccggagcctgccataccctccctgccggccacgtggctgctgcgtgattggctcttcaaccccacgtccatggccgtcggcttcggcttctcccgcctcattgtcttccctcctcttccctgcccacccacgaccatctaccccgttccgctccaccttcatactcgcatacgtgttcctcctccctaccggtgtgccccagggggggggggaccaaaagtgcaaggggggttttggaattcccccgaacgaaacccgccagacggggcggagcgcaacccaatcggatgcttcccagtcccacgcccaaacaatggcataaacttgtgggggccgctgtgccgctaatactctaccgggaggggggtgttttgaccacactaaccttcgaggcccacggtggaggtgcccgcggcaattgcaccgccggttcccactgaggagtcttcccacgagagtttgtatcctagttggggagcgggtgcaacaccccacattagaatcccgcgcgtacatggtcgcgcccggtggagacccaccctcccccacgggcacacaccatatccaagttttctcctttatacgggggaattaaatgtggtgtccatgacccccccacggttcatagaaaacgccggttaagtcatatgaanaaatatcggcccggaccccacggggaaaaccagaaaagtcccgggcaataaggcctatacaccaccaaaccacaagg

SEQ ID NO: 93659 - DNA, 1031 bp, Zea mays
  misc_feature: Ceres CLONE 1583100
  misc_feature: Encodes the peptide sequence at SEQ ID NO. 93660
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (31)..(31): n is a, c, t, g, unknown, or other
  misc_feature (33)..(33): n is a, c, t, g, unknown, or other
  misc_feature (35)..(35): n is a, c, t, g, unknown, or other
  misc_feature (42)..(42): n is a, c, t, g, unknown, or other
  misc_feature (44)..(44): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (61)..(61): n is a, c, t, g, unknown, or other
  misc_feature (68)..(68): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (486)..(486): n is a, c, t, g, unknown, or other
  misc_feature (535)..(535): n is a, c, t, g, unknown, or other
aaaagaaagannnnnnnnnnttttgtttttncntnttttttnanaaccacgnnnnnttttntcccaantnnnnnccgcaannnnnnaaaactggagctccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaaccctcagtacgtgcgcctcgggtaccactacctcatcagccacggcgtgtacctggccaccatccccgtcatcntgctggtgtgcggcgcccgagctgggcagcctcaacccgcgacgagctngtggcgcaaagttgtgggggggaaggccacctacgaccttcgccaccggtgctcggccttcctcgccggtcctcggcctttcaccaatctccgtctaaaataatggtccagggccccgggcccggggtaccttcatcgaaatttccaatggcaaaaaaccccggcccaaaaaaacttcaaggggtgttccaaagggcggagattttttttcaacctctggggccggcaaaaatcccggggaaattttctcacaaaaggaaaaaacccctgggggtttttccaaatccccgcttttgggtggggggcaaaaaatccggggttatttggggaaaaagaaattttttaaaaatttcccccccctctgtttttttttttaaaaccccaaaaccccgggtgtgtggccccaccctgtataaagagggaggggcccgcccccccaaaagggtctcccccccgcgcccttgtttttcccccggcgcccttggaaaaataaatt

SEQ ID NO: 93660 - protein, 120 aa, Zea mays
  misc_feature: Ceres CLONE 1583100
  misc_feature: SWISSPROT Homolog: EC 2.3.1.119 Icosanoyl-CoA synthase
  misc_feature (71)..(71): Xaa is any aa, unknown, or other
  misc_feature (87)..(87): Xaa is any aa, unknown, or other
MAREEQALLSTEIVNRGVEPSGPDAGSPAFSVRVRRRLPDFLQSVNPQYVRLGYHYLISHGVYLATIPVIXLVCGARAGQPQPATSXWRKVVGGKATYDLRHRCSAFLAGPRPFTNLRLK

SEQ ID NO: 93661 - DNA, 1163 bp, Zea mays
  misc_feature: Ceres CLONE 1583106
  misc_feature: Encodes the peptide sequence at SEQ ID NO. 93662
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (65)..(65): n is a, c, t, g, unknown, or other
  misc_feature (1054)..(1054): n is a, c, t, g, unknown, or other
gtggtggggtgnggtgnntntttgggggtgttggggaaaggtttattatgttttattttaggagntacggatgctataaaaactggactccccgcggtggcggccgctctagaactagtggatcccccgggctgcaggaattcgtctcacccctagaaaaaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcctcctcttcctctaagcccacctcccttttccactcccttccctcaaagaaatcggtgggccccaccccccggcgcattcggaattcttcccttgaggggctcacccccgtaaccggcttcggacttcgacggcggggggtcaagcgaccggaacccgtggccgggttccaggaaccggcttccaggagccgggctcccagcacacggggcccccccccccaaagaaaacccccccgcctggaagggcgcgcggccaatctaaagcccgtctcccgggggcctcccaattcgggaaactggggaggtcccccccatcttgggggttaaatttcacgcagcccccaccccggtcgggggatgtggcccccccgaaaaatagccccgtggggggaatagtcttccccaaaagagaaaataaaatagccctatcttccgaacaggcatttgtgtttgggggggcattaccttttttcacgccccctcgaaatacggtctgtgtacgaccctctctttcggtgacgcaggtgtgtatatacccctattcacattgggggggacttttgcgggggagcccagatccgcgtgggttctcgagggcccgtgtgtaaggcctattacagagtttgtgtgccgcggacggggacctctttctctccggaggctctttgacggagtggaaaacgcgcaatttccctcctgtgggaagaaatgatgagggaggtgggaccctatatctgtctataagncgaaagggggggggttctcatatcaaagaaaacgcggcacgctggggtgttccaccacataaccgcacaagaatctcacttcgggcgccccaccccatttgggggtccc

SEQ ID NO: 93662 - protein, 143 aa, Zea mays
  misc_feature: Ceres CLONE 1583106
MASSTAASPLTCHHLGSVGARPRLPSLSISLRRRSSSSSKPTSLFHSLPSKKSVGPTPRRIRNSSLEGLTPVTGFGLRRRGVKRPEPVAGFQEPASRSRAPSTRGPPPQRKPPRLEGRAANLKPVSRGPPNSGNWGGPPHLGG

SEQ ID NO: 93663 - DNA, 816 bp, Zea mays
  misc_feature: Ceres CLONE 1583109
  misc_feature: Encodes the peptide sequence at SEQ ID NO. 93664
  misc_feature (241)..(241): n is a, c, t, g, unknown, or other
  misc_feature (321)..(321): n is a, c, t, g, unknown, or other
ctggagctccccgcggtggcggccgctctagaactagtggatcccccgggctgcaggaattcgtctcacccctagaaaaaataccacagcacaaacgcaacgcgacgcaccaagctctgagagtcgcaatggagagatcagctgagagctggtgggtgcttcccatgaccttgatcccggccatctccggcgagcaacacggtaacatggctaccgtagccactagcttcgcctacctcgncatcttcgcgtgcctcgcatgggtgggcgcgtccctgctctactgggctcacccaggcggccctgcgtggggcaagtacntggagggcgatgggggaagaagccgtcggcggcgatcccagggcctaaggggctcccggtggtcggcagcctcggcctcatgtccgggctggcgcaccgctcgctggccgacgaggcgtcgcgccgcccgggggccaagcggctcatggcgctgtcgctcggccccgtccgcgcggtcgtcacgtcccacccggacgtggccaaggagatcctcgacagcccggcgttcgccgcccgccccctgaaccacgccgcgtacggcctcatgttccaccgctccatcggcttcgccgagcacggcccgtactggcgcgcgctccggcgcgtcgccgcgggccacctgttcggcccgaggcaggtcgaagccttcgcgccgtaccgcgcggccgtcgccgagggcatcgtcgcggccctgatgcgcgccggctccgggcgcgccgtcgtccaggtgcgcagcctccttgcgcgggcgtcgctctactacatcatgcggtt

SEQ ID NO: 93664 - protein, 185 aa, Zea mays
  misc_feature: Ceres CLONE 1583109
  misc_feature: SWISSPROT Homolog: EC 1.14.13.68 4-hydroxyphenylacetaldehyde oxime monooxygenase
  misc_feature (21)..(21): Xaa is any aa, unknown, or other
MGGRVPALLGSPRRPCVGQVXGGRWGKKPSAAIPGPKGLPVVGSLGLMSGLAHRSLADEASRRPGAKRLMALSLGPVRAVVTSHPDVAKEILDSPAFAARPLNHAAYGLMFHRSIGFAEHGPYWRALRRVAAGHLFGPRQVEAFAPYRAAVAEGIVAALMRAGSGRAVVQVRSLLARASLYYIMR

SEQ ID NO: 93665 - DNA, 791 bp, Zea mays
  misc_feature: Ceres CLONE 1583110
  misc_feature: Encodes the peptide sequence at SEQ ID NO. 93666
  misc_feature (334)..(334): n is a, c, t, g, unknown, or other
  misc_feature (772)..(772): n is a, c, t, g, unknown, or other
acccgcggtggcggccgctctagaactagtggatcccccgggctgcaggaattcgtctcacccctagaaaaaacttctctaccgccgctgtgcctgtgctagctcctctctctgcttctgcttctgcttttgcctcactcagcctgctgcaagcttttgctttggtttaggtgcttcttttgcattcctttactgttcccccccactttcgctcgctttgccacgcacacgaaaagctcctgcctttaccttctcggaccttatctccgccccgtagtgggattttggtgggagctgcgctgcagctgcttgccccctcgcgtttctttgctcnattgggggtgtcgcgcgtgctcgtgggcggaattcggtgttcttgcttgcgcggtccacgtccccgtccccgtccccatcccttggcgcgattgcggttgcggacgctcgctgcagatcttcgcgcgactccgggagcgccgccggagatggactgcgggccgcccgaccagctgccgccgtcgtcggcgccggcgtgcttcctcaacctcaactgggaccagtccatggccgccgccacggccggcgaccacctcgacctggtctcctccccggctccaactccgaccgggcggctgacggcctcgctcctccacgggatctcgccgcagccgcagtacggaggcactccgctcagctcgcccccgcagctgaacctctcgatgatgggccagttcccacactacccgccgatgggccatctagtacagttcctcgncgaacccatgcttcgccgc

SEQ ID NO: 93666 - protein, 103 aa, Zea mays
  misc_feature: Ceres CLONE 1583110
  misc_feature (97)..(97): Xaa is any aa, unknown, or other
MDCGPPDQLPPSSAPACFLNLNWDQSMAAATAGDHLDLVSSPAPTPTGRLTASLLHGISPQPQYGGTPLSSPPQLNLSMMGQFPHYPPMGHLVQFLXEPMLRR

SEQ ID NO: 93667 - DNA, 909 bp, Zea mays
  misc_feature: Ceres CLONE 1583111
  misc_feature: Translation starting site: 138
ggcggccgctctagaactagtggatcccccgggctgcaggaattcgtctcacccctagaaaaaccccctcctcccaaatgtctggtccgtagtcgcgtccgccgcacgtctcaatgggcggccccagcgtgccctgaatggctctggcggccctgctcgcggtggcagccctcacgtgctgcgcagtcgcggatccgccgccgagcgagcggaccgctctgctggcgttcctcaccgagaccccggacgagtcgccgcctcaggatggaacgcctccaccccggcgtgctgctgggtcgggatcacgtgtgacaacacctactccaccgtgcatcgaggagcgcctcccgggcgtgggcctcaggggcgtcatgatgtctggcactctcaggcggttatcaacctccgcgtgctctggctccgatccagcgagtgctcgggacccgtcccgacgacgtgctccagcttgccagcctcaaggcgctgattctgcgagataagctgctctctggccccatcccgacgggaatccagaagctctgcggactccagtcgctcgtgctctctcacaacaacgtatcaggctccatgacctttgcactcaaaagatcacatccctgcaagtgtttaagctcgaacggagacatcttctcatggatgcattccaagactcagacatcccggggctcgttcgcctttcaacttttcacgaaatgagcttccaagggttacttcccgaaaattgggtgggcattttgcgggcaggaaatcctttctttgggaaaaacttgcaaggttaaaggccggaaccttgttgaacaattccttttgggagaatctttttctttgtcccccgaaaaagcattgtctcggggaaatttaaaccttgtggcacctgttgaaaagggc

SEQ ID NO: 93668 - DNA, 1115 bp, Zea mays
  misc_feature: Ceres CLONE 1583112
  misc_feature (14)..(14): n is a, c, t, g, unknown, or other
  misc_feature (17)..(17): n is a, c, t, g, unknown, or other
  misc_feature (53)..(53): n is a, c, t, g, unknown, or other
  misc_feature (65)..(65): n is a, c, t, g, unknown, or other
  misc_feature (66)..(66): n is a, c, t, g, unknown, or other
ggggttggtgtgtnttnttttttttttttatggtttttgtgagctgcttcttntctcttaggtgnncccccaccatttaaaagctggagctccccgcggtggcggccgctctagaactagtggatcccccgggctgcaggaattcgtctcacccctagaaaaaacttctctaccgccgctgtgcctgtgctagctcctctctctgcttctgcttctgcttttgcctcactcagcctgctgcaagcttttgctttggtttaggtgcttcttttgcattcctttaatgttccccccccaacttcacctcccttttttccaccccaaccaaaaactcctgcccttagccttctccggaaccctatcccccgcccccctaaaggggaattttgggaggaaacctcccctggttacttttttgtcccccctcgcggttttcctttggcccaaatgtgggggggtgttcccccccccgcccccccgtggggcgaaaattcgggggtttcctccccccggcccaggttccaagtttccccggttcccccttgcccccattccccttgggggcaaaaatgtgcgggtttgccgaaaaaccccccctggcaaaaaattttgggggcccattttccccggggaacccccccccccggaaaaatggttattgtcgggggccgcccccccaaataccctttttgttcccccccgttttttccggggtgccccaggggcgtgtgtttttcccccccaaaacctcccaaattgtgggggaaccactttccccaaggtgtccgccccgccccccagaaaatcccggcgtgaaacccaacctcccccaaacacggggttcccccccttcccccccggggctttcacaaaatttttcaaagaagggcggctttggtaaggatccctactacgtttttctccaccgggtgaaaaattccctcccccccccatttcccccatttttagggtgagaggtaatttccccttttaaatgttttcgccccccccccaagagccggaaaaacactctccccccaaggaaagagggggcccctttttctccccctcatataaccccccccccaaagggggcgcacctctctgattatcac

SEQ ID NO: 93669 - DNA, 1198 bp, Zea mays
  misc_feature: Ceres CLONE 1583113
  misc_feature: Encodes the peptide sequence at SEQ ID NO. 93670
aaagagggggctctattctgggatgttgtggtgggtctaaacaaacacaagggaaacggccgccaccaaaataaaaaaaagaacatcccgcggtggcggccgctctagaactagtggatcccccgggctgcaggaattcgtctcacccctagaaaaaaccaccaggcaccagcatagatctcgtgctcgccactattattctgcacagcaacgcatcagccttctggaaccatctcgccgccgccacaccacaatccacaacccgtcgaagcgaagcaagcaatggccggagtcggatcgaaggccctcgccgttgccgccgttctggcggacgtctccttctcggtggccgccgcggccgaggcgcccgcgcccagccccgtctccgccgccgtcgcggcgtcgacgccctacgccgcgggtctcgacacctccgccgacggctttcctcttcggcgccgtccggcactgagccccaaggggcctcgtgcctgcagggctacctagcaaaaattacccccgccgccgccggccggcggcctaaaattctaatttatttggaagtggctattcccgccaatactaatgaggaggtggagaattttggtcccgggggctggacccaggtgcccccccccacaatttttttggttcggaaatctatgggttttcccgtgtgggcgccaccggggaagggggtttctctaatatcccccatgagacccggggggtgttccccgactatgtagtgctgagaatctctcctttcccccgcccccccgtttgtgtagaaaacaaagggaaccctccgcgcgcctctatatcaacgccgggtccccagtgagaagccgcgtgaaaaaactgggagggcgaaattctctctttctcctggggggggtgcaaatattaatgtgggcacaaaccgcaaatattttcgtgcctcgcgcccattttttgggggctcgggagagacccccatgtgactttataatagttaagggggtgtgggcccccctccctctcttttggggggtgttcttttggcgctcgccgcgcattactccgagctcccccgaggagtttttctcccgcggtcccacagagagagggggggggggttatatattcttattccccctcaaagagaaaaggtggtgtattgtggaaaaatgggaaaatattctgggggggtgtttaa

SEQ ID NO: 93670 - protein, 74 aa, Zea mays
  misc_feature: Ceres CLONE 1583113
MAGVGSKALAVAAVLADVSFSVAAAAEAPAPSPVSAAVAASTPYAAGLDTSADGFPLRRRPALSPKGPRACRAT

SEQ ID NO: 93671 - DNA, 911 bp, Zea mays
  misc_feature: Ceres CLONE 1583114
ccccgcggtggcggccgctctagaactagtggatcccccgggctgcaggaattcgtctcacccctagaaaaaaccccaggtcgtcacgcccgccgcgagaggcagcagcctccgcccgagctgctagcccttctaaccttgctcgacccttgcccgccgcctgaactcgcctcccccgcggccggtcccctgcatctgttcgccgcgccgcaacccggaggagactacgactacgagcaccaccaggtagcagcaactgttttgctgcattctggcaaagtggaggttttaacagtcgctccttcttttatgtcggaacatcttttgctttatttgggatggctgggagagtatttcttcccccccgaaggaaaaggcccaaattttttgcccccctggcttgcaattaaaagccccatccgggttccctttgtttccgggggggtcccttcccccagggccccaaaaacccgggtttggtttttttttgaaaaaataagccgccccctctcttttgatttcgggggttttggtgcccccccttgaaagcgacttttgggttaaaaaaaaacttttttttccaaaaaagggggcctcttcacaaaaatttggggggggctttaaaaagggggggggggggggtcctttttttcaggggggtaacaaaaagggccccccaaaaagtttttttcccccacatataaaaagggggcgttgtgttatattgtgttttctaaaaaaaaaaaattttttttaaaaacagggggtgttaaacaaaaaaaaaaaaaaacattttttttggggggggggggttttttttttattattacacaaaaaaatattttttggtggggggggggggggggggggtcccccccccccccacctattttttttgtaaagaacacacg

SEQ ID NO: 93672 - DNA, 799 bp, Zea mays
  misc_feature: Ceres CLONE 1583115
  misc_feature: Encodes the peptide sequence at SEQ ID NO. 93673
  misc_feature (589)..(589): n is a, c, t, g, unknown, or other
  misc_feature (723)..(723): n is a, c, t, g, unknown, or other
ctccccgcggtggcggccgctctagaactagtggatcccccgggctgcaggaattcgtctcacccctagaaaaatcgcagcatctccctcgccccaccccaacctccacctccaccgccacccattgaaaagcagagcggcagactggcagaggcaggcgctctcggctctcctcgtggacaaaaccaccggctcccgatatccaaattggaacaggggattctgaacttggggtttgttccggggaccgattctggcatcggcagacgggatgtcagcccccctcgaccgacttgctaggccatgttttgaagggtttgtacataacgatgaaaggaaagagagcagatctgatgcagacaactcagaaggagataagaagactaagatcggatctttcaagaaaaaagcaattaacgcggggaacaaattcaggcattccctgagaaggagaagcaaaaagaagaccgaaaggggggattccatcaaggatataagggacattaaagaacttcaagatgttgagacatttcgacaatgcttaattgacgaggatttgctgccgccacagcatgacgattatcacatngatgttaaggttcctaaaagcacggaaaatttgatgttgagaaagctaagaatatgtggtcagacatgctttaatggaggaagggaattcggggttgacaaaatagaggaatttgagtacgccgaattagatgnagttaaaaagtattacccacatttttatcatggggtagataaaagagggaagacctgtctacatagaattaatagg

SEQ ID NO: 93673 - protein, 176 aa, Zea mays
  misc_feature: Ceres CLONE 1583115
  misc_feature (106)..(106): Xaa is any aa, unknown, or other
  misc_feature (151)..(151): Xaa is any aa, unknown, or other
MSAPLDRLARPCFEGFVHNDERKESRSDADNSEGDKKTKIGSFKKKAINAGNKFRHSLRRRSKKKTERGDSIKDIRDIKELQDVETFRQCLIDEDLLPPQHDDYHXDVKVPKSTENLMLRKLRICGQTCFNGGREFGVDKIEEFEYAELDXVKKYYPHFYHGVDKRGKTCLHRINR

SEQ ID NO: 93674 - DNA, 784 bp, Zea mays
  misc_feature: Ceres CLONE 1583117
  misc_feature: Encodes the peptide sequence at SEQ ID NO. 93675
ccccgcggtggcggccgctctagaactagtggatcccccgggctgcaggaattcgtctcacccctagaaaaatcgcagcatctccctcgccccaccccaacctccacctccaccgccacccattgaaaagcagagcggcagactggcagaggcaggcgctctcggctctcctcgtggacaaaaccaccggctcccgatatccaaattggaacaggggattctgaacttggggtttgttccggggaccgattctggcatcggcagacgggatgtcagcccccctcgaccgacttgctaggccatgttttgaagggtttgtacataacgatgaaaggaaagagagcagatctgatgcagacaactcagaaggagataagaagactaagatcggatctttcaagaaaaaagcaattaacgcggggaacaaattcaggcattccctgagaaggagaagcaaaaagaagaccgaaaggggggattccatcaaggatataagggacattaaagaacttcaagatgttgagacatttcgacaatgcttaattgacgaggaattgctgccgccacagcatgacgattatcacatgatgttaaggttcctaaaagcacggaaatttgatgtttgagaagctaagaatatgtggtcagacatgcttaaatggaggaaggaattcgggggttgacaaaatagagggatttgagtacgccggagttagatgaagttaaaaagtattacccacaattttatcatggggtagataaagaagggagaacttgtctacaa

SEQ ID NO: 93675 - protein, 118 aa, Zea mays
  misc_feature: Ceres CLONE 1583117
MSAPLDRLARPCFEGFVHNDERKESRSDADNSEGDKKTKIGSFKKKAINAGNKFRHSLRRRSKKKTERGDSIKDIRDIKELQDVETFRQCLIDEELLPPQHDDYHMMLRFLKARKFDV

SEQ ID NO: 93676 - DNA, 843 bp, Zea mays
  misc_feature: Ceres CLONE 1583118
  misc_feature: Translation starting site: 135
  misc_feature: SWISSPROT Homolog: EC 4.1.1.39 Ribulose-bisphosphate carboxylase
  misc_feature (505)..(505): n is a, c, t, g, unknown, or other
  misc_feature (537)..(537): n is a, c, t, g, unknown, or other
  misc_feature (761)..(761): n is a, c, t, g, unknown, or other
  misc_feature (778)..(778): n is a, c, t, g, unknown, or other
ctccccgcggtggcggccgctctagaactagtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagggtcggcttcgtgtaccgcgagaactccacctccccgtgctactacgacgggcgctactggaccatgtggaagctgcccatgttcggctgcnacgaccgccacccagtgttacaagagctgcangaagccatcaaatcctaccccgacgccttccaacgcgtcattcgcttcgacaacatcaagcagacgcagtgcgtcagcttcatcgcctacaagccccccggcagcgactagaccgcgcccgcctgccgcccccccccggctagctaatagctccggcgtgagctagtagctagctagtggcatgtctcgtctccgtccgttcgtttttgcttcggggtcacccnacccttgcctggctggnttcctccttcccttttacattttttttttccttttcccgggcagggttcccttgctttccagttt

SEQ ID NO: 93677 - DNA, 1017 bp, Zea mays
  misc_feature: Ceres CLONE 1583120
  misc_feature (38)..(38): n is a, c, t, g, unknown, or other
  misc_feature (43)..(43): n is a, c, t, g, unknown, or other
  misc_feature (50)..(50): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (70)..(70): n is a, c, t, g, unknown, or other
  misc_feature (476)..(476): n is a, c, t, g, unknown, or other
attaagtgatttaatagtcaccaagaaaacacagacanatgcnaagctangggnnnnnnccgcccttttnccaaactggagctccccgcggtggcggccgcaatcgaacagtggatcccccgggctgcatgacattcgtcgcacccctagaaaaactctacttctctaccgccgctgtgcctgtgctagctcctctctctgcttctgcttctgcttttgcctcactcagcctgctgcaagcttttgctttggtttaggtgcttcttttgcattcctttactgttcccccccactttcgctcgctttgccacgcacacgaaaagctcctgcctttaccttctcggaccttatctccgccccgtagtgggatttgcgtgggagctgcgctgcagctgcgtgccccctcgcgtctcgttgcacaattgtttgtgttgtgcgcgcccgccggcggaattacgtgttcttgcatgcgcggnccacctcatcgtacccggacacatcccttggcgccattgcggctgcggacgctcactgcagatcttcgcacgactccgggagcggcgactgaaaaggacagcgggccgcccgaccagctggccccaacgtcggccccggggtagacttcccaaactcaaacggggaccagtccaagggacgcccccccccgccgggggaacaccctctgacctggggcgccggccccggggggccaacctcgaagggcggctgaacagcactcgcctcaaacacgggaaaaccggacccccaaccttcacgaagggaaggggcttccgccgcaacccagcacccggaaaccccaagaccctcccaaaaaggggggcacgttctccgccctgagccccccccgagggggcccggtttagagaaaaaatgcattcgcgccaacaccaggggatttcaccacaaaccgggcggccggagggacatgtcctgtggagtgaaagggggcggccccggtggtaggggagggggagataaagccggggaaccctggcg

SEQ ID NO: 93678 - DNA, 808 bp, Zea mays
  misc_feature: Ceres CLONE 1583121
  misc_feature: Translation starting site: 551
  misc_feature: SWISSPROT Homolog: EC 2.7.1.40 Pyruvate kinase
  misc_feature (733)..(733): n is a, c, t, g, unknown, or other
  misc_feature (742)..(742): n is a, c, t, g, unknown, or other
ctccccgcggtggcggccgctctagaactagtggatcccccgggctgcaggaattcgtctcacccctagaaaaagcatctccatcccgcatcgcgcatcgcatccaccgccgagctttctttctttctttctttcttttttctgggagaagaggaagaagaggggaggcgcgacaaaaagggcgccgcgccacgcatcgcccccgacgccggcatctctccctcgctctccttctcccgatctgatccgaagcgcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctacaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcagggccaagaagcctcctccaccttgctgcccatcaccttcgatggactcgccaagggctttgacccaggtggcaacgatatttgntgggccaanactttgttccctggtagcgagactaccctcagttttggttggaagtttcctgaaagtaaaggaaga

SEQ ID NO: 93679 - DNA, 1142 bp, Zea mays
  misc_feature: Ceres CLONE 1583123
  misc_feature (12)..(12): n is a, c, t, g, unknown, or other
  misc_feature (13)..(13): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
gtgggggggggnnagcacaacggcagcgaccagacaacagcgacccggggggcgacccagcctnnnccgggtctttcccaaactggaactccgcgcagtggcggccgttccagaacagtggatcccccgggctgttcgaattcgtctcacccctagaaaaattgccggatcgagcttggctctctcgtaccttgcttcgccgcacggcaccaaaagcacggccgcgctctcatccccctccacaaggttccgcctcccgatccatagccgccgtgagccgccgccgacataggtcctcccgctcgcagctctccagctctccgaaaggcccgggtcatcaaaccgagccttgttcagtcccgaacaatcaccccgggggggcggaaccccacaggccaacaagagggcgggcgggagagtcccctccttgggtgaacaacgcggggccccccccccggtgacaggcaggagggaagggagggcacccccccccataaaacaaatgagtgggggcggagcagggccaggggggagttacaccaatcactccgggacgcgggaggatagtgagaaaatagagagccagcgaaggaggtaaggaggggggggatgcgagggaggtcgagagaaccgcccgccggcaagtttgcgcgcaccgggaagcggataaccgccaggacaacacaaccacgcgagacgggcgggatgagaagagaacggatctaaaagcgaggggcaaggggcggacccatagtgcgttcggcatcgcggagtcatcggcgaagggagtatagagccgagaagctggtcacccattcctagacataccgcgatttgttggccgctactgtcggtggctcttcggtccgcatggcccccactcacgaggggagtcaagaaacaagctaagaaaggagagcggcgcagcggacccacccgctcggtagacacgtcccgaaggggtgagggccaaggccgctcacgccctagccagacgaacgcgaccacgaccccctcctaccctctcaaaggagttgccgattatgcctagaacagatgcaggaggcgagcgactatcatccgggctacgggaagcagggcgagcgggacacatcatcggtgccgtcgcgccgagcacgcac

SEQ ID NO: 93680 - DNA, 1196 bp, Zea mays
  misc_feature: Ceres CLONE 1583125
  misc_feature: Encodes the peptide sequence at SEQ ID NO. 93681
tacatgttcatgagaggcgggggtatgggttaaactcacccgcccttcttatctataagaagaaaacagagcaaacaggagctccccgcggtggcggcctctctttcatagtggatccccgggctgttgcattcgtctcacccctagaaaaagtactcccgtgcgctagtgcgctcggcgctgcccccgtccgcccgcagtccgtccccgctcgccgcccatgcgctcgccggccgcccctcggcgctcccccatctcctcccgctccgcccccgccctccgtctggtagtccgtcgccgctcctcccgcacgccaacacgacctagtagacggctcgaagcgaagacggtcccatttccagtctccgtggtcaacatggatttagaggtatccgacggttcaggtactaatgccacctcggatgaccaatcgtatccaactctgcctataatggtaaaactttttccaccccttgtcacctcgagttagttgaaggtcaatggcggggatgaaagctattttgcaaaatatttgcgggacgaagtttgaaggagtttcaaagcaccaatttatcctcaaaaaacccactgttgcggtaattcattgtccctaaaaaatttcattttgaagggaccggcaaggccaattctatttgcctcccattgggaaaaaaaggggatcgagtcggcaagaccctcaattatggtgggtttggaaatcctttaaaaagaggactccggtgaaatggttaatgggtcttaaaattgggtcgcacattccaattagttccaaaaggcttcggctaattgtcaaactcatgtcttcagggacagagaatctcctttatgcattggggccacaacgttgggaatgggcacaattttaatgttcagtcccaagcgatttgtaaatacggacgtgttgtggagtcggactcaaaaaaataagtgacgaaaatcgaaattggtgtattataccgcgggatttacacaagaatgaaatgatagtcgtagcgtactcctcaaaagaaatgtgatccttgccaatggccttttataaccggccccgtaattgttacttgtgataatactttaaatctttgtggagactatcaaaacacagaagaattggggttatatctttaggcctggatacgaccttaattatcatttattggctcaatttgaactctttc

SEQ ID NO: 93681 - protein, 89 aa, Zea mays
  misc_feature: Ceres CLONE 1583125
MRSPAAPRRSPISSRSAPALRLVVRRRSSRTPTRPSRRLEAKTVPFPVSVVNMDLEVSDGSGTNATSDDQSYPTLPIMVKLFPPLVTSS

SEQ ID NO: 93682 - DNA, 1062 bp, Zea mays
  misc_feature: Ceres CLONE 1583132
  misc_feature: Translation starting site: 341
  misc_feature: SWISSPROT Homolog: EC 1.1.1.22 UDP-glucose 6-dehydrogenase
  misc_feature (18)..(18): n is a, c, t, g, unknown, or other
  misc_feature (76)..(76): n is a, c, t, g, unknown, or other
  misc_feature (77)..(77): n is a, c, t, g, unknown, or other
  misc_feature (81)..(81): n is a, c, t, g, unknown, or other
ggtttttgtttttttttncgggagagcctatagtattaattaatcattatcaaacacactaccagaaaaaagattnntttnttcattgctggagctcaccgcggtggcggccgctctagaactagtggatcccccgggctgcaggaattcgtctcacccctataaaaaacacacacactagacacaacactcctcgtaagcagagagcgtctatacatcttcctctcatacgcaccgatgtccagagaaggcagagagagatcgccgctcctcttcatctacctctgcggtgcggttgaccgccctccgccatagagatctcgctgcactacctcaagatatggtcactgatctatccaacaagatggtgaagatctgctgcatcggtgctggctatgtcgctggcccaagcatggctgtcattgccctatagtgcccatacatagaggttgatcggtgttgacatctccaagccccgcattgaaggatggcaccgccacacccttccaattgatactagccccgcctcgaataatgttataaaaacaggagcacggggcaaggaaaccctcttctttcaccactggatggttgaggaaagaacgtgcgccttaaagggggaacattcattctttcaatcctcggggggaaacagcccccaaaccaaataacccccttgagggcctttgtaaaactttggccatatggctaggcccaaacccccccaccctttttcctgggaaagaaaaagccgcccttaacttcgtgtaatagaaatcgcgccccaaatggtcccttaccaaaatcccttgtaacaaaaaaaaatcgtttttgtcccaaaaaaaataaaccaccccgtctcccggaaaaaataaaaacggcctgaaaagacattattgtgaaaaaagaaattttgtagaccctaaaaaaatatctaagggggaaatcaaaacctaacctatttattcattttcaaaacgcccggaaaattccctttagaaaaaggggcttttggcttttttgaaggaacctgttcccaaaacctgggaccaaaagggctcc

SEQ ID NO: 93683 - DNA, 1192 bp, Zea mays
  misc_feature: Ceres CLONE 1583135
  misc_feature: Encodes the peptide sequence at SEQ ID NO. 93684
  misc_feature (61)..(61): n is a, c, t, g, unknown, or other
  misc_feature (74)..(74): n is a, c, t, g, unknown, or other
caaagaaaagaaaaaaaaggaaataaaaaatattttacccactccccccccccccccactnccccccccccccnaccccaaactggactcaccgcggtggcggccgctctagaactagtggatcccccgggctgcaggaattcgtctcacccctagaaaaaccaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagcaccccgtgaaaaccctgaccggcaagactatcaccctcgagggtggagtcctctgacaccattgacaacgtcaaggcccaagatccagggacaagggagggggcatcccctccaagacccaagcagcgggcctccatccttttgcctggggaaagccagccttttgaagggaacgggggccgccaaccccctttggccccggaaacttaccaaaacaatttctcccggaaaaaggggaagagagagccacccctcctttccaaaacattttgtgggaggggtgccttattgcgcgcccccctctttacataggggggggtgaagaagggcgccaattgtgtccccaaaaaaaattctcttcttccccgtgggagagaaagaaaaccccccgtgtagaacctccggggcgcacaaaaaaaacctattattctccccccccccctcctccaaggagcgtggggaagaaatcttcttttcagaaaaaacaccctctatttttgagaaaaaaaggtttttaagggagccccacaagaaatctcccggggaaacacaaggagggggggcgatatttcccccccacaaaacaacaaaaagagggggttctctaatttttttcctggaaaaaaaacacacctttggggagaaggggggcccaccccctggcgcgcaaatataaaaatttcctaaaaggggaaaaccccctccccctttgggga

SEQ ID NO: 93684 - protein, 96 aa, Zea mays
  misc_feature: Ceres CLONE 1583135
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQHPVKTLTGKTITLEGGVL

SEQ ID NO: 93685 - DNA, 938 bp, Zea mays
  misc_feature: Ceres CLONE 1583140
  misc_feature: Encodes the peptide sequence at SEQ ID NO. 93686
ctccccgcggtggcggccgctctagaactagtggatcccccgggctgcaggaattcgtctcaccccctagaaaaaaccgagctcaaacacacatcaagaaagcaagaaagaaaagactgtatctagctagccacgccgcgcgcgcacgagtagtctaactagaatacactcgcgttcgaaacaaacacacagcgtcgggctgcgtgatctctgaccgcgtggacgactaccggagcaccaagcagctgatggcggccagcgtatctacctgcatgagcctcgtcccctactgtgcacgaccgggccggcgggttccccagcagtgtggcactgacgaacacgcttcagcgccgtcaaccctctcgccgctaacttgtcaacgccgcgccgaccaggagctaacaggaggccacccctgtgaccatcaacgacgtgggactcagatctcattacgccgcggcctaccacagggagctctccgcgcggtggcggtgagtccatggaaaaaacaactgggagggtctgctggacgccatcgacggcgtgcttcttcaggagctcatccggtaggggcgagtttgccagggcacctatgaaaagcttgaattacgaacgggttttccccctacttgggcagcctgaaaatacacgggagaaagattttctttacattaacttaaggcttccggcggtatttggggtacaaaggtcacccgtttacctttctacgcccacctgtaaaacaacctttaagggtcccccaactttgagcctttaaagaaggggcccccaaacccccaaaaaagttgtaaagggagatcggggacccttttcattctcggggaacgggggcgcttgtctcccccccaaacaaaaaaaaacgggctctggactttggacccggggggggtaaatccgcccgtgtggggttgtggccc

SEQ ID NO: 93686 - protein, 92 aa, Zea mays
  misc_feature: Ceres CLONE 1583140
MEKTTGRVCWTPSTACFFRSSSGRGEFARAPMKSLNYERVFPLLGQPENTREKDFLYINLRLPAVFGVQRSPVYLSTPTCKTTFKGPPTLSL

SEQ ID NO: 93687 - DNA, 1231 bp, Zea mays
  misc_feature: Ceres CLONE 1583141
tatagatgaaaatatttaaaaaaaaaataaaaaaactccccccccccataaaccaatcccaacaaccacacaatcgggaaaccactctatggcggccgctctacactagtggatcccccgggctgcaggaattcgtctcacccctagaaaaatagctcgcactccccgctagctccctctggttcccttcaagcggagaaagaagagagaggagggagaagaagctacaagagcgaactcaaaattatattacttctttctgagatggcggctcctgcgccgaagcaggaggaggtgcggttaaacgtcgttagggagcggctgccctccgtcttcaactgtctcaccatactgccccatggggcggaggccgtccacccggggtatcccaccacaacctggtaaagttggggacaatcggaaggatgccaaacgcaattgtaccccaaatgggttggagtgcaacccccatcctaaaaataattttttcaaaaacctgttttttttgaggggccgagattaaatagtgtctttgtaataactttattagcggagcggggtctctccctccattatgtgtggggtgtcataaggcttttgagtcgagttataagcttgttttagttccacctttttgcaggcgggaattagatgggtatgtgcgaaattccccaaagggaaaaatagacggaatccaatccttacttgtgtgtgtaatccaagaggcgtcagtccagggatttgggctcttactatcatcgcattagagctccttttgtgggtgtcgaccctgtgatgtttttttgttggaaagtttatcgcctagtgagtctgttgttagagtatgagagatgacgcattcgattgtgaggtactgtcgcgatcgtcccaccacctctatttgtttttgtttttgcgctactctctaaataatgacaccgtgtattgattttacaagattatattgtaacgaaatatgattagcatctatatcgttgaccttcttgctgcggattatagctagaattgaatatgtgggagtacaatcgtgacgttccgattagacggtaattcctacaggcggtgtgtagcgttgtaggtatactaatcgcgccatctcaagttgacattaaggatagagtcgctactttttgttacgcactcacctttctgatacatatattgacttgatttcaaaatagtgatatttgccgcgatgtatggggatgag

SEQ ID NO: 93688 - DNA, 855 bp, Zea mays
  misc_feature: Ceres CLONE 1583142
  misc_feature (798)..(798): n is a, c, t, g, unknown, or other
  misc_feature (801)..(801): n is a, c, t, g, unknown, or other
ctccccgcggtggcggccgctctagaactagtggatcccccgggctgcaggaattcgtctcacccctaagatttttaagagatactctcttagacttgttttataagaactacttcccctagaaaggaagcacttccacacaattcggacggtggcacgttggctaggacaccaaaggcacggcgagcgagagcccaacgaccgtccagttccagttccagcggtccgagcgagatcgatcgcccctccgttggccgcaacaacagacgcggcaagcgggtacaagggagttcttctggaggcgcgggagatcacgcgagtgtgttgcgcttgataagaagaaaaaaacacgcagggaggagggagtcccgttcccgaacccgaactacaagcccacgcaactgctgctgccgccgcccgcccagcatgaggagcgagggcattgcccggccccatcgccgtcgcgccgtcgccgtcgccgcgctgcaggcagaggaggacggcgccggccatcatgggcgggtacgagctcgtcaggagcgacgacccggcgggtccccgcacgagccatctcttagtcaggattcagcttccaaaaggccattggctccccacctcccacccccgcctctttggtatcccccggccgtctccacatcaccccatctgcatggcccgtcgttcttctggtgccattaccatcccttgcccttttattattccgtccaccatctccggttatggaataccttcccaggcagccttacaccctgtcggccccttcccacagtgccgtgnctntcgcctccccgctgaacttttaattaagacaaaccatatgcctgctcaccattc

SEQ ID NO: 93689 - DNA, 796 bp, Zea mays
  misc_feature: Ceres CLONE 1583143
  misc_feature: Encodes the peptide sequence at SEQ ID NO. 93690
ctccccgcggtggcggccgctctagaactagtggatcccccgggctgcaggaattcgtctcacccctagaaaaaatctagctctcccgtttctgctagcaagtactcacctcgtcgctgcagtagaacgccctcatcccacattcccacctagctctgcgcgattcatcccggccgccacgccaaggaggccctcgcctgacctcggatcaaagcctccatccgccttcatcccggccggtggttcgggccgtcacgagaggggtccgtcactggttactcggtggagagctcggggctcggctcccatctcacgattctcaccccacacgcgcaccgagtcacctcgattcggcagcctcgcgagtccttgttgcgtgggtcactgcctcactgggttctgaggcaaggaaaagaaggcttcagtagtcaggtctgggtcaagccatgatggagagatcgctgctggaggtgctggccacggcggcgcaaggagggaccgaggggacgtcagtgctgagcatgctcaagtacgccgtgctgcccatcgccaaggtgttcactgtctgcttcatggggttccttatggcctccaagtacgtcaacattctccagcccaacggccgcaagcttctcaatgggcttgtgttttcccttctgcttccatgccttatattttccccaattgggtagagccatcactatcgagaaaatgataacatgggtggtatattccagtaaatattggttggttggcgcaattattcgggctcttttgaattgggattttgttgggg

SEQ ID NO: 93690 - protein, 81 aa, Zea mays
  misc_feature: Ceres CLONE 1583143
MMERSLLEVLATAAQGGTEGTSVLSMLKYAVLPIAKVFTVCFMGFLMASKYVNILQPNGRKLLNGLVFSLLLPCLIFSPIG

SEQ ID NO: 93691 - DNA, 1057 bp, Zea mays
  misc_feature: Ceres CLONE 1583144
  misc_feature: Encodes the peptide sequence at SEQ ID NO. 93692
  misc_feature (19)..(19): n is a, c, t, g, unknown, or other
  misc_feature (75)..(75): n is a, c, t, g, unknown, or other
aagcgcaataaaaaaacanaaaaaaaacctccttcacccccacccccccccacacccacaaaacaacccaccacnaacaaaaactggaactccccacggtggcggccgctctagaactagtggatcccccgggctgtaggaattcgtctcacccctagaaaaatcaggcccacgctttgttaacaaagaattccctcatagccgccgccgccgccgccgccgccgctcatctcgtcgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatttccccccccctggctacagcattgaggacgttcgacctgccggaggcgcgaagaagttccagtctgctgcttactccaactgcgcaaagaaaccatcctgatatccctttttggcttcctcgttctagtagttttaggaatttctttttcttgacaccttcgattctttaccaaattcccccctgggcctggctggctttcccctgaacaaatcgaaccaggtttccccccaagtccttggcttcccctggagagattcctacccgcttccctcccaatttttcccagaccggtttgatggttttcttggaattccaaccctggcaaccaaaagggggcatggtttccttttccctggcaagccttggttgggtttccccccggggcccttcagatttatttgggggtttttggaggggctaatgaaaaaaaacgccccttgaagaataaaaatttctcctcgaagggcacccgggtcctttttgtgagacccccattgggcacgcgcggttttgcgtgtcccctctctccagggccccaaaaattaacctccgtgttctggaatctttgcccgggggcacac

SEQ ID NO: 93692 - protein, 50 aa, Zea mays
  misc_feature: Ceres CLONE 1583144
  misc_feature (1)..(50): Pfam Name: AdoMetDC_leader Pfam Description: S-adenosyl-l-methionine decarboxylase leader peptide
MESKGGKKSSSSRSMMYFPPPGYSIEDVRPAGGAKKFQSAAYSNCAKKPS

SEQ ID NO: 93693 - DNA, 908 bp, Zea mays
  misc_feature: Ceres CLONE 1583147
  misc_feature: Encodes the peptide sequence at SEQ ID NO. 93694
  misc_feature (247)..(247): n is a, c, t, g, unknown, or other
  misc_feature (908)..(908): n is a, c, t, g, unknown, or other
ctcaccgcggtggcggccgctctagaactagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagaacggtcggaagagacctgcaaggcgacngcacgacgcctcggtccgcggcggcggggcaggccatgatggagctcaagcccaacgggtcggccgccgtcggggcgccatggtggtggggctcagcccgctcaccaaaggcctggtggcgggaaacaaagggcctccccccgggggccggccccgccccgctaattcggcaaactgttcccccagggtccacgtgggagggaacctctgcgttcaccctggggtttggggccccgcaaaaaaccacaaaccgggctggaacaaacttcaaccggggtaacccgaaagccccggggcccctaaaccgcccctcattgggggccccctcgcgggtcccgggaaaaaataacccccgtggttgaaaaaccctttggacgggccgggctttgcccgccaaaaaccttttcccttttccgggaaaaaagggtttccctcaaaagggccccaaaagggcaaaaattcttctccttttggggccccccgcgggggttaattgtaaacccaggaaaacaaaaaccccatattcggggaaaccctaaacgggtggcccaaaaaaaaaaatgggtttatttcccgggccttttcttgtggggtttgcccggaaaaaaaaattacccgcggaggaggaaaacaacacccccctcttgtgtgagagggaaan

SEQ ID NO: 93694 - protein, 131 aa, Zea mays
  misc_feature: Ceres CLONE 1583147
  misc_feature (12)..(12): Xaa is any aa, unknown, or other
MRTVGRDLQGDXTTPRSAAAGQAMMELKPNGSAAVGAPWWWGSARSPKAWWRETKGLPPGAGPAPLIRQTVPPGSTWEGTSAFTLGFGAPQKTTNRAGTNFNRGNPKAPGPLNRPSLGAPSRVPGKNNPRG

SEQ ID NO: 93695 - DNA, 1257 bp, Zea mays
  misc_feature: Ceres CLONE 1583148
  misc_feature: Encodes the peptide sequence at SEQ ID NO. 93696
  misc_feature (475)..(475): n is a, c, t, g, unknown, or other
  misc_feature (1111)..(1111): n is a, c, t, g, unknown, or other
aagaaaggtaatctataaaaaacaaaagagaatcaaccccacaaccaaaccaaaacacacacacaccccataacacaaactacacccgagggcggccgctttttactagtggatcccccgggctgcattgattcgtctcacccctagaaaaaattccacctgccccatctcctcccgatctatccgagcccaaacccaagtccatccagatctccaccgccgccggcgagagcactgcatcagattcgcagcgatggcgctccgccgcacctcatccgcaggggtgcgcgctaagctctgacatcgccacaccagcgtccgggaacactcacgaggcctccgcagacgtcgccgcggcccccggcgggctagcccccgacacaaccccggggcgcgctcccgtgagggcgtacgatcgtattgttgaaaggaggaaaaaccaagatacgggaggatttgagtatctaaaaaccancctggtcccaaatatggaaggacccgttggcgtcccactgctaaccatagaggggagcctttggcgggggtgcggaagaaagtgggggatattcccatcttgccccaataggatccttgatccggtgggcccactggaggtccgtcacacatcgttatttcccggcaacgaggtctacccgatgggggttgatgaggcgataaccgaattaccgggggacagttaagggcttccgcaggaaaatagaagaggcaagagattgggccccgtgggtgtgtcggtcgacgaatcctgttgtgattcgatgagccgcgccacagagctcttggtttttatagagcgtgtgcgtgctcatgcgcggtacaaataattgttagagagtggtgcgtgtatgtcactacccttgtgtgaacctcactggtgtaggaaagtatgtgtgtggcacccctgtggggtgtgggtgagataagcctatcaacataggcgcgatttaacacttaggaattatggcggggggcatgctggtaacctcgagcgtgaggatctatatgtctcacaggagggtgatccttctaatccaacagggcaacgttcggtcgcatcccatggcaacatcttggagataagtcctgccancgttttcacctctccccgtgtggggaaataatcctctaaacatgacggaacaagaggctcccgcacttaagtagacagacgagctcgtacgaatttatttgtgcattattccgaagagattgacaacgtaacggttgttgagtaca

SEQ ID NO: 93696 - protein, 70 aa, Zea mays
  misc_feature: Ceres CLONE 1583148
MEGPVGVPLLTIEGSLWRGCGRKWGIFPSCPNRILDPVGPLEVRHTSLFPGNEVYPMGVDEAITELPGDS

SEQ ID NO: 93697 - DNA, 953 bp, Zea mays
  misc_feature: Ceres CLONE 1583151
  misc_feature: Translation starting site: 219
ggagctccccgcggtggcggccgctctagaactagtggatcccccgggctgcaggaattcgtctcacccctagaaaaaagcccactccagcgctgaaggcctgcagcgccagcgcagcgcctctctgctactgtgctggctgacgccggtggggtgtgagcgaactgcgagctgctgccacccctgctgccgcggtcgaccgccggccccggaccgagatggacgctcggtgggcggtgctgctcgcgctgctggtcgccagcggcggcgtccgtgtctgcgcctcgctgaggcccagggacgccactggctgggcgggctgagccgcgcgtcgttcccaaagggttcctgttcgggacggcaacctccgcctacccggtcaagggggccgcgttcccccacgggcgggggcccccccatttgggaatcattccccccccctcccaggaaaaatttggcgggggaaccaaaatggaaaaccttcccatgggaaaccaattccccccccctcaacgggaaagaaccccagtcttcccgaaaaaattttggaactttttaagggccctaacggggttttcccaaaatcccgggggtgcccgcgaaattttccccccgaaagggtgtcaaaaggaaaaaaccccattccccccaaaagggggggacggcgccatttcaccaacaatattttgaaaaaaaataaaccccggccctccccccaaggggaagggaaattcccctctaaaataccaaaccttttaaaaacccaaaagaaaatctttcccccttggggctttgggaaaaaaaaaaaaaagtgaggggggggggttataccccccaaaaaaggggggaaattttgtttttaagaaccagcgcctgaaatttcccgtttttaaaaaaaccaccccggcaacgcccctaaaacaacgggttttcaattccagggagcccaggga

SEQ ID NO: 93698 - DNA, 971 bp, Zea mays
  misc_feature: Ceres CLONE 1583153
  misc_feature (746)..(746): n is a, c, t, g, unknown, or other
  misc_feature (919)..(919): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
ggcggccgctctaaactagtggatcccccgggctgcaggaattcgtctcacccctagaaaaagtaccgcccccctcctcgccgtccactggtgccgagccggcgcgggtggagatccgttcgctttggatcgacttcttcgtgtttgggttgaagccgctcgatttgctcaccagaaattcagattttcgagtggaattcgcttaatatagcaatgcactagggtttactgtgcaccactaggctactgcctctgctattaggaagccgacatctgttgtttccgaagtctttcaagtctctgtggggtggcgttgctattgtgggtgtgataacatgataaagcaatttcttggacgtctccccaagaagccttccaaatctggagataaggatcctattgggccggcccagcccctcgggtgtcgcacccagccatttgggtccaagagctgggagacaggggccacccaatttgagtagcccatccacccggttattttcccagctctggggctcagtttagggggaggtgggttgcattgtcggcaaatgccatacaccaaagggccccacggggaaccggggaatttcggcccgctttcagcattttcggggtcgtttggccgaagcttttcaggggaggtggcccaaaaccagaagaaaaaaaaaactttggtttaaatgaagaaagttgaaactttggggcctgcgcccccaattttgaacttcccccccaaccccccnaaggatcttaaaggagaaggagataaggagcaaactttgggggagctcgttgactatattgcctcggcagtgggaaattttctgaggcagcatgcaagagatccccaaatggtttctgcaaacttgtcaggagctgagtcctcctctaaaacaacaatggatgcttttattgnatgagagcgcgcggctgattagttattgtcggnnnnnnnnnnnnnnnnnnng

SEQ ID NO: 93699 - DNA, 836 bp, Zea mays
  misc_feature: Ceres CLONE 1583154
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
ggagctccccgcggtggcggccgctctagaactagtggatcccccgggctgcaggaattcgtctcacccctagaaaaaaatgccctcctccctcggcggaaacatccaatccccgggccaccactacctgcctgcccgtgcccacgcttcttctcttctcctccccaagccccagccccagccccagctaccgcgccccctcctgtctgttccaccagcgtcggcctagctacctgcccgtcccctctccgagtacggtcggaagcctcagctgaaggatctggcctgggcgccctccggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactccaacttcccgcatggtgcacccctgttggcgacgtcccaaggcagactcccaagcaattcctgtattctggtaacccgcagcacctctgccatccgtaccagtcagctccggatgcccatgtcgtgccgcagcgccgttacaccgtgaggtctcagtctcactcgccaaataatgctggttctcaagaccatgagactcacaagcagtacacgctggagtcctcggcggcttccggttgttcaaggcagtcccacatctgcgagactgcaacccgcagacgannnnnnnnnnnnnnnnnnnnnnnnnnnnnnnnnnnnnnnnnnnnnnnnnnnnnnnnnnnt

SEQ ID NO: 93700 - DNA, 1143 bp, Zea mays
  misc_feature: Ceres CLONE 1583155
  misc_feature: Encodes the peptide sequence at SEQ ID NO. 93701
  misc_feature (458)..(458): n is a, c, t, g, unknown, or other
  misc_feature (1143)..(1143): n is a, c, t, g, unknown, or other
tttgtggggcgtcactccactccttctattatggctatttatttcttacacaacaaaaaaaggcaaccctccaaaacctggagctccccgcggtggcggccgctctagaactagtggatcccccgggctgcaggaattcgtctcacccctagaaaactagaaaaagtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacaacgcaatggtggtgggggcccgcggcgcggggctcctggcggagatcgggctcttcgagcacggcttcaacaccgcggtgaataacaaagntttttcccacccccccccaaaatgtttcgggttaagggaggcctaaaatgcttgcccttggaaaaatgaactaaaaaagaactggggggggggcatttgttagaacaccggttaagggaaaaggaatgggctggggggaccaaggaaatttttttcccggaatttggggggggaggagggaccccaaaaagctttttttaaagaagtttgggaaaaatcaggggacaaacccctttttttctaaaaaccttgaaaaagagggggaaaaaaaaattttccccccggggtccctttttgtgggggggggcggggactctttattattttttttgggaaaaaagggggggggaaacaccccccctccccctttttgttccccctccctcctctctgaaaacaaaaacaaagaaaacaattgtttgtttttggtccaaccctcataatatgtgggtggccccccagtgacacccccccccccccccattttaacatggggagaaaaatttgtgttgtgggacacccctctcgtgggggtaacaggaggagaaaatatttggggggaaaaaatttttcttttatataggggggggggaggagaacctctctctgggttggggtggttaaaaaaaattctatcccgcgggggaggggtgggggggggattttttctttcccgccgctaacn

SEQ ID NO: 93701 - protein, 80 aa, Zea mays
  misc_feature: Ceres CLONE 1583155
  misc_feature: SWISSPROT Homolog: EC 1.3.5.1 Succinate dehydrogenase (ubiquinone)
  misc_feature (66)..(66): Xaa is any aa, unknown, or other
MWRSCVSRGLSRAKASASRLLSTASSSYTVVDHTYNAMVVGARGAGLLAEIGLFEHGFNTAVNNKXFSHPPPKCFGLREA

SEQ ID NO: 93702 - DNA, 913 bp, Zea mays
  misc_feature: Ceres CLONE 1583159
  misc_feature: Encodes the peptide sequence at SEQ ID NO. 93703
gcggtggcggccgctctagaactagtggatcacccgggctgcaggaattcgtctcacccctagaaaaaacgataagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttggagagcgggtttcagaaagtcaagaccgaggtctatgacaagaagccggagctggtcgagcctctcaagtccggccagagccccaggaacatggggttcgcctgctccgactcccgcgtgtggccgtcggggacccctgggcctggcaccccggtgaggccttcaccgttccgcaaaatcgccttccatggtcccaccctaagaaaagaatcaagtacgccgggaccggggtcccgccctcaaataacccccggtggcgccgcccaagggggccagctcaacctggggtcaattggccaaacgcttgctgtgggtgtggaataaaggggggcttccctcttccctctaagggatagggcgccccctcgagg

SEQ ID NO: 93703 - protein, 115 aa, Zea mays
  misc_feature: Ceres CLONE 1583159
  misc_feature: SWISSPROT Homolog: EC 4.2.1.1 Carbonate dehydratase
MDPTVERLESGFQKVKTEVYDKKPELVEPLKSGQSPRNMGFACSDSRVWPSGTPGPGTPVRPSPFRKIAFHGPTLRKESSTPGPGSRPQITPGGAAQGGQLNLGSIGQTLAVGVE

SEQ ID NO: 93704 - DNA, 785 bp, Zea mays
  misc_feature: Ceres CLONE 1583160
  misc_feature: Encodes the peptide sequence at SEQ ID NO. 93705
  misc_feature (748)..(748): n is a, c, t, g, unknown, or other
acccgcggtggcggccgctctagaactagtggatcccccgggctgcaggaattcgtctcacccctagaaaaaaatgccctcctccctcggcggaaacatccaatccccgaggccaccactacctgcctgcccgtgcccacgcttcttctcttctcctccccaagccccagccccagccccagctaccgcgccccctcctgtctgttccaccagcgtcggactagctacatgcccgtcccctctccgagtacggtcggaagcctcagctgaaagatctggcctgggcgccctccggacgacgggacaggttctgtttggtcttcataaaggagagcactagctagaagacatattcacacgcatcagctatcaaattgcaagcttagaattgacctcaaagttgggacatgcttgtcttaccagaagcaactgatagcttggagttgtagtccgtccggactgtctgctggaacagtatggatgacactcccaccttcccgcaaggtgcacccctttggcgacgtcccaaggcagactcccaagcaattcctgtattctggtaacccgcagcacctctgccatccgtaccagtcagctccggatgcccatgtcgtgccgcagcgccgttacaccgtgaggtctcagtctcactcgccaaataatgctggttctcaagaccatgagactcacaagcagtacacgctggagtcctcggcggcttccggttgttcaaagcatggttctcccntcagccaaagcgtccatgccgggagtggcagcactgt

SEQ ID NO: 93705 - protein, 101 aa, Zea mays
  misc_feature: Ceres CLONE 1583160
  misc_feature (90)..(90): Xaa is any aa, unknown, or other
MTLPPSRKVHPFGDVPRQTPKQFLYSGNPQHLCHPYQSAPDAHVVPQRRYTVRSQSHSPNNAGSQDHETHKQYTLESSAASGCSKHGSPXSQSVHAGSGST

SEQ ID NO: 93706 - DNA, 1119 bp, Zea mays
  misc_feature: Ceres CLONE 1583163
  misc_feature: Encodes the peptide sequence at SEQ ID NO. 93707
  misc_feature (775)..(775): n is a, c, t, g, unknown, or other
  misc_feature (913)..(913): n is a, c, t, g, unknown, or other
tccccgcggtggcggccgctctagaactagtggatcccccgggctgcaggaattcgtctcacccctagaaaaacccgtcgcattccgcaacacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatggctatgattgatgagcctatttatccaattgctgcactgattgacgagctcaagaatgaagacatccagttgcgtctaaactccattagaagactatcgacatgtgcacgggctcctgggagctcatgaagcaggtgcggagcgggataagggggtgggttggccccacaacaatagagtgagacgaagggggacctatggaacagaaagaggattcaatggtgcggtgagcatcgattagaaagaaattggacggctggtcctagaaagggtgaaggacgctgtcagccaaagccgtgagtgatgcagtgggatggaggagggactcggggggaacgaaatctctggtcttgatgtgatcgtgtgatataagtcctctggctgagggggcggttgtataagtaggagtgggagaagaggagcggcgcggtgttatctcgcgtgagagaggcgggaggtgaaagaatagcaaattctgaaaggtggggatggtgtttctcccgatgcctgagataatgggggaatgtcgtgacaanaaatagtgtgtgtgcaagcgagatctacaccatacagagccgagagaggaaaagaaattatacgggatatggatggtgacagtgcagtttgccgctccgagatgggacggagtgggtgtcgcaccgcgccatttaatntctgtgcatctacggacttgaaatggtaggcatataacgtgaatgctctagagaggcaacatcggcggccggatgcttggaggaggcagctctatccgccgcggggcgcgggcgcgtggcggtgtgttggtgcgtagaggcttatgtgtttgaggtgagggtgctatgacagtgattgttttgcgagcgatgcggagcaggagtgg

SEQ ID NO: 93707 - protein, 43 aa, Zea mays
  misc_feature: Ceres CLONE 1583163
MAMIDEPIYPIAALIDELKNEDIQLRLNSIRRLSTCARAPGSS

SEQ ID NO: 93708 - DNA, 977 bp, Zea mays
  misc_feature: Ceres CLONE 1583164
  misc_feature: Encodes the peptide sequence at SEQ ID NO. 93709
  misc_feature (389)..(389): n is a, c, t, g, unknown, or other
ctccccgcggtggcggccgctctagaactagtggatcccccgggctgcaggaattcgtctcacccctagaaaaaagctctgcagctgcccctcacaacttcattcccaaatccgccgcaacgcgaagcaaacgacgccccgaacacacccaagccacgcccaattcctatctctcgccgcgcatcgacgacggcgcggacgccatgatcctgcgaacgtacgggcgcagatcccgctccttctccgacggcgggggcggggtctcgtcctcgcaggacgcgttcgactgcgacgacgccgccgacttgctggtgtcgtcggcctcgcagccgctcccgctcccgccgtcgcaggagtcctcttcgatgtgggacttcgacgaggacccnacctcgtccccgccgcggccccggtccggaggggcggcggctcggggcaagaaagaggagggtgggagctcgccgaaagcccccgcgggtggcgccaaagggaaacccttgatggaggcgggagggattcccgaaaaaattatgggaaagcctgggaccaaattcccgtttttgcgccttgaggggggttcccaaccccccaaggcccaaaaaacggaaaccgggggggggccaacctggggttcgcccttggtttggggggatattgggcgcccctcctcccgaagaggcgcccccccgggggctctccggggccccaggggagtggggtcaccccaaaaaatttccggggggctttttttggggttcggggaacaattgaggaaggcccccccccggggcgctatgtgggcggggagggaggctcttttttttttttgtttttgggagaggggggtttcccaaacaaaaataaatctcctgtgtgtgataaaaaaaaacggggcgccccctttccctctccataaaaaaataaacaccctccccggggaggaggggtggtggagcacccacccccctcttcatgtg

SEQ ID NO: 93709 - protein, 258 aa, Zea mays
  misc_feature: Ceres CLONE 1583164
MILRTYGRRSRSFSDGGGGVSSSQDAFDCDDAADLLVSSASQPLPLPPSQESSSMWDFDEDPTSSPPRPRSGGAAARGKKEEGGSSPKAPAGGAKGKPLMEAGGIPEKIMGKPGTKFPFLRLEGGSQPPKAQKTETGGGPTWGSPLVWGDIGRPSSRRGAPPGALRGPRGVGSPQKISGGLFLGFGEQLRKAPPRGAMWAGREALFFFCFWERGVSQTKINLLCVIKKNGAPPFPLHKKINTLPGEEGWWSTHPPLHV

SEQ ID NO: 93710 - DNA, 870 bp, Zea mays
  misc_feature: Ceres CLONE 1583166
  misc_feature: Encodes the peptide sequence at SEQ ID NO. 93711
agctccccgcggtggcggccgctctagaactagtggatcccccgggctgcaggaattcgtctcacccctagaaaaaagtctcgctccaaaccaaagccatcggaggagcaactggacgaccatggcctcgccgctgctcaagtcacactctcagctcgccgccgccgccgccctgcactccgtgaggagagccgaccgctgccctgcgacactacacctgggcaagttccatgaccacgggctcaggtccggccgttctaagagatccggttcagcgagggtgggcgccttcccgtcgctggacgtggtgccgctgatggtgacgatggtggagcacgtggacatgtcgcgggactacgtcgtgaccaagtccatctggcatctcagcgacctacccctcaagagcgtctataccttctacgccatgttcaccgtctggggagtctgctttcttcgcgtccatgaaggatcccttctacgacagcgagacgtacagggagccagggtggcgacgggaccgtgcactggtactacgacaggcaagaggacccttggaggcgtctgccaagggaaggagctgcttgcgggaggagctgctcccagagattgagccgaagggttggggggcttcagggagcttggaggaagccagccaggaggagcacctccccaaggggatcccccccggggcaaataccaaaagggattggatacgggctaatcatcagctcttttattgaagctccttagccaaaaaatccaaacttcctaacggccctggccaaggccgttaatgggccaaacccccaaacattggttccctgggccccccggcggggaataacgggggaaccctaaggtttttttttc

SEQ ID NO: 93711 - protein, 162 aa, Zea mays
  misc_feature: Ceres CLONE 1583166
MASPLLKSHSQLAAAAALHSVRRADRCPATLHLGKFHDHGLRSGRSKRSGSARVGAFPSLDVVPLMVTMVEHVDMSRDYVVTKSIWHLSDLPLKSVYTFYAMFTVWGVCFLRVHEGSLLRQRDVQGARVATGPCTGTTTGKRTLGGVCQGKELLAGGAAPRD

SEQ ID NO: 93712 - DNA, 1243 bp, Zea mays
  misc_feature: Ceres CLONE 1583168
  misc_feature: Encodes the peptide sequence at SEQ ID NO. 93713
  misc_feature (438)..(438): n is a, c, t, g, unknown, or other
ccacctttttcttttttttttatatacagccctcccccccccccccccgccactggatacggataatttcaaacctggactcaccgcggtggcggccgttctagaagagtggatcccccgggctgtttgaattcgtctcacccctagaaaaatattattgtggcaacagatcggtcatcatgttttgctagtaacccaattgcacttcgaatggaagtactttgtggagctggtgaaactaatgtttgcccctcaggaggagtcggaatctccaatcctggttactggggcatgaacattgaaagaacaaatgtctatagagttaccatatacatcaggtcatcagacatccgggagttaacggcctcccccacaagttcagatggtcttcaaaaactcacctctcacgatatcacggtagacttataagatttaganaaagtgaaataaaattaagcttgaatcgccccccccacttcattaacttcccaattcacacctccgcctttaccaccccccaaaatgtggtttgacattcgtttttgatgaaagtactccccttttgttttccccagcaattattttatacgagagcaagggtgttgcccacaagaaaatctatggcattcatatatctgtgtaccgcaagttgcagaaggagccctatatttgatcatacacaattatcacgacggtgcgcgccgtattttctagtccacggggattaaattatttttctcgtgtattatacgattgcacgtgagagggcgcttggacaactgtacaacaccctactctagataacacctccccgcgttgtgccatttatgacaatatctccaaggcccacgaatatatcttattgtacatggcgacctgacggtgccacaatggctgtaagagcgtatcgagcatgtacgggcctcgcttcgagtcgaatatgtcttatgggatgcccacctctcgccgccatttacgtcacaggacttattcagatcgcggtgcatcctatagcttgctgtataattgtagagtaaggtttattaacatatcgagaagtacgtcactgccatgtatctgaatctctcgagaatatcttcccacccaattgttcatcgtcgagcgatgatgtgatgagacattgtgtcagatagtggcggacggcgcctctttgaactttttacccataggtgtctagctaattatagacggccggcacacttctctccgcttgctcttgcgc

SEQ ID NO: 93713 - protein, 72 aa, Zea mays
  misc_feature: Ceres CLONE 1583168
MEVLCGAGETNVCPSGGVGISNPGYWGMNIERTNVYRVTIYIRSSDIRELTASPTSSDGLQKLTSHDITVDL

SEQ ID NO: 93714 - DNA, 865 bp, Zea mays
  misc_feature: Ceres CLONE 1583170
  misc_feature: Translation starting site: 141
  misc_feature: SWISSPROT Homolog: EC 2.3.1.15 Glycerol-3-phosphate O-acyltransferase
aggccgctctagaactagtggatcccccgggctgcaggaattcgtctcacccctagaaaaaactgcctactcgcacgcagcagtacgacgtctctcctctgggtctggggccgagacaccgagcacgtactaccagcaagatggtggcgtctcccagattcaagcccatcgaggagtgctgctcggaggggcggtcggagcagacagtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgcacttcttctccgagtcgctgggcatcagcacgctggtgtacatctccgtggcggggctctaggtgcgcagcatcgagatggtggcgcgctccgtgctccccaggttctacgcgggcgacgtgcacccggagagctggagggtgttcagctccttcagcaggcgctacctcgtcacagccagccccagggtcatggtcgagcccttcgccagagccttcctaggcgccgacaaggtcgtcaggaccgagctggaggtcggcagaggaccgcaaggccacgggcttcatggccaaggccagtcgtgctcgtcggcgaccacaagaagaaagcccttcgtcaaggagctcgtgcgacgcgcctggccgacctccgggattgggggataggggagaccgaacttcgaacttcatgttcattctgcaaagaaggccctacctgggtgaacgtccaaggtaattacacaccccggtggccccgaggtaaccaggcttgctggaccccggcttgaatctcgtgcaa

SEQ ID NO: 93715 - DNA, 820 bp, Zea mays
  misc_feature: Ceres CLONE 1583171
  misc_feature: Encodes the peptide sequence at SEQ ID NO. 93716
ctccccgcggtggcggccgctctagaactagtggatcccccgggctgcaggaattcgtctcacccctagaaaaaaatacagcgccggccgggccgttgcgtccgtccatcctcatccccatccgccacccaccccgcgcccctccttctcactccagtgctggctgccggccagctccgcccccggggtccttgagctggaggtgggtggcgacgtaaaggcgcccgcttgctttgccactgccggcgctcgtcatctccttacttattcatccctgcggccctgctacacatcggtgccgtgccgtgcgtgcttgattccgtcctgtcctgtgcttgccgtttctttggcttgtattgtaggtggcggtggatgaccagctctcggagttttctgaggcgaggatcggagggcgttgcgttaggtccgcggttggtgagcggcggtcggagcggtctcgcgcgcggcggggtcgttcgatgacgcaggaatcgcgctctgggagggtgggaatacctcgcgctcgcgctcaaggtgctcgattaatttactgcctgaggctgaaggagggcgcgcctgtgagctgaaccgttcccgctgcactgactcctgagctcgggaaatggttgggagcgtgcacatcaatggatcggtccacggcggcaatggcacggccacggaagagcggctggacgagctgcgccggctgctcggcaagtcggaagggggacccttctcagatcgtcagcgtcggcgccggcgcgtgaggcagcgtcttcgccgcgctcctacagacgcgtacggcatttccgggacaagg

SEQ ID NO: 93716 - protein, 66 aa, Zea mays
  misc_feature: Ceres CLONE 1583171
MVGSVHINGSVHGGNGTATEERLDELRRLLGKSEGGPFSDRQRRRRRVRQRLRRAPTDAYGISGTR

SEQ ID NO: 93717 - DNA, 1184 bp, Zea mays
  misc_feature: Ceres CLONE 1583173
  misc_feature: Encodes the peptide sequence at SEQ ID NO. 93718
  misc_feature (1)..(1): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
nttttgggggggggcgcggcccctccccccataatgagacaagcggagaaaacagcaagaaggcccggtgggnnnnagtatnnnnnnnnatgttggaagctccccgcggtggcggccgctctagaactagtggatcccccgggctgcaggaattcgtctcacccctagaaaaaagaagcactagcagttccacgcggcgttccacttccacccgaaaccccaatcaagcgtgcactgcatctgcgtagcccgttcaccacgcacgcgcttccctccctaccgggcgatctatggacggcgacggcgcgacgtgggggcagccgatgctggagaagcggccgagccaccgggagcggcatttcacggcgggggaagtggtgcgggacgtcatcatgggggtgtccgaaagcctcaccgtgcccttcgccctcgccgcgggggtctccggcggcagagggccctcctcgctcgttctctccgacgggctgcgcccaaaaagccggccgggggccttctccctggggaactcggagagggaactgcctccatcaaaactcctggtccctccatccgctcgccgacctggaagctaaaaccgggtaggttaccgaggccgaatgtcccccctgttgattccctcttttaagaccttagtcctccgggggcgcaatgaaaaagagactgtattacacacaaatatttgcgcctgaaagaacccgcccaaacccttaaatatgggccggggccagaataacacacgggacgtagaacgactcacaagcacagactatgttagcatttccagcaccgcgcggaagaaacaccggagcgcccatgcgatagacgaagagaactccgcgcataggtggtggagatgtcgcagggcgccccagctcagaaatatccctattgggggagggcatagaggcgaaaccagcgctataaaatatatctttttccgcaggggtgaaatagaaaccccttcttcttatgcgtccttgggcaagagggggaaataaaaacccgtgcgcgcggggtccaccgctccaggttctttagccgacaaaacaccacttcacccctctatgatataatgttggaggagtgttattatcacaccgaaaatgcctcgaaacccaggagataagacgcggcggacgttatatacatgaagcgagggagag

SEQ ID NO: 93718 - protein, 100 aa, Zea mays
  misc_feature: Ceres CLONE 1583173
MDGDGATWGQPMLEKRPSHRERHFTAGEVVRDVIMGVSESLTVPFALAAGVSGGRGPSSLVLSDGLRPKSRPGAFSLGNSERELPPSKLLVPPSARRPGS

SEQ ID NO: 93719 - DNA, 992 bp, Zea mays
  misc_feature: Ceres CLONE 1583174
  misc_feature: Encodes the peptide sequence at SEQ ID NO. 93720
cagagtttgaaaaataagtatatatgtggtgaggacaggagcgaacggaaaacaaaaaaacaaaaaatacctaaaaccccgaactcaccgcggtggcggccgctctagaactagtggatcccccgggctgcaggaattcgtctcacccctagaaaaaaaaggaaaggggatcgccatggcagcgtcgccgcagcagcaaggccagggcggccctggcagcggcgggtggactcccgagcagttctggtcgctgctggacaaggcggaccgccggttcgcccgggtgcgagacctgccctccttcggccgccaggagcccgacgagttcgccaaggccttccgcgcctacacccagctctggcggatgcagcaggagcaccgtcaccgtcttctcgacgcgggcctccgccgctggcaggtcggcgagatcgccgcccgcatcgcccacctctactacgcccagtaccagcccacccccgacaccgcgcttctctccgaggcgttcgtcttctaccacgccgtcctcgaccgcgcctacttccaggacgccgaccaccacctcgcccccgccaaacacctccgcttcctcgccaggttcctcctcgtcgcactcctgctcggcaggcgttcgcacaccgtcccgcgtctcgcctcggacatacgcacgctcttaggtgactccaaaaagtccttccaggatgccgaatacaaagaagtggaagcatgtcgtgcaagagatcgcgaggttcctgcgagctgactcaccatttatgaacatgaagccgctccagtacagctatgcattcgatccgccccccggaaacgcttcgtactgggccaaactacctggtcagaagacgaaggtcttctcctttaggtgaacaccaaacttttgcagcctttctattcctaaacgaggggtcaaatttttcaagaacctcttcccaaaaaaaggttattctcaaaaaggggtttccaggggccctccaaaa

SEQ ID NO: 93720 - protein, 194 aa, Zea mays
  misc_feature: Ceres CLONE 1583174
MAASPQQQGQGGPGSGGWTPEQFWSLLDKADRRFARVRDLPSFGRQEPDEFAKAFRAYTQLWRMQQEHRHRLLDAGLRRWQVGEIAARIAHLYYAQYQPTPDTALLSEAFVFYHAVLDRAYFQDADHHLAPAKHLRFLARFLLVALLLGRRSHTVPRLASDIRTLLGDSKKSFQDAEYKEVEACRARDREVPAS

SEQ ID NO: 93721 - DNA, 1939 bp, Zea mays
  misc_feature: Ceres CLONE 1583175
  misc_feature: Encodes the peptide sequence at SEQ ID NO. 93722
aataacccatataaccctcgtccacgtcctttgctcgactcgcaaaaacttgcttccttcaacggccgcatcattcttccacgtacgtcccgcccggcacgtcgatcacggcaaaagctagccagcgcacaggacctgcggaggagctcggttttcgatcagggtcaataatcaccacgccgacgctgatgacgccggcgtcccaggcggcaccgccgcgcgcgcggcggtccgtggtggcggagctggagggcgcgctgcttcggagcgcggacatgctcccgtacttcatgctcgtggcgttcgaggcgtccgggctgccgcgcttcgcgctgctgctggcgctgtgcccgctgctgcggctgctggagctggcgggccgtcgcggcctggcgctgcgcgccgccgcgttcgtggccaccgcgggggtgacacgcgccgagctggaggccgtgtcccgcgccgtgctgcccaagttcatggccgacgacgtcgaccccgcggcctgggcggccttcgggagctgcgaggggaggcgcgtcgtcgtcacgcggatgccccgcgtcatggtcgagcgcttcgccaaggagcacctcggcgcgcacgccgtggtcggctctgacctcgagtacagccggctcaggcgctccacggggctcctcaaaggcgcctgccatgaggccgtcgccagccgtgcccgcgcgctgttcgccggcgacgacctgccggacctcgcgatcgccggctcagagatggcgcgctccttcacattctgcgaggagcagatcagcccgccgttcactggagaccacgggatgaacgccgccccaccgttccggccggtcatcttccacgacggtcgcctcgtgtgccggcccacgccattcatgtccctcgtcatcctcctctggctgcctctcggcgtgctggtcgccttcgtccgcatcgccgtcggcctcatggttcccatctggagcatcccctacatcgcgccggtcttcggcggcgccgtgatcattcacggccgcgcgccgcccccagtcaggcccagcgacgccgcggacgtcggctcgccgccctcgggggtcctcttcgtctgcacgcaccgcacgctcatggaccccgtggtgctggccaccgtgctcgggcgccgcgtggccgccgtgacatactccatctcccgcctctccgagatcctctccccgatcccgacggtgcgcctgacgcgagaccgggaagtggacgcggcacgcatgcgcgccgagctggccagtggcgacgtggccgtgtgccccgagggcaccacgtgccgggagcccttcctgctccgcttctccaagctcttcgcggagctcagcgacaggatcgtgcccgtggcgatgaactaccgcgtggggctcttccacccgacgacggcgcgcgggtggaaagccatggaccccatcttcttcttcatgaacccgcggcccgtgtacgaggtgacgttcctgaaccagctccccgcagaggcgacgtgcgcggcggggaagagccccgttgatgtagccaactacgttcagcggatactcgctgccacgctcgggttcgagtgcaccaccctcacaaggaaggacaagtacacggtgctcgccggcaacgacggcgtcctgaacgccaagccggcggcggccgggaagccggcttggcagagccgcgtgaaggaagtcctcgggttcctgctccactaacaattacaccttgcccagatctggactctggcacaaatacttcgctcaccgatttgtttgagtttatactttgttacatttatacatgtacgtaaaaataaaacatgtagtagtaaaatacagcagtgatcagcctttctttacataataagtactgtatattgtattgttctttattttacaattgttttggcgaaaaaaaaaaaaaaaaa

SEQ ID NO: 93722 - protein, 512 aa, Zea mays
  misc_feature: Ceres CLONE 1583175
  misc_feature (274)..(399): Pfam Name: Acyltransferase Pfam Description: Acyltransferase
  misc_feature: SWISSPROT Homolog: EC 2.3.1.15 Glycerol-3-phosphate O-acyltransferase
MTPASQAAPPRARRSVVAELEGALLRSADMLPYFMLVAFEASGLPRFALLLALCPLLRLLELAGRRGLALRAAAFVATAGVTRAELEAVSRAVLPKFMADDVDPAAWAAFGSCEGRRVVVTRMPRVMVERFAKEHLGAHAVVGSDLEYSRLRRSTGLLKGACHEAVASRARALFAGDDLPDLAIAGSEMARSFTFCEEQISPPFTGDHGMNAAPPFRPVIFHDGRLVCRPTPFMSLVILLWLPLGVLVAFVRIAVGLMVPIWSIPYIAPVFGGAVIIHGRAPPPVRPSDAADVGSPPSGVLFVCTHRTLMDPVVLATVLGRRVAAVTYSISRLSEILSPIPTVRLTRDREVDAARMRAELASGDVAVCPEGTTCREPFLLRFSKLFAELSDRIVPVAMNYRVGLFHPTTARGWKAMDPIFFFMNPRPVYEVTFLNQLPAEATCAAGKSPVDVANYVQRILAATLGFECTTLTRKDKYTVLAGNDGVLNAKPAAAGKPAWQSRVKEVLGFLLH

SEQ ID NO: 93723 - DNA, 878 bp, Zea mays
  misc_feature: Ceres CLONE 1583177
  misc_feature: Translation starting site: 187
  misc_feature: SWISSPROT Homolog: EC 1.4.1.2 Glutamate dehydrogenase
gcggtggcggccgctctagaactagtggatcccccgggctgcaggaattcgtctcacccctagaaaaagtccacccattcctcgttcttccttaattcctcatttcctccacgtacgcgtgcatactctgcgagtccaggaggtattttcccccttcttcacgatactctcgacgagagcgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacgcgtcggtgcagagtgacgccaagctatggcctttcaaggtgatcccgggctccggcgacaagcccatgatcggggtgcagttcaggggcgaggagaaacagttctcggccgaggagatcagctccatgatcctgaacaagatgaaggagacggccgaggcttacctcggcaccacccatcagaacgctgtcgtcaccgtcccggcctacttcaacgactcccagcgccaggccaccaaggacgccggcgtcatcttcgggcctcacgtcatgcgcatcatcaacgaggccaccggcgccggccatcgcataacggtctcgacaagaagtcaagcaccgacggccgagagaaacttcttcatctttaacttccgggggggggacccttgacgtctcgcttcttaacctccgaggagggcttctttgaggccagggcccccgca

SEQ ID NO: 93724 - DNA, 1333 bp, Zea mays
  misc_feature: Ceres CLONE 1583179
  misc_feature (1015)..(1015): n is a, c, t, g, unknown, or other
  misc_feature (1289)..(1289): n is a, c, t, g, unknown, or other
aaacaaattaaaggaaggcgataaccacaatccacccccccccccccccccccccacacaccacccacatattttatcatgcaactccccacggtggcggccgctctagaactagtggatcccccgggctgcaggaattcgtctcacccctagaaaaaaaaattctagtattccaccgccgcacacctcctgtcttccttcaccttcgcgctccgccgccgccgtcgattcgtgctgctctcacccctaacctgtccaacatcgccggggacggaagcagcagaagaagctccccttacctccggctatcgcctgacgataaaatgtggtctgtaggggagtcttaggggggagtcaaagggataggatatggagagatgaagcaatcaatttcttcgtccgccttcgccgctgcttacgtccccggctactaaccctagtgataataagaacaaaaaaagattcataataaaaaatcccccacgctttcatacctattaaatttatgagcgcacgaacaggcttttacaaacgattttcttctgtgatatatctggtaaattacgcccaacttgttatttacattttttgtatgcccgcttgtgcaccaaagattaactccgttttggttttatctgtttcctattatacgctcccatcgctataaccaagatgtagctcgccctaattttaatcccgcgccgcaagtgttaatttagccgcgtggttcaactttgtgattaccctgggaatacacctcactaatatgtatgagactgttcctcttactgagagcatcaaaacaccttgggagatatgacatatcacctcctccgcgctcactggtaaatatatactttttaacctcttgcactatacccgctctcctgacataagattttatatatcgcagcatgtcttcaatctcttagagaaatatctaggccttttttactaacgtagtcaattatatatgtgcgctcacctttccagatggacgagtgcttcgtgtcancccgtgtgatttgagaaaagacgtttgtcacgcactattttcttaacaattctacacaactagcgacgacgcgttagagaatagagcggatacaacagagatcagaggtcgattatttactccataaatttgtgacttcacatacactatacgtagcaggattgtatgacactctaaatgtgtcgcctagtcttgtggatcacccccgctcttatatataactattgcagtctcgtgtttacctctcacacacaagcgcgttagtaatactagngtacgtctgactgtacaacagccatgatgcacacttcttcagag

SEQ ID NO: 93725 - DNA, 874 bp, Zea mays
  misc_feature: Ceres CLONE 1583181
  misc_feature: Encodes the peptide sequence at SEQ ID NO. 93726
gagctccccgcggtggcggccgctctagaactagtggatcccccgggctgcaggaattcgtctcacccctagaaaaaccggagaactgagaaagcccactcgttagtcgttactcccaacaccgggaatccatggagccggcctatgtcgtcaccctctccttcctcttcctcttcttgctccaccatctcctcggccgccaccgccgcaggaccaacggcaagaacaagagaacgcagctgccaccgagccctcccgccatcccggtcttgggtcacctccacctcttacggaagcctatccacgcggcgctcgctcgcctcgcggagcgctacgggccggtgttcttcctccggctcggctcgcggcaagccgtggtggtgtcgtccgcggcttgcgccacggagtgcttcaccgagaatgacgtctgcttcgcgaaccgcccgcggttccccacgctcctgctggtttccttcggcggcgccacgctcccaatgtgccgctacggcccgtactggcgcaacctccgccgcgtcgccacggtgcagctcctgtccgcgcaccgcgtcagctgcatgctccccgtcatatccgccgaggtgcgcgcaatggcgcggaggatgtaccaaatcgccgccgccgcccccgccggggccgcgaggttcaagctgaaacggaagctgttcgagctctcccacagcgccctgatggagaccatcgcgcggaacaaaacgtcccgtggcgtggcggaacgacgacaggaaaatgtctcctggaggcccaggaattcatgaaaggcgctggacgtgtttctttcggcttctcagcggggccaaagcctgggaactacctggcggggctacggtggcgtcaa

SEQ ID NO: 93726 - protein, 220 aa, Zea mays
  misc_feature: Ceres CLONE 1583181
  misc_feature: SWISSPROT Homolog: EC 1.14.13.89 Isoflavone 2'-hydroxylase
MEPAYVVTLSFLFLFLLHHLLGRHRRRTNGKNKRTQLPPSPPAIPVLGHLHLLRKPIHAALARLAERYGPVFFLRLGSRQAVVVSSAACATECFTENDVCFANRPRFPTLLLVSFGGATLPMCRYGPYWRNLRRVATVQLLSAHRVSCMLPVISAEVRAMARRMYQIAAAAPAGAARFKLKRKLFELSHSALMETIARNKTSRGVAERRQENVSWRPRNS

SEQ ID NO: 93727 - DNA, 851 bp, Zea mays
  misc_feature: Ceres CLONE 1583183
  misc_feature: Encodes the peptide sequence at SEQ ID NO. 93728
ccgctctagaactagtggatcccccgggctgcaggaattcgtctcacccctagaaaaaccccgaattttctgcatatatctaaaaaaaatatcgaattacatcaaatccgaggagcagccacagccatccatggaggcgctctacttgctggcctccctggccgcgactgtcgtcacctccgccttccactcgctcctgctgttcctccgcctcctcctccgctacccgcgccgcgctgcccctaccgatgatgggcccgccgcggcggcgcggctctacgagggccgggtccggcacgcgcgacggcgcccggcggcgcacaccttcgagtaccccgcgcgctacgccctcgtcgacctcgaccgactgccgctccccggccacctctccgccgacgatgcccgccgcgtcgcctccacctccggccccgtgcacctcttgacggtacccgagagcgtggggtacgagcagaacccgctgagcatttactactgctacgattctgcaggacaggggcaagatggagagctcagaacgtgcattgccgaggtcacaaacaccccctgggcagagagagtgatgtttaccttccaaccgggctctgatctcattgcgaagcccttgcatgtcagcccctttatggatatgctcagcaactggagtattcgcgctgatgctcctggtgatagactctatgttgggatatcagttcagcatccgacacttggggactacttcactgcagttttggatgccaaattggttgacagaacaagtaatctctgaagcttgcaactctctttctgctgatgccgcacaagatgctgcatggataactggggagccctca

SEQ ID NO: 93728 - protein, 218 aa, Zea mays
  misc_feature: Ceres CLONE 1583183
  misc_feature (47)..(217): Pfam Name: DUF1365 Pfam Description: Protein of unknown function (DUF1365)
MEALYLLASLAATVVTSAFHSLLLFLRLLLRYPRRAAPTDDGPAAAARLYEGRVRHARRRPAAHTFEYPARYALVDLDRLPLPGHLSADDARRVASTSGPVHLLTVPESVGYEQNPLSIYYCYDSAGQGQDGELRTCIAEVTNTPWAERVMFTFQPGSDLIAKPLHVSPFMDMLSNWSIRADAPGDRLYVGISVQHPTLGDYFTAVLDAKLVDRTSNL

SEQ ID NO: 93729 - DNA, 834 bp, Zea mays
  misc_feature: Ceres CLONE 1583185
  misc_feature: Pfam Name: Hemerythrin Pfam Description: Hemerythrin HHE cation binding domain
  misc_feature (36)..(36): n is a, c, t, g, unknown, or other
  misc_feature (443)..(443): n is a, c, t, g, unknown, or other
  misc_feature (505)..(505): n is a, c, t, g, unknown, or other
cggtggcggccgctctagaactagtgggatcccccngggctgcaggaattcgtctcaccccctagaaaaaaaggagaatctagcacaaatactgacagaaatcatagctcacacaatgctgctactgaagcatcgcaatgtaacaacagagcctgttacattcccaggttaagagtagaaagtagctaccttggtgttcattcatctacccctacaaaatcctttcgccctctgtctttcaattatgttgcaccttcattatattcaagccttttctcatgggacacagatacactagtatccggcccagataacatttctaagccaattgataccatattcaaattccacaaggcaattcgcaaggatttagagtttttgggattcgcaatctggaaagcttattgacggggaacgagtcttgcctttagcaattccatggnaaggtttcgtttactgtgggggtctatatagagcacacaccaatgcttgaaaatgagaatgnaattttctggctctttgaatcgaagggagccattgcccaatggtaaggcaattcaaacacccttggattcccagcaggaaaaaaaaattggtcccaaaaaatattcccctggtacttatttgaaatttttccaaaaaacaagaagggtttggagaccaccctcttgagagttgaaaccgggaacaaaaggtttttttcaagtaatgggaatttgtttggggcttaaaaaaccgaatagaaatttttaaaaaagtttcccggggttttttcaaattttttccggggggcggtttttaaaaataaggtttcttaaaagaaaaaactatttt

SEQ ID NO: 93730 - DNA, 968 bp, Zea mays
  misc_feature: Ceres CLONE 1583187
  misc_feature: Encodes the peptide sequence at SEQ ID NO. 93731
  misc_feature (1)..(1): n is a, c, t, g, unknown, or other
  misc_feature (17)..(17): n is a, c, t, g, unknown, or other
  misc_feature (748)..(748): n is a, c, t, g, unknown, or other
nggggggggggtttctntctttctaagtcaaaaaaaaacctaaattattaaagaaaaatttaaattacttttatttcttttttttttaaagctggagctcccctcggtggcggccgctgtagactcaccggatacaggccgctcgccgactgaggctggccagctgctgcacggcagcggcgcggaccagcaccacgggctgccgcgcggcggggtgccggtatacgtgatgctgccgctggacacggtggggccaggcggccagctgtcgcggcagcgcgcgttggcggccagtctgatggcgctgcggggcgccggggtggagggcgtcatggtggacgtgtggtggggcgtggtggagcgggagggccccggccgctacgactgggaggcctacgccgagctcgtgcgcatggtggagcgagccggcctccgactccaggccgtcatgtccttccaccagtgcggtggcaacgtcagcgacacccccaacatcccgttgccgccatgggtgctggaggagatgagcagcaacccgggacatcgtgtacacagacagagtccgggccgccggaaaccccgaagtacatctccccctcggctgcgaaaacgctgcccgggtgcttaaggggccgggaacccccatccagggtctcacacccgaactacaatgcgtcaagctttccggcggaagagaattcccgtgtacctaccctcgggcaaatgttcattccccgggagattcccnagtgggggccatgagggtccctttgtgagagtaggctgaagggtaatccctttcactacccctggaggggccaaacgggaaaacctgggcggtttttcccgggaggcattcaggcgaaagtttccaaatggcttatgaattaagttaacatggccggggccttcagccttggtaaaacccggccagcccgtttggaccaccccggggttcccaccaaaga

SEQ ID NO: 93731 - protein, 132 aa, Zea mays
  misc_feature: Ceres CLONE 1583187
  misc_feature (1)..(131): Pfam Name: Glyco_hydro_14 Pfam Description: Glycosyl hydrolase family 14
  misc_feature: SWISSPROT Homolog: EC 3.2.1.2 Beta-amylase
MLPLDTVGPGGQLSRQRALAASLMALRGAGVEGVMVDVWWGVVEREGPGRYDWEAYAELVRMVERAGLRLQAVMSFHQCGGNVSDTPNIPLPPWVLEEMSSNPGHRVHRQSPGRRKPRSTSPPRLRKRCPGA

SEQ ID NO: 93732 - DNA, 816 bp, Zea mays
  misc_feature: Ceres CLONE 1583189
  misc_feature: Translation starting site: 230
ctccccgcggtggcggccgctctagaactagtggatcccccgggctgcaggaattcgtctcacccctagaaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctggaggaggtggacgggaggcggtggagctacgtggtggacggtggggccgcgaaggggaggagcaggggcggggccgtccccgctggggccgccgtcaggcccgtgccgctgcagtcgccgcttccgcctgccgaggaaataatggcattcataagatcatatgtgggtgcctgaagggtttccagacagtgttactccttcatatgtaccttacatgaccctggagggctctgaagccatttctttgggtgaagcgatgggagtgtttacgacaagaacttgcctgagttcctgttggagtctctcaaagcaaggtaaacacaggtgccattggctatcactggatccccaggatggtgctggggcgtgtcccgaaaaatggtttttggcactcaaaggaaagaaaa

SEQ ID NO: 93733 - DNA, 834 bp, Zea mays
  misc_feature: Ceres CLONE 1583191
  misc_feature: Encodes the peptide sequence at SEQ ID NO. 93734
  misc_feature (493)..(493): n is a, c, t, g, unknown, or other
  misc_feature (603)..(603): n is a, c, t, g, unknown, or other
  misc_feature (609)..(609): n is a, c, t, g, unknown, or other
gcggtggcggccgctctagaactagtggatcccccgggctgcaggaattcgtctcacccctagaaaaaagccgcatcccttctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtcccggttcaccccttccatgtccttcgtatcaacaagatgctttcgtgtgctggggctgataggctccagactggaatgaggggtgcctttggcaagcctcaggncacctgtgctagggtggacattggtcaggtcctcctttctgttcgatgcaagggacaacatgctgcacatgccagtgaagctctgcgtcgcgccaagtttcaagttcccntggcgncaaaagattattgaggagcagaaagtgggggcttccccaagttcagcccgggcgactaactgaaagacaaaaggtagggtaggaatggttcctgatggggtcaacccaaaaactcctcggtaaccctggaagaacttgaaaaccggctccctgggaaggtttttccccggggccgtggttttagcccaactccacgggggaaaggcgaaccccaaacatttgtgt

SEQ ID NO: 93734 - protein, 166 aa, Zea mays
  misc_feature: Ceres CLONE 1583191
  misc_feature (5)..(167): Pfam Name: Ribosomal_L16 Pfam Description: Ribosomal protein L16
  misc_feature (124)..(124): Xaa is any aa, unknown, or other
  misc_feature (161)..(161): Xaa is any aa, unknown, or other
  misc_feature (163)..(163): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSAGKDAFHLRVPVHPFHVLRINKMLSCAGADRLQTGMRGAFGKPQXTCARVDIGQVLLSVRCKGQHAAHASEALRRAKFQVPXAXKDY

SEQ ID NO: 93735 - DNA, 1227 bp, Zea mays
  misc_feature: Ceres CLONE 1583192
  misc_feature: Encodes the peptide sequence at SEQ ID NO. 93736
  misc_feature (18)..(18): n is a, c, t, g, unknown, or other
  misc_feature (59)..(59): n is a, c, t, g, unknown, or other
  misc_feature (440)..(440): n is a, c, t, g, unknown, or other
  misc_feature (1071)..(1071): n is a, c, t, g, unknown, or other
ggggggttggtctccccnctgtgcatctagggggtatttattactacgtgagagtgtgngggggaatttttttaatagtggagctcaccgcggtggcggccgctctagaatagtggatcccccgggctgcaggaattcgtctcacccctagaaaaatcttgagaaagaactcctcgtcctcgctccctccccaaccatcaagagcgcacacgcacacgcacacgccgcgcgcaagccggccgacgtacggcatggagaagagcgctacaactggcggcggcggttcaagcggcggcggacaggcggcggaggaggcgaaggtgcctctgctgcatccgagggctgcggcggcggcggctgccgaggaggaccatggaggacgaggaggatactacggcaaggcggcctccgctgctgcggatgaggacggcagggacacntcgtggtcgtcgctgccgctgcggcggcacgcgtgggaggacaaaaagaagctgtgggttgtgggcccgtcccgtccatcttcaagccgtttcgcgttccttccggcattcaaccgttattaagaccaggccctttcatcgggggaaaaattcgggggcccacccggaagcttcggacggccttaaggcggcttcggtacttccaacccagttgcttcgaaaggaaggggttacaaagccaaaaagaaggcaatttccctgaccctgggaggcccatagagaatcgcaaaccgccccgccccctaggaaaagagaatacggctctagttttggcgcggcgggttccaagggtcaagagcttataaggggggggggggcacggcaaaaaagaaccacaagtttatccccactgcgaaattgtgcccggtgggggggacaaatttttctaaacctctctggggtcaaaagcggggatataccccctgtggagaatattatatttccctctgtttccgcgggcgtgttgtagaaccccgcgtctgggggatagagaggagcattcccctctcccgcgggtataacccgcgggttttcaccgcgaaaaacccaccctatcctcgggttggcgcgncactgtgaggtccctaggaaacccccggagaaaatttctccgcccgagtgtgaccggaggagaaacgacagacccctttcttggttaaaaacaccctcgaggaactcttcttgcctaacggagggaggccttcacccccctcaaaaaaaaacccgg

SEQ ID NO: 93736 - protein, 103 aa, Zea mays
  misc_feature: Ceres CLONE 1583192
MEKSATTGGGGSSGGGQAAEEAKVPLLHPRAAAAAAAEEDHGGRGGYYGKAASAAADEDGRDTSWSSLPLRRHAWEDKKKLWVVGPSRPSSSRFAFLPAFNRY

SEQ ID NO: 93737 - DNA, 992 bp, Zea mays
  misc_feature: Ceres CLONE 1583193
  misc_feature: Encodes the peptide sequence at SEQ ID NO. 93738
  misc_feature (719)..(719): n is a, c, t, g, unknown, or other
  misc_feature (992)..(992): n is a, c, t, g, unknown, or other
atctgctttttcaatgattgtctatcaacaccctccctcactaatactcgattttttccccgtcccggataaactgacctccccgcggtggcggccgcggcgccaggacgagctagtgcatgacagtctcgtagtgccgccgcgcgcaccagcaccaccatgcgagcacccgttctgcatttttatcaggggagagccggtgtgcaggtgcctcgacggaacccggccggcccccagcagcagcgtcgaaatgaggatgatgatgcacgcagacatggagagagccagcagctagcgtgccactgagccactgatgtacgtggttttggtttgtttgttcttggtccagcagtaacagtgatagtgtcgtgaatgagctagcacactgtcgagtctgtcaggatgatgctcattccccagtgtccaggtcgtctggttccgtgttccaagaaccaaaatcctaccttaccgggtttttttgttttttggggaaaaaaaataaaaaacccttcccctttggttaaaaaaaccaaaagattctcccggggggatttctcgcgcccggagaccaaacacaattataatcataccccgaaaaaaaaatacttttggtggttgggtaaagagaaaaaaaagacccgctttatgtgtcgtggggcgaaaaaaacacttttctttttttttctcacaaaaaaaaaattttctccccccccccgcgnggttctaagaagatagagatataaaattttgtgggtgggtcccgggacgcccgctagatgaataacaattggtgggggtgtgcgcccccccgcacgggtggggtcaaaaaggggtggggtttttttccccccacaaaatccccccctcttttttttatggttgtggcccctctttttaacacacggggaaaacgaaaaaaggaatcacccacaactcttttttccccaaaaaagggttctccccccacccaaaaatttttaaaaagccccccn

SEQ ID NO: 93738 - protein, 97 aa, Zea mays
  misc_feature: Ceres CLONE 1583193
SAFSMIVYQHPPSLILDFFPVPDKLTSPRWRPRRQDELVHDSLVVPPRAPAPPCEHPFCIFIRGEPVCRCLDGTRPAPSSSVEMRMMMHADMERASS

SEQ ID NO: 93739 - DNA, 878 bp, Zea mays
  misc_feature: Ceres CLONE 1583196
ctccccgcggtggcggccgctctagaactagtggatcccccgggctgcatgtatattcgtctcacccctagaaaaaatctcactgccacatacgcaaagagagattctagtggtttccaaagccaagtgtgtactagcagtctagcatccagctagctcgggcggcagcaggcagccatcatgtcggaggagaagcaccaccacttcttctaccaccacaagaaggactaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgacgccaagaaggaccccgagcacgcgcacaggcacaagatcacggaggaagtcgctgccgcggcggccgtcggcgccggcggctacgtattccacgagcacctcgagaagaagaaggaccactaggacgccgaggaggctagcggcgagaagaaaaccaccacctcttcggctgatcgtagtaccggcccgcgcgcgatcgagctagctagctccggtgcacacaaccacacacctgtttaattcctgtactgcattgcctgtggtaattagaggggttcacaataaatgaggtcccgtctccctgaccttgggtaaggctccttgccttgtgggtggagttgaaaattgttcaataattgaaggggaaaaaaaatagttggtaggggccactggtgggctttaccttccgagaagaaaggtggttggttccccatggttaccctcgccttttcgggttatttcataaatgacaaggg

SEQ ID NO: 93740 - DNA, 1066 bp, Zea mays
  misc_feature: Ceres CLONE 1583198
  misc_feature: Encodes the peptide sequence at SEQ ID NO. 93741
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (63)..(63): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
ntgtggtgggnnnnnnnttnncnaacntnncacaaaatnnaaantnnnncnnnannncccaanaaaccaacaannncaaaactggaactccccgcggtggcggccgctctagaatagtggatcccccgggctgcatgaattcgtctcacccctagaaaagctcctgcctcgcctcaccaccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccccatggtggcgcacgggcccctctttctgcgacattacctggggcgccgggggaaccaccgctgaaccttaccctcaaaatcgccaaccgtaagtcaaaaagggtgggggtggaaaaccatgaaggacctggaatgttaaaaaccccccccccccccaggttaaacaaagccttgggaaaccacccaaatccaatggggaattccaaaaagtttttggccccctcaaaggggaaacccttcacccagggggaaaagaaaaattttgtggccaagtttgaaagggggggaaatttgccttggggcctcctttgaaatttggggtggccgcccctattttttggaagccccaagctaccggggggagattaatttttgtggccaaattaactggttaagccctgggggtttattcccccgaaaggggcgaccccccccctgaaatgcgcatatatcaaagggaccccaagggggagggtggccccaccacgttggggaaggcccctttaatgccaaaggggaaattttttggcccgaactttgggaaaaaaaaaaaagggttggaatgtcctgggggggttgaaaccctttttgggtttaaaccaaactttttgtttgttgttttacccacacccctttttttccaaattttggtgaaaaaaaatccccccccaaaaattggggaatatccttgtcaccaattgttttcccggagcaaagggccaataa

SEQ ID NO: 93741 - protein, 60 aa, Zea mays
  misc_feature: Ceres CLONE 1583198
  misc_feature: SWISSPROT Homolog: EC 1.5.1.20 Methylenetetrahydrofolate reductase (NAD(P)H)
MKVIEKILEAAGDGRTAFSFEYFPPKTEEGVENLFERMDPMVAHGPLFLRHYLGRRGNHR

SEQ ID NO: 93742 - DNA, 972 bp, Zea mays
  misc_feature: Ceres CLONE 1583199
  misc_feature: Encodes the peptide sequence at SEQ ID NO. 93743
  misc_feature (1)..(1): n is a, c, t, g, unknown, or other
  misc_feature (2)..(2): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (28)..(28): n is a, c, t, g, unknown, or other
  misc_feature (34)..(34): n is a, c, t, g, unknown, or other
  misc_feature (40)..(40): n is a, c, t, g, unknown, or other
  misc_feature (47)..(47): n is a, c, t, g, unknown, or other
  misc_feature (53)..(53): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (474)..(474): n is a, c, t, g, unknown, or other
  misc_feature (480)..(480): n is a, c, t, g, unknown, or other
  misc_feature (825)..(825): n is a, c, t, g, unknown, or other
nngggaggggaannngaggagggtgatnaaaacncaacanttggcancaaaanacnnnnaaaaaaaccnnnnnacaaactggaaactcaccgcggtggcggccgctctagaactagtggatcccccgggctgcaggaattcgtctcacccctagaaaaaccgtcacagctagcgcttgcccaggtcccccaccttatcaacaacaactgtgcagcttagctagctgcccctcctgcccccgctcgccgcgagagctcccgtcccgacgaccttccctcctgtagcactctacagtctacaccaagcagcagcgtctcctgttgcatgttgcactgcacctatctacgacgtccgttcccagtgctttgctcatccaccttcatcaagccaagcgtgtgtcctctccagctgcgagctccgacccccggcaccatgtccgacagcagcgacttcgccgagctgctatgggagaanccccangcggtggtgcacgcgcggacgaggaaacagccgccccagcagcccgccttcccgcccttcaccttcacctgcagcagcagagctcaacaaaggcagccggtgccggcgctgctcaagacgggaggaggtctctttgccgacttctcctcggccaccgccggcctagacaccccccgtcacaacggcgacctcgacgacaccgtgccgtggaatcactaccccatccccatcgtcgacgaaaccaagtcccgccgcgcctgccctggcagatagcttcatcccagatttcttctcggagcttcatgcggcggcggcgaacaacaaaccttcggccttttggcaccnaacacaacaaccaacatcaggaagtccagcacaccgggggacaacaaccacaaccgggaacaccccggtttccaaatcccaccaccggagagaagaaccagaacccctcaaaggaaaacccaccgcgccaccaataacccgggtcca

SEQ ID NO: 93743 - protein, 106 aa, Zea mays
  misc_feature: Ceres CLONE 1583199
  misc_feature (14)..(14): Xaa is any aa, unknown, or other
  misc_feature (16)..(16): Xaa is any aa, unknown, or other
MSDSSDFAELLWEXPXAVVHARTRKQPPQQPAFPPFTFTCSSRAQQRQPVPALLKTGGGLFADFSSATAGLDTPRHNGDLDDTVPWNHYPIPIVDETKSRRACPGR

SEQ ID NO: 93744 - DNA, 879 bp, Zea mays
  misc_feature: Ceres CLONE 1583203
  misc_feature: Encodes the peptide sequence at SEQ ID NO. 93745
  misc_feature (463)..(463): n is a, c, t, g, unknown, or other
  misc_feature (494)..(494): n is a, c, t, g, unknown, or other
  misc_feature (495)..(495): n is a, c, t, g, unknown, or other
ggagctccccgcggtggcggccgctctagaactagtggatcccccgggctgcaggaattcgtctcacccctagaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccgttgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccgggcagactatcaccctcgaggtggagtcctctgacaccattgacaacgtcangggccagatccagggacaggagggcatcccnntcagacagcagcggctcaatttttgctgggaagcagctttgaggacgggcgcacgcttgccgactacaaaattcagaagggaagcaccccccccactggtggcggcgccctcaggggaggcattgcaaaactttcgtgaaaaccctgaaccggaaaaaatttacccctccgaggggggagtttttaaaaaccccttaaaaaattttaggggccaaaaatcccgggaaagagagggggtttttcccccaaaacaaagagaggggggtttattttttttggggaaaaaacactttttggagaagggggggccaccctgggggccaaaattaaacaatcttcgggaagagagagggcccccccctccccctgggggggtgcgcgcca

SEQ ID NO: 93745 - protein, 241 aa, Zea mays
  misc_feature: Ceres CLONE 1583203
  misc_feature (6)..(74): Pfam Name: ubiquitin Pfam Description: Ubiquitin family
  misc_feature (103)..(103): Xaa is any aa, unknown, or other
  misc_feature (114)..(114): Xaa is any aa, unknown, or other
MQIFVKTLTGKTITLEVESSDTVDNVKAKIQDKEGIPPDQQRLIFAGKQLEDGRTLADYNIQKESTLHLVLRLRGGMQIFVKTLTGQTITLEVESSDTIDNVXGQIQGQEGIPXRQQRLNFCWEAALRTGARLPTTKFRREAPPPLVAAPSGEALQNFRENPEPEKIYPSEGGVFKNPLKNFRGQKSREREGVFPPKQREGGLFFLGKKHFLEKGGPPWGPKLNNLREERGPPPPPGGVRA

SEQ ID NO: 93746 - DNA, 815 bp, Zea mays
  misc_feature: Ceres CLONE 1583206
  misc_feature: Encodes the peptide sequence at SEQ ID NO. 93747
  misc_feature (446)..(446): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (522)..(522): n is a, c, t, g, unknown, or other
  misc_feature (523)..(523): n is a, c, t, g, unknown, or other
  misc_feature (525)..(525): n is a, c, t, g, unknown, or other
  misc_feature (526)..(526): n is a, c, t, g, unknown, or other
  misc_feature (535)..(535): n is a, c, t, g, unknown, or other
  misc_feature (546)..(546): n is a, c, t, g, unknown, or other
  misc_feature (550)..(550): n is a, c, t, g, unknown, or other
  misc_feature (551)..(551): n is a, c, t, g, unknown, or other
  misc_feature (570)..(570): n is a, c, t, g, unknown, or other
  misc_feature (584)..(584): n is a, c, t, g, unknown, or other
  misc_feature (595)..(595): n is a, c, t, g, unknown, or other
  misc_feature (613)..(613): n is a, c, t, g, unknown, or other
  misc_feature (624)..(624): n is a, c, t, g, unknown, or other
  misc_feature (625)..(625): n is a, c, t, g, unknown, or other
  misc_feature (650)..(650): n is a, c, t, g, unknown, or other
  misc_feature (652)..(652): n is a, c, t, g, unknown, or other
  misc_feature (692)..(692): n is a, c, t, g, unknown, or other
  misc_feature (719)..(719): n is a, c, t, g, unknown, or other
  misc_feature (748)..(748): n is a, c, t, g, unknown, or other
ctccccgcggtggcggccgctctagaactagtggatcccccgggctgcaggaattcgtctcacccctagaaaaaatttctcctctcctctcccctcgctagttcgtcgcgtcctcctcagatcaacaaaccgtgtcctgctgctgcctctggaaaccaccgggggatcgccccgcccttttcttcccgcaccccagatcctccgtcccaaaacggcagcttccggaggtctcccgtctccctgctccttccggcgcgacgggtggcccggctcgcggatccggcggtcttcggtcgacggcgaggcggcgctcgtcttggtatcgggagtggttgctgagagcgcggagatggtggccgaggcggaagtcatgcatcagtcccccgttccggtgctgagaggtgcagtaccaccggcgcgcgacgaccaagggggttgacgacgtncgtcgggatgtccgcgcccgccccccgagtggggggggtttnnnnnnnnttttttttannnnnnnnnnnnnnnntnntnnattttcccnttggaaggtgntttnntaggggggtgggaagaagnttgatgtttggaanaaagttttttnaaggggaaatgattaagnaagtttggtgnnaaaaattaggttttgggtagttttngnagtaaattggggccttgggaggttttatgggaggagaagnaaattgggaatagaagattttttccgnccattttgggttcgatgtttagtctgganttctggccttagcgcctttctacgggggtcctttgaacggccatggcgggccccggtacgccccagg

SEQ ID NO: 93747 - protein, 29 aa, Zea mays
  misc_feature: Ceres CLONE 1583206
MVAEAEVMHQSPVPVLRGAVPPARDDQGG

SEQ ID NO: 93748 - DNA, 871 bp, Zea mays
  misc_feature: Ceres CLONE 1583207
  misc_feature: Encodes the peptide sequence at SEQ ID NO. 93749
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
ctccccgcggtggcggccgctctagaactagtggatcccccgggctgcaggaattcgtctcacccctagaaaaagtcggcggtcgtgaaccgaacaaacctttccccaaaatttcccctcccccgcaccgaacgaactctcgatccgatcccgatccctgcagggagccgcctcggctcaccgatccggccccggatccgctcgttgctcgacgggatctctcgatcgcggtctggacaagcatgctgcatcaggagaacagtgaggctttcgggaggcaccactctgagcagcttgcatgtgtcaacatgaggggagcagataatggtcatccgaatttccttcctgagaaatgccagattgcagttcaccgaaggggtgaaaaagttggactatttgatgaagagctggtacatggtgttcatctaaccagtccttgtgttcagtcaccattggtgccaagtggtgtcaaagaaacacctatagtggatcataacaagagacctgcatccagtgacatactggacatagttgaatgcaaacggctgaagcaggaagatcaaatcgttactaaggaagacaaccatacatctgctgaggaggattttcatgactacccagataacactgcaagacttgatacctttgaatgagaggaatgtgactctcccccttcttgcatgatgagcgaataatgaatatggaggggggttgatctcacctcgtccaatggacagnnnnntcgcccccctatgttggaaagatggggctatgggccctgcccagcctttcatcaaattctgttgggccccttttttcccttgaagggaaacctggtttcctattcgggggcaaaatcatcgagggctgg

SEQ ID NO: 93749 - protein, 136 aa, Zea mays
  misc_feature: Ceres CLONE 1583207
MLHQENSEAFGRHHSEQLACVNMRGADNGHPNFLPEKCQIAVHRRGEKVGLFDEELVHGVHLTSPCVQSPLVPSGVKETPIVDHNKRPASSDILDIVECKRLKQEDQIVTKEDNHTSAEEDFHDYPDNTARLDTFE

SEQ ID NO: 93750 - DNA, 869 bp, Zea mays
  misc_feature: Ceres CLONE 1583210
  misc_feature (670)..(670): n is a, c, t, g, unknown, or other
  misc_feature (715)..(715): n is a, c, t, g, unknown, or other
  misc_feature (719)..(719): n is a, c, t, g, unknown, or other
  misc_feature (805)..(805): n is a, c, t, g, unknown, or other
  misc_feature (837)..(837): n is a, c, t, g, unknown, or other
ccccgcggtggcggccgctctagaactagtggatcccccgggctgcaggaattcgtctcacccctagaaaaagcgttgcctgtcgtcttcgcctgcacggctgcacctaaagctctgacctttttccccactttcccttggcatctactgccttgtccggtgtagaaaacaacggatttcgttgtgttgttttgctgcggtttttgtcccctcccttctcactcggcgagctttgttgttcactttggattccacgggtttgtttcggattaggaaggctcggtttttggtctgggaaggccccccttccgaggcgatgaatttggtgcgggttgatggcgtcctgtcaggagtccgctatgcaatgatgggttctttgaagccgaggtgaatctttgacctgcctagtttgcgattccaaattccgagctcccaccgcttcttgatccgccgggcgccatgggcctctgctacggcaagtcggcggcggtccaggagccggcggtagcggaggagaacaacaaagccgatggcgcggcggcgggccgaggcgatggcccgccggcgtcgccggtgaaggtgcctcggacgcccagcagcccaagttgtccttctacttgccgagcccgctcccgccctccagctacaagggctcgccggcaaactccangcgtcgcgtccacgcccggcgcgcggcgggttcaagcgcccgttnctgnccgcgtcgccctgccagcacattcgtgcgctgctgggcgcgcgccacggctcggtcagccccacgaggcgtcccatctcgagggcngcgaaccagaccttgggctggacagagcttcngctactccaggcacttgcggccaagtacgacc

SEQ ID NO: 93751 - DNA, 798 bp, Zea mays
  misc_feature: Ceres CLONE 1583213
  misc_feature: Encodes the peptide sequence at SEQ ID NO. 93752
  misc_feature (654)..(654): n is a, c, t, g, unknown, or other
ctccccgcggtggcggccgctctagaactagtggatcccccgggctgcaggaattcgtctcacccctagaaaaacttctgtctggctccgcatcccagtcccagacccggcaagcgccggccatcgccatttcggatccgggcccgctcagcgcgcgggttcccgaacccggccggccggccgcgctcctcgccaccgccgccgccggccatgaagcgcgcgcgcagctccgaggtattcatcggcgtaggccggctgcgcgcacgcaggggcctggcgccgttcctcgcagcggcggctttcgcctacctactgttcgtgtccgtcaagctcacttacctcggcagcgctgggcccgcgcctgccttcggccgcctggacaccaccggcgcgggcgagccagctgcgcgcgcgcgctcgagcggcggcggggccgtgtccgggtacggccgcatcaccggcgagatcctccggcggcacgaagccttcgaggagcggcggaagcggttggggcagctggggaacttcacggagctcgagcgcgtggcggccgaagcgtgtgcgctcggggccgccgcgtgggaggaggcctctgcgttcgacagcgaactcgactacatcgcctcccgcgacgtcgcccggggagggcaccgncaagtgcccaggctcgctcgcgctcggcgccggggagacccacggcgtcctgccgtgcgggctgggcgccggggtcgcagttacgtggttggggacaacgcgcccgcgcggccggagtaactcaaggcgctggtagcgaacgga

SEQ ID NO: 93752 - protein, 187 aa, Zea mays
  misc_feature: Ceres CLONE 1583213
MKRARSSEVFIGVGRLRARRGLAPFLAAAAFAYLLFVSVKLTYLGSAGPAPAFGRLDTTGAGEPAARARSSGGGAVSGYGRITGEILRRHEAFEERRKRLGQLGNFTELERVAAEACALGAAAWEEASAFDSELDYIASRDVARGGHRQVPRLARARRRGDPRRPAVRAGRRGRSYVVGDNAPARPE

SEQ ID NO: 93753 - DNA, 808 bp, Zea mays
  misc_feature: Ceres CLONE 1583216
  misc_feature: Encodes the peptide sequence at SEQ ID NO. 93754
gcggtggcggccgctctagaactagtggatcccccgggctgcaggaattcgtctcacccctagaaaaaaacgggcagcctgtactgcccgcttctagctgcagctaccctccagtcccagttccagccccggccaggcgctcgcaaagtgcggagccgccctctcttcgagtcttcgctcgtggtctctctctccaggtcgtgcagtacgatccatatcccggagctcttgcgcgagcgacatgtcctcggcggcgggcggtggatacggggctgcgggcggcgccgagcaccagcacctgttgctggggcaggcctcggggcagctctaccacgtgccgcagcacagccgccgcgagaagctgcggttcccgcccgacccggccgactcgcccccgcccactgcctggccggcgcctccacccttctactcctacgcgtcctcgtcgacgtcgtcctactcgccgcatagcccaacgctggcgcacacgcagctagtggcgcacgcgctacctgccggcgccggggcccaaatcccgagccagaactttgcgctctcgctctcttcagcgtggtcgaaacctccgcccgcgccgcggaggcagctcgcctcgggggtagccgctgggccgtacagcccgttcacgggctacgcggccgtcctcgggcggtccattatcctgggtccccccgcagaaactaactcgagagatctgcgaactgggcggaacgcccccgcaactggacgggcgcttcgacgacaagggtatgctccacatggaacccgccggggggcttggaacaacaaa

SEQ ID NO: 93754 - protein, 189 aa, Zea mays
  misc_feature: Ceres CLONE 1583216
MSSAAGGGYGAAGGAEHQHLLLGQASGQLYHVPQHSRREKLRFPPDPADSPPPTAWPAPPPFYSYASSSTSSYSPHSPTLAHTQLVAHALPAGAGAQIPSQNFALSLSSAWSKPPPAPRRQLASGVAAGPYSPFTGYAAVLGRSIILGPPAETNSRDLRTGRNAPATGRALRRQGYAPHGTRRGAWNNK

SEQ ID NO: 93755 - DNA, 868 bp, Zea mays
  misc_feature: Ceres CLONE 1583217
  misc_feature: Encodes the peptide sequence at SEQ ID NO. 93756
  misc_feature (615)..(615): n is a, c, t, g, unknown, or other
  misc_feature (755)..(755): n is a, c, t, g, unknown, or other
ccgcggtggcggccgctctagaactagtggatcccccgggctgcaggaattcgtctcaccccctagaaaaaaccccaggtcgccacgcccgccacaagaagcagcagccttacccgaaccgaagacgaaccctaccgcgccttgatatcatatcgtctccgtgtcgttctcgcagcgcagcgagcgagccacgcgctcctgcgcagtagcgtaatggcggtgcaaggcggcgaggagagggagagcgggaagggcgccgccccggcggtggtgtcaggcggcgaggcgggcccgccgggccggaggacggcgaggggccacccgctcctgcgcggcgggtggaggcgcgaccggtacacgcacgggatgcggccggcgcagatggaggcgctccgcgccatgtgcggcgcgctcatcccctcgctgcccgccgacgccgacgccggccgcggcgacccgcccggcggcaaggacctcgagcgcttctacctcgcctccgcggccgactccaccatccccgacgaggtcgcggagctgatggtgacgcggtgcatccgcgaagcggtggcgctggcgtgggtggtgctttgggcgctgagcacgcgggcgggcacnctgctgctgtgcggccggctcagcctcggcgccgggcttccctacgtgcgcaggttcgccgacatggcgccgggagcggcggggaggcggccctgccgcgctggaaaccgggtgggctggcttcttccgcctcgaatcgnctttcgccatgttaaaggatccttggccactacggttttcttagccaagggggaacgaaaattccaagaatcctactgggaaggcgataggaatacacgtggaacaacccccg

SEQ ID NO: 93756 - protein, 218 aa, Zea mays
  misc_feature: Ceres CLONE 1583217
  misc_feature (181)..(181): Xaa is any aa, unknown, or other
MAVQGGEERESGKGAAPAVVSGGEAGPPGRRTARGHPLLRGGWRRDRYTHGMRPAQMEALRAMCGALIPSLPADADAGRGDPPGGKDLERFYLASAADSTIPDEVAELMVTRCIREAVALAWVVLWALSTRAGTLLLCGRLSLGAGLPYVRRFADMAPGAAGRRPCRAGNRVGWLLPPRIXFRHVKGSLATTVFLAKGERKFQESYWEGDRNTRGTTP

SEQ ID NO: 93757 - DNA, 910 bp, Zea mays
  misc_feature: Ceres CLONE 1583219
  misc_feature: Encodes the peptide sequence at SEQ ID NO. 93758
tccccgcggtggcggccgctctagaactagtggatcccccgggctgcaggaattcgtctcacccctagaaaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcccccaccacctcggccttgcccccggcggggaccccttcgtggcgtgcaacgagtggcgccttcccccgtctgcccgggactggctaccaattacaaagcgccggggagggggcaccccaaaaactgccccccggggggcagaaattccattacagcggcctccaggggctgcccaccctttgtgacccggggaaccaaggaagaaggaccggggttccaataaccctgggacaaaacaaattttcaactgggggacggggccataacctctcccaattttgggggggccgaaatccttttttttttatggggcccacattaaatctacgggccgcggggggaggggggcccccctcatggggggcgcgcccccaaaggtttttttcggggttatacccccccaaggggtccccccccctccccccaccaagcgggggaaaaaagggggggaaataagaatacctccccccccggagagaaacaccccggcccgggggggggcgcccttctttttttaggggag

SEQ ID NO: 93758 - protein, 103 aa, Zea mays
  misc_feature: Ceres CLONE 1583219
  misc_feature: SWISSPROT Homolog: EC 2.4.1.12 Cellulose synthase (UDP-forming)
MEASAGLVAGSHNRNELVVIRRDGDPGPKPPREQNGQVCQICPHHLGLAPGGDPFVACNEWRLPPSARDWLPITKRRGGGTPKTAPRGAEIPLQRPPGAAHPL

SEQ ID NO: 93759 - DNA, 1156 bp, Zea mays
  misc_feature: Ceres CLONE 1583222
  misc_feature: Encodes the peptide sequence at SEQ ID NO. 93760
  misc_feature (16)..(16): n is a, c, t, g, unknown, or other
  misc_feature (64)..(64): n is a, c, t, g, unknown, or other
gtttgtttggttcccnccctcgggggctggccggctttctatcaatttttatctcacaaccganggggagccgtgggtttttttcttctgttacttcaccgcggtggcggccgctctagaactagtggatcccccgggctgcaggaattcgtctcacccctagaaaaagcaccacttcacttgcttcaaagcgcagactctccagaagggcggagctgtagtcatcaccatcctgacaatggacgcgcgtcgtggtctccagcgaggccgagccgccttcgccgccgccttctcggcatgtcccttcctcgccctcgccgtcctcctcgccttgccagagctcgcagccggcgacacccactactacacgttcaacgtgcaaaatgaacaacgtgacacagccgcgcgtgactaaaagcatcccgactgtggaacgagggagttcccggggggcctaaacttggtcatgcgggaaaggcgtccgcctcgtggggcaaagtttcccaccggatcgacttccatggcctcctttccacctgggaaccgaattccggaaatctgccccaaggggtgggggctgggtccgtgccgtcgatacctcaaggcaagggcccccaaccccggggcggggggcaaaaacataccttggatgcaactttcaccaatccccgggggggcattccccagacctccactggtggggtgggaaaaagaaagaaaaattttcctctccagtgggtcctaggacccccgggggaaaaactcttctgtatgatgagaccccacggaccccgcgttacaaatttccacttcgccccccttatattcaccttccataacataagagtggtcctaaccaccccctattttttcctccttggctctcaccctttcaccaaatgaggtgaggaaggccccctattaccctttctgtgtcggaagggaaaataaggggtgctcctcaaattaatgaagtaccacctcgtggaaaggaggcccgtctgacttcacaaacactcatgtgcattcttgcataaataacgaggggcgcgcccagtgccccccaaataaattgtccctcgcgtaggaagacctgaaaaacacttttttgaaatatgggggtcttctcccagatgggcccgacagacactaataa

SEQ ID NO: 93760 - protein, 58 aa, Zea mays
  misc_feature: Ceres CLONE 1583222
MDARRGLQRGRAAFAAAFSACPFLALAVLLALPELAAGDTHYYTFNVQNEQRDTAARD

SEQ ID NO: 93761 - DNA, 1223 bp, Zea mays
  misc_feature: Ceres CLONE 1583223
aaagaagggttcaaccccagaacatactgtgaggggaagcccacgcccccaacccaccctccccgcaaagaaaataaaactggaactccccgcggtggcggccgctctagaatagtggatcccccgggctgtatgaattcgtctcccctagaaaaatcaggcccacgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaaaatttacaacctgcgccccctgacacacggtggcgcgcctcacgaaaccagggggggccacaagcaaactttcagggtttggaaaattgaatgtgactcgggggagggtatggggtgggtatttttttccccccccccgccaccgggtggggggggcccccggggggggggacccccccccgtggccacaaaaaaaaaaccagagggggcacgtgtgggggaggggatgggacactggggggcggagcagggggggattccttccaggctccggccaagaatgagccgccctgtgtaggattgcgcccccatggtgtgccccctggtggaaagaggggatgttcgtgaggccccgtgcctaacggcggaagatggaggtccactacttcctaacgaagatttgtccgcccgcggactaacggttggggtacgaaggtaacaggaggaggcagcgtgcaatggcggggatccctccaccatctcacgtatatccaacgaggaaatgaggcagggagacatgtcgaaagatagaacttcagtagatctggatacccttttgtgtccggcgaagtagtgggtgtgtgcggtgcagggaatacagatgcggcgcgattcttggttagcggtgtcatcgccgggattagaggtgtgcacgcagtgaggcgtaggtgtaaaccgtggcggggagttatcggttctacacactcccaggttaccacgtatccaggctcgtgggcggggagtagccaaacctagacaatactcgagccaacgtgattcataccggcagcggaaagtggagatggagagcgccatctctgcgcgtgctatgtgtgggagaccgacgatgctctgatactgccacctgtagcttcgaccgcgaagctaacagatgg

SEQ ID NO: 93762 - DNA, 1333 bp, Zea mays
  misc_feature: Ceres CLONE 1583225
  misc_feature: Encodes the peptide sequence at SEQ ID NO. 93763
caccaacgagcgaaaaaaagaaaaaaaaagggcgaccacggggggcgaagaaaaaaaaaaaacacacaaaacccaaaagctggacctccccacggtggcggccgtatcagaacaagtggatcccccgggctgttccactacgtctcacccctagaaaaaggaccgggagccacgccacgcaggcacgcacgcggaggggagcgccggccgtccgcggcggattgggatctccctcgcccgcccgtccactcgagactcgacggcacccgccgcatttgagctgagctgaggaggcgtgggggacggcgcggggatgtggcgcctgcggatcgcggaggggggcggggacccccggctccgcatgaagaacgcccacgtcggccgccaggtctgggagttctacgcctccgccgaccccgaccccgccgtcgactgcgagcaccacacctatctccggcagaaggggccaccgcccccccaccgccgacgtcctcaggcgcatcccggttcgccaaaaaaaaaccccccttgagcgtgaacctggccagcgaatcaaggtcccggcgaacccctaaagcacccccacccgatggaacggccgtcggcggagcacctatgggaaaaaagggccaaaatcggcgcgtacttttgcatatgtccacccagggcaaacatggaatggaaaccacttgggcggcgggggggcgatttatcgagagccgaaccccttaggggagttgccccttaacgtcccgaagggccttggtgaaggtcgcggctaacgtcatggtcacacacaaggacgtccctaggcgaaaaaccacgctcgaagaaacaactcgcgcgtatacgattacgggaacgcaagtctcgatagagagattagtatcccctgagagcacggtggaatacgaacccgcgcgtctacggagtaagagagaatctacgagagccaggaggacctaatggcgcggaaatatcacgaaagagactttatcgggaggagcgcgctcggcgggacgacgctaagggcggctagccaattgtaggacggcgggtgtctcctagtgtcatacgcaccgtagaggatattcgtagacgctatagtgggctaagcagtgggaggacgagacgcgcgttagacgacatataatgtcgcacagtcagattcatgtaggccacacggatgggcgcacgctaccatcgcggctatgatagaatagggataaatttcatgtgaaaaggaaaaaacgcgccacaataactgagtagtctctgcagtcaccccggaggcactgttatacatacccgtgataatgtatatacgcgcgtg

SEQ ID NO: 93763 - protein, 72 aa, Zea mays
  misc_feature: Ceres CLONE 1583225
  misc_feature: SWISSPROT Homolog: EC 5.4.99.8 Cycloartenol synthase
MWRLRIAEGGGDPRLRMKNAHVGRQVWEFYASADPDPAVDCEHHTYLRQKGPPPPHRRRPQAHPGSPKKNPP

SEQ ID NO: 93764 - DNA, 1274 bp, Zea mays
  misc_feature: Ceres CLONE 1583227
  misc_feature: Encodes the peptide sequence at SEQ ID NO. 93765
  misc_feature (460)..(460): n is a, c, t, g, unknown, or other
  misc_feature (873)..(873): n is a, c, t, g, unknown, or other
atggggtggaaggctatcaaattgaatagaagacacaccacagccggagactacaattatgggtgaagcccagcgaccccctccccgcggtggcggccgctctaaaactgtggatcccccgggctgcaggaattcgtctcacccctagaaaaaactccatcccgcatcgcgcatcgcatccaccgccgagctttctttctttctttctttcttttttctgggagaagaggaagaagaggggaggcgcgacaaaaagggcgccgagccacgcatcgcccccgacgccggcatctctccctcgctctccttctcccgatctgatccgaagcgcggcgtcgacgacgacgacctaagggcacgatgcattcgaccaacctgctgctggaggagcccatccggatggcctccatcctggagccatccaagaccagcttcttcccggcgatgaccaacatcgtcngcgcggcccccccccaagtcgcgctccgtcgacaccatctcctcctgcctcaaaggtcggcattggccggttgcgcggttccgatttcctcgtgggggagaccgccgctctatccaccaaggagaaggcttccgagaaaccctcaaagcttctcccattcaaagtcccaccaaaaaaaagccttgttgcgccttagttaatgcctttggaacaccggcctttggtaacccggccacacttgtccagggttgggttccacacgacaggaggtttgaaaaacacctccccaattctttttcccctcccaaaggggaagaaaacacccggggcaccttgggtgtcgggtgggccttgcgtacggcgcggcgtcatatattctattggggtgttccctcaaagaaaaaaggagactntatcagtcacctgaacttgtttgtgtctgggctccccgaattcccaaacacttccgctaaatttggggaactctccgcccccagaggggggacttttcttagaacacccctctgtagttggccgagagcgcggagaatattttgcgcgggaggccgcgaaaaataccttgaggtatcaccccaggaggcaaagcgcggataactcttatctttgttgcgtctttttgggttctgcgcgaagagagtttgctctggacaggagctctagaagggacgaatatatatatgtggtggtgttagtctgcaccccgtttctacaagaaattacaggagttcgctctttagggcgctgttgaggtgccagttgatcttagacgatggggtcatgagtatgtgactcg

SEQ ID NO: 93765 - protein, 99 aa, Zea mays
  misc_feature: Ceres CLONE 1583227
  misc_feature (34)..(34): Xaa is any aa, unknown, or other
MHSTNLLLEEPIRMASILEPSKTSFFPAMTNIVXAAPPQVALRRHHLLLPQRSALAGCAVPISSWGRPPLYPPRRRLPRNPQSFSHSKSHQKKALLRLS

SEQ ID NO: 93766 - DNA, 804 bp, Zea mays
  misc_feature: Ceres CLONE 1583228
  misc_feature: Translation starting site: 247
  misc_feature: SWISSPROT Homolog: EC 3.2.1.4 Cellulase
  misc_feature (756)..(756): n is a, c, t, g, unknown, or other
ccgcggtggcggccgctctagaactagtggatcccccgggctgcaggaattcgtctcacccctagaaaaatcgcccacccgcccgcctgtccctccccaaggccgcagctcactcgtgtcgtgcacccgtcccctcccacccgccaagaactagcattgccgccgccggtgccagggggcggaggagaggccgcggcggcgagggagcggcaccaggcgcagggggtcaggagagccgccggcaggatgttcgggcgggacccctggggcgggcctctggagatctccaacgccgactcggcgacagatgacgaccggagccgggacctggaccgggcggcgctgatgcggcagctggacgagacgcagcagagctggctcctggccgggcccggcgaccaggcgggcaagaagaagaagaggtacgtcgacctgggctgcgtcgtcgtcgaacgcaagatcttcatgtggaccgtcggcaccatcctcggcctcggcgtcttcatcggcttcatcatgatgatcgtcaagctcgtcccgcacaagcgtccgccgccgccgcccgtccgacagtacacgcaggcgctgctacaggcgctcatgtttcttcaacgcgcagcgatcccgtccgctgccggagcacaacggcgtcagctggaggggcaattccctgcatgaggatgggctctccgaacgcaacgtccgccggaacttgggtcggaggctctacgatgtcgggggacgccctcagttcanctacccaagggccggtccctgaacatgctcaactggagggcaatcagt

SEQ ID NO: 93767 - DNA, 924 bp, Zea mays
  misc_feature: Ceres CLONE 1583230
  misc_feature: Encodes the peptide sequence at SEQ ID NO. 93768
acccgcggtggcggccgctctagaactagtggatcccccgggctgcaggaattcgtctcacccctagaaaaaagacgcatcaaaccgccctcctctgtccctccctctcccgtctgccccctcgcatccccaaattaagccccgcgcgcaaggcagcaaacgcgccgcgcaccggaaggccccggggagctgcacgaggtggccccattgcggcatggctgctacggccgccgccgctggcgtcgagttcccgctcattggcgttgccgtggccacgctcatcgtgacggtccttgtcgcggccgtgatgcgccgccgccgccgtccctggcaccaggcgcctctggtggaggggaaacccgcaccagaggcaggctgcgcggtcagccaccgcgggacggacgtcatcatcgtcggcgccggggtagctggatctgcgctggcatacacgctcggaaaggatggccgtcgggtgcatgtcatcgagagggatctgacagaacctgacagaattgtgggcgagctgttgcaacctgggggttacttgaaattaattgagctgggcctccaagattgtgtggaagaaattgatgcccaacgcgtgcttggttacgcattattcaaagatggaagggacacaaagcttgcttatcccctggagaagttccattctgatgttgctggtaggagctttcacaatgggaggtttatacagaggatgcgtcaaaaagctgcgtctttgcccaatgtccaattagagcaaggaactgttacctcacttccttaaaaaaatgggactgttaaaggtgttcaataccaaacccagttcagttgaagaaactaagggttaatgcgccctttgacaatggtagttgaagggctgccttttcaaatcaaccaacccgcccttttgcttctccaaag

SEQ ID NO: 93768 - protein, 190 aa, Zea mays
  misc_feature: Ceres CLONE 1583230
  misc_feature: SWISSPROT Homolog: EC 1.14.99.7 Squalene monooxygenase
MAATAAAAGVEFPLIGVAVATLIVTVLVAAVMRRRRRPWHQAPLVEGKPAPEAGCAVSHRGTDVIIVGAGVAGSALAYTLGKDGRRVHVIERDLTEPDRIVGELLQPGGYLKLIELGLQDCVEEIDAQRVLGYALFKDGRDTKLAYPLEKFHSDVAGRSFHNGRFIQRMRQKAASLPNVQLEQGTVTSLP

SEQ ID NO: 93769 - DNA, 883 bp, Zea mays
  misc_feature: Ceres CLONE 1583231
  misc_feature: Encodes the peptide sequence at SEQ ID NO. 93770
  misc_feature (674)..(674): n is a, c, t, g, unknown, or other
  misc_feature (695)..(695): n is a, c, t, g, unknown, or other
tggagctccccgcggtggcggccgctctagaactagtggatcccccgggctgcaggaattcgtctcacccctagaaaaagcccctcctgcccccgctcgccgcgagagctcccgtcccgacgaccttccctcctgtagcactctacagtctacaccaagcagcagcgtctcctgttgcatgttgcactgcacctatctacgacgtccgttcccagtgctttgctcatccaccttcatcaagccaagcgtgtgtcctctccagctgcgagctccgacccccggcaccatgtccgacagcagcgacttcgccgagctgctatgggagaacggccaggcggtggtgcacgcgcggacgaggaaacagccgccccagcagcccgccttcccgcccttcaccttcacctgcagcagcagagctcaacaaaggcagccggtgccggcgctgctcaagacgggaggaggtctctttgccgacttctcctcggccaccgccggcctagacgccccccgtcacaacggcgacctcgacgacaccgtgccgtggatccactaccccatccccatcgtcgacgaagccagtcccgccgcgcctgccctggcagatagcttcatcccagatttcttctcggagctgcatgcggcggcggcgacgacgagcctcggccctctgccanccacaccaccacaccaccagnagtccagcacaccggcgacgacaacgacaaccggaagcacccggttcccaatcccaccaccggcagaggaccagagccctcaaaggaaaccaccgcgcaccagtaccaggtccaggcggcaggcctggagcacaaccacagctgagcttccgcccgcagaagcctccccaggaaaccggcggcgggga

SEQ ID NO: 93770 - protein, 199 aa, Zea mays
  misc_feature: Ceres CLONE 1583231
  misc_feature (130)..(130): Xaa is any aa, unknown, or other
  misc_feature (137)..(137): Xaa is any aa, unknown, or other
MSDSSDFAELLWENGQAVVHARTRKQPPQQPAFPPFTFTCSSRAQQRQPVPALLKTGGGLFADFSSATAGLDAPRHNGDLDDTVPWIHYPIPIVDEASPAAPALADSFIPDFFSELHAAAATTSLGPLPXTPPHHQXSSTPATTTTTGSTRFPIPPPAEDQSPQRKPPRTSTRSRRQAWSTTTAELPPAEASPGNRRRG

SEQ ID NO: 93771 - DNA, 877 bp, Zea mays
  misc_feature: Ceres CLONE 1583236
  misc_feature: Encodes the peptide sequence at SEQ ID NO. 93772
  misc_feature (826)..(826): n is a, c, t, g, unknown, or other
acccgcggtggcggccgctctagaactagtggatcccccgggctgcaggaattcgtctcacccctagaaaaatccccctcctccactcgcctgtgtgtgtctgtctgtccatccatccatcccgctgccagtcctcgcgccgcccaccccgaaataaccggaaattgcaacccggtccacgggtcggatcccccaaaccgaaccctcccgagctcgcccggcgatggggatctcgagcatgccggagccgcgggacagcctgctggggtacctggtgtacaacgcggtggtgtcgatcgcggcgctggcggggctggtgcgggcggcgctggtgttcctggacctgcaggccgcgcagctgcccgggggcgcgggcgcgggtgcggacgacgacggcggggaccgtctcgcggcgtcgggcccgggcctgggcctggcggagcggttcctgagggccttccggccggcgctgtacggggtgctggtgcccacgtgcccctccccgccgacgagacgccggtgctccgctacccggagctcgagtgatccgggcctcggcggccgtcgcgcgcctcggctgtgtgctgcaagctccgtgtggccttccgtgtgcgcgtagcaaaaggaaaaaaggagtataggagctgtagtagtagagttgctgttgctttccctttctcgttttgtggtttgcggttgccctgcccccatgctcttgttgtttccgcgctgtcgctgtagcgtgtaaatactccggttcgcccttggcagcagaaagtagtagagtgctcccgtggcctgggccgatggtgtagcaccttttacnagctcagctcgtgggtgtacatttgcatggctttcaattcagtttcccgag

SEQ ID NO: 93772 - protein, 131 aa, Zea mays
  misc_feature: Ceres CLONE 1583236
MGISSMPEPRDSLLGYLVYNAVVSIAALAGLVRAALVFLDLQAAQLPGGAGAGADDDGGDRLAASGPGLGLAERFLRAFRPALYGVLVPTCPSPPTRRRCSATRSSSDPGLGGRRAPRLCAASSVWPSVCA

SEQ ID NO: 93773 - DNA, 964 bp, Zea mays
  misc_feature: Ceres CLONE 1583237
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (63)..(63): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (87)..(87): n is a, c, t, g, unknown, or other
tgggttttgtggnnnnnnncncccccctcgcccacggccgaccgggggggggtacggtgggancccaggnnngggcgggggtccgtngtgtgtggggctcaccgtcggtggcggccgctctagaactagtggatcccccgggctgcaggaattcgtctcacccctagaaaaacctcctcatcaaatcccgtctcctcagtcctcccaataatggtggcgtggtgagaaatccttccgtccggccgtcgtcttagaagatgaactgttcctcttgctgcgccactgccactccatcttctccggcgcttctcgccaggccgcgggggggtttagctgctagctgctccacgacgacagcaaatcagaaggtgcttttcctgggctcaaaacagtttccacggatcacgtatagccgtgcgtcgtcacggttgtcgcggagagaggtaatagcttttgccgggcaacaaccttgggacatcggcagatttgtcaagacgctgttatttcttcaacgggcctccaaaccttctcaagattgtagaatctatcatcagcagtttcactggacctgcttctagtgaagcgccaaagaaaatggaaacatcagatgtggtgctggttactggagccaccggtggtgttgggcgacgggtggtggacgtcctgcagaagaagggagtacctgttcgagtattggctagaaatgtagacaaggcaaggagcatgtttggggcccggatgtacctctgatccataggagatgttacaaaaggaagatacaacttgaatcctaagctattcaaaggggataaaaaaaagtaagtcaaatgcagtcctcctgtccatagtgggggcccaaaaggaaaggtgaatacaccctgaccagggcggaaggtccccaaaccaaggccatcaaaatttttttccgaaccctgaagaatcaaggggaaccttttcaaccgga

SEQ ID NO: 93774 - DNA, 1333 bp, Zea mays
  misc_feature: Ceres CLONE 1583239
  misc_feature (37)..(37): n is a, c, t, g, unknown, or other
  misc_feature (87)..(87): n is a, c, t, g, unknown, or other
  misc_feature (980)..(980): n is a, c, t, g, unknown, or other
  misc_feature (1229)..(1229): n is a, c, t, g, unknown, or other
  misc_feature (1231)..(1231): n is a, c, t, g, unknown, or other
  misc_feature (1259)..(1259): n is a, c, t, g, unknown, or other
  misc_feature (1269)..(1269): n is a, c, t, g, unknown, or other
agatacgtgcagagtgcatttttttttttactccccncctccgaccaaaacccaaaacacaaacaccagatctggaattcacctcgngcgccgcactctagaatagtggatcccccgggctgcaggaattggtctcacccctagaaaaaaccttcacccaccgcccggcgcccgccatgtattcggccaaccactggggcggctcgttccagatcgccgatggggcggtcggatgatgaccacagccgcaacatggtacctgggaccgctggccgcgcatgtcggcgcgtgcagccccgatattagtttggactgagactgcagcacaagcatggcctgctacagccctgccgcgagtgcccacgaaagaaatgacaaaagtactgtgggaccttccagattgtgatcttacgttccaatcgcgaatcctcctacctgggtgaggccctttgggaggtggcagttgtaaaaccacctatttccaaactccattaccggctttcccaccattagttcaattggtcaaaaccccaaaccgtcgtccccaaaaaatactaagggaccctgacttgttcccccactaatcaattatcatcataaagggcgtatataccggcaagaaggggtcatctcctctcttcttcttttaatagcccccataaaaatattctctggcccaactctctttccccaaagaagaacaacgtagcgccttcctcataatcggggcccgcccgcggagaaattctcttgagggcctctggttcaaagaaaggaggctgttcctcacaacatacctcacaggcagaaagatcttccacggtaggtgtagagcgttctatccacacgacgcaggagggctagtatactcgacacaaagactaccctaaggacgttaaagaaagactcctcacaaacacggtttctactcacctttctcccgcgtcgtatatgtagcgctattatatacacctcccaanatcactcgccacagcgccaataaatagccaccagtaattcgattgtggacactacggtcattacgaattattccgtctctctatcatctacacaaaaatatgacacataatgtatgtgtgacaaatatttgagaaccactatccttaactgagagagagcgcctctgttaacatatgacaggggtaggtgctccaacttcattttcttgtttatgttttgtacgatctacatacctatataaaacgatnancttatcatttagtattcctctcacctgncttattcaanaaaatagtatagagcccacacgcctcgacagttatgtagttcatcgcgtcccctaacataaaac

SEQ ID NO: 93775 - DNA, 985 bp, Zea mays
  misc_feature: Ceres CLONE 1583242
tccccgcggtggcggccgctctagaactagtggatcccccgggctgcaggaattcgtctcacccctagaaaaagtatctcctctctggacgaacagatcctctctggacgaacagaaaggttaccagcagcaccacggcgagatctccccttggcgggccaaaaccgacggcgagcttcaccggcgttggtcggctccaatctcttcgccgttttattttcctcccaggttaaggttgcaggcttttagcttgggattctgaaagatggggacctcttctggcgcgaaatttcatcagcaacctcctccgacccaggggatgttgcctccaggcatggtccacgccccctcgggttgcagacctcgctctcgctgggctctttcgaaacagtttggctcgcctgacatgcagggagcctgggtcaaattcggaggccggggcatgattccgcccactgagaagcgccatttccaaaaacccatgggccagctttaacccaaaccaaaacaaatggtgggggggggcttcccatgtaaattttttgaataaaaggcggcgggaaaaaagggggggggaaaaagggggtgttcccaagccccgcggggtttatccaggggaccccccccccccccggggggaaggggggggagcctttttcgccgggagggttttccccgcgaaaaaaggggttttttttttgtgtccttaaaaaaaaaataaaaaaaatatattcgggaaaacgccccccccaggggggggccaaaaaaaaaagctctccgggggtctttattttgggggggcccgcggggggtgtttccccccccccagcagagagttttttttggtttttttaaaaaaatttttttcccaaagaggggggtgtatttttcccacccctcctctgtcttttgggggcgccccccacgggggggcgggagaaacttttttttgttcaaaagagaagggaaaaaaaacggcttcctt

SEQ ID NO: 93776 - DNA, 879 bp, Zea mays
  misc_feature: Ceres CLONE 1583250
  misc_feature: Encodes the peptide sequence at SEQ ID NO. 93777
  misc_feature (657)..(657): n is a, c, t, g, unknown, or other
  misc_feature (658)..(658): n is a, c, t, g, unknown, or other
ctccccgcggtggcggccgctctagaactagtggatcccccgggctgcaggaattcgtctcacccctagaaaaaaaaaatgagctgctgcccaagaacttcgacaccacttgcccaccctccctggattcttgcggctcttcctcgagctcatcgaatccttcatggagagcgccgagggaccgtccccgtactccggtgatcgagcggcaccggttcaggatggcaatggccaaactacacctgggcataattcgcgaaggccaaacctttctttgcaaataccagctaggaccttggataccaatataccttcatcgacaagagttactatatcctgcagccccagttcaacgagagtgggtttgccaccgagacctaattcgacgagaacaaaatcatctatcaagaacatgaatcctcagcacagtttcagagcaaggagttcagcccaggaaggtgatcgagtggtccttctaaatcctgggacgtcatctgaagggcagcaggataatccaagcacagcaagatcattttcttttagaaaggtcattaactcattatcggcaaaaaggacccattctcttccagtaacgcctgtaggaactactgacaaggctgcatctcctccaaatcaattagatacccctgccactanncactaatgaaggagttgaaagcaaaattaggcgctcactttcagtacctggaaatcgcaaaaacagaagtttgaggaggggcagatcattagggtgtcatccgtgtgattccaccacccccagacctgtcccagtcgaagcaccacattcagcgatataattgaggaacaatcgatgtcccctgagatggaggcgaagatattcttgaagaagagcagttt

SEQ ID NO: 93777 - protein, 166 aa, Zea mays
  misc_feature: Ceres CLONE 1583250
  misc_feature (165)..(165): Xaa is any aa, unknown, or other
MESAEGPSPYSGDRAAPVQDGNGQTTPGHNSRRPNLSLQIPARTLDTNIPSSTRVTISCSPSSTRVGLPPRPNSTRTKSSIKNMNPQHSFRARSSAQEGDRVVLLNPGTSSEGQQDNPSTARSFSFRKVINSLSAKRTHSLPVTPVGTTDKAASPPNQLDTPATXH

SEQ ID NO: 93778 - DNA, 842 bp, Zea mays
  misc_feature: Ceres CLONE 1583251
  misc_feature: Encodes the peptide sequence at SEQ ID NO. 93779
  misc_feature (443)..(443): n is a, c, t, g, unknown, or other
  misc_feature (447)..(447): n is a, c, t, g, unknown, or other
tccccgcggtggcggccgctctagaactagtggatcccccgggctgcaggaattcgtctcacccctagaaaaagactccttccgatcctctcgcctcgtctccgtcgtcagtcgcctagctagcttccctcacaagcagcaaggcgggagcgaacacgccggcgaccgttagctcgacgcctcgaccgacctccgcgccgtcgctccgcccttgcaaagccgcagccgcgcgcttttatgctcgcggcagctcggtttgtggtctctactagcggtatcctctcgccctcggacctttctgcgaaagcgaagattccggtatggaggtggaggcgacgcccacgacggccgtgtcatcttcccggcgtggccgcgcagctgccgccgcccggcccgcccgccaagaaaaagcgtgcccctccccggcatgccagatcctgacngcgnaggtgatcgcgctgtcgcccaagacgctgctggcgacgaaaccgttcgtgtgcgagatctgcaacaagggggtccagcgggaccagaactgcagctccacgggggggccacaacctggcgtgggaagctgccgcagcggaaccgcaaagaaggtccgggagccgggggttactttggccccgaagcccagttgggtggaaccaggaaacccgtcggggggggttcgggaacctatcccggggaataagaaaagcacttttgcccccaaaccccgggagaaaaaaaaagtgggaaagtgcaaaaaaggggctcccacaaaaaaaacccccgtgtgcgattcggggaatgggaagggcgcccctttttaagaaaccttgtggggtcctcccgcggaa

SEQ ID NO: 93779 - protein, 164 aa, Zea mays
  misc_feature: Ceres CLONE 1583251
  misc_feature (43)..(43): Xaa is any aa, unknown, or other
MEVEATPTTAVSSSRRGRAAAAARPARQEKACPSPACQILTAXVIALSPKTLLATKPFVCEICNKGVQRDQNCSSTGGPQPGVGSCRSGTAKKVREPGVTLAPKPSWVEPGNPSGGVREPIPGNKKSTFAPKPREKKKVGKCKKGAPTKKTPVCDSGNGKGAPF

SEQ ID NO: 93780 - DNA, 907 bp, Zea mays
  misc_feature: Ceres CLONE 1583253
  misc_feature: Encodes the peptide sequence at SEQ ID NO. 93781
tccccgcggtggcggccgctctagaactagtggatcccccgggctgcaggaattcgtctcacccctagaaaaaacctcttatccgttcgtcactccccaagcgtcacaccgaatcactacagtcgagctcgagcaggaacaatccttgagcgcctgcctccccggtcctcagtatctattccacacctcatggcgccggcgctgagcaggaccctgggcccgtcgtcggtggccgcgctgcgcccgagcccgtcgtgccggggtctgctacgggccgcgctcgtgccgcagggcaggggcgcctccgcgaggtgcgcggtaggggtgagatgggaggcagccaggcggaggaggatggccggggtgaggtgcgacgccgccgtctctcacaaacctgccggcgaggaggagacggccggcgagaagtacgagtaccaggctgaggttacccgcttgatggacttaattgtacacagtttatacagccacaaggaagtatttttacgtgagcttgtaagtaacgcgagtgatgcactggataagctgagattcctcagcgtaactgattcttctgtgttggctgatggtggtgagttggagataaggattaaacccgacctagaggcggggacaatcactatcacagatactggcattggaatgactaaagatgagctcaaagactgtctttggaaccattgcacaaagtgggcacctcaaaatttttgaaggctctaaaggagaacaaagactttgttgcagataattgaactcattgggtcaattccgggtcgggttctattccgcttttcttgttgcaaaaagggttgtggtgtctactaaagtccaagggcaaataacagtatgtgttggaagaaaagctgaccacaactctttggtatcaaga

SEQ ID NO: 93781 - protein, 179 aa, Zea mays
  misc_feature: Ceres CLONE 1583253
MAPALSRTLGPSSVAALRPSPSCRGLLRAALVPQGRGASARCAVGVRWEAARRRRMAGVRCDAAVSHKPAGEEETAGEKYEYQAEVTRLMDLIVHSLYSHKEVFLRELVSNASDALDKLRFLSVTDSSVLADGGELEIRIKPDLEAGTITITDTGIGMTKDELKDCLWNHCTKWAPQNF

SEQ ID NO: 93782 - DNA, 1041 bp, Zea mays
  misc_feature: Ceres CLONE 1583256
  misc_feature: Encodes the peptide sequence at SEQ ID NO. 93783
  misc_feature (94)..(94): n is a, c, t, g, unknown, or other
  misc_feature (116)..(116): n is a, c, t, g, unknown, or other
  misc_feature (152)..(152): n is a, c, t, g, unknown, or other
  misc_feature (163)..(163): n is a, c, t, g, unknown, or other
  misc_feature (166)..(166): n is a, c, t, g, unknown, or other
  misc_feature (171)..(171): n is a, c, t, g, unknown, or other
  misc_feature (224)..(224): n is a, c, t, g, unknown, or other
  misc_feature (225)..(225): n is a, c, t, g, unknown, or other
aagcgcgagtgaagggaagaacaccagttaaaaagaaaaggaccagctccggtcgcttgggggggtttggtacaaagctggagctcatcgcggngggcggccgctacagaggaganggatcccccgggcgttttcaaaggcggggcaccccnagaaaaaatcncgnaagcnccaacacaccatcaaattaatcgcgcggccggcgcccaccagctctcccccgnnggggccggcccacatacaaatgcttgggcattagcgatcctcctcctcgttctccatccccttctccctcctctgggtctgggtgcgccctcccctgctccacttctccggcgctgacatgacgtccacggcgtactcgcggtcgtccaagctgccgggcggcgagcggcggctgcccccgcgcctcaggcgggggttcgcgtccaagatcgagcccaaaaaaccgggcgtcggcctcatcgccggctgcagccacgcgctcctcacctacggctccctcgccaagcgcgtcgcaaacaacgcccctgtctacgcaagctcggccaaacacggccgcgctgaagcagcagaacgcgccgccgacctcgtccaagcccgaccgtgccgggaaacggaaaccaaccccgccgcaagaaaacgaaaaggcggggggccggccgaccagctcggaaacccggcccacaccggcgcggaagggccacgaacggggccatccgaaggaagcccgggcactaggcgggaagacgggcccctgagggagggaaggggacatgggggggggggggtcccgaacgaaggcccgggggtggcccacctagaaaggaccgacgggccaaggaagccagacgggggagccccgcaacagagggcatgctgaaggaggggaaggggcaaaagaccgcggggggacgggcaaggcgcgcattcgaaggaggggggaagaagcaaagaggggggagggagggggccccgagaagaaagcggaaaacagggagaggagaggagagcggaaaacgaagagggaagggcgaaaag

SEQ ID NO: 93783 - protein, 179 aa, Zea mays
  misc_feature: Ceres CLONE 1583256
MTSTAYSRSSKLPGGERRLPPRLRRGFASKIEPKKPGVGLIAGCSHALLTYGSLAKRVANNAPVYASSAKHGRAEAAERAADLVQARPCRETETNPAARKRKGGGPADQLGNPAHTGAEGPRTGPSEGSPGTRREDGPLREGRGHGGGGVPNEGPGVAHLERTDGPRKPDGGAPQQRAC

SEQ ID NO: 93784 - DNA, 1318 bp, Zea mays
  misc_feature: Ceres CLONE 1583259
  misc_feature: Encodes the peptide sequence at SEQ ID NO. 93785
  misc_feature (66)..(66): n is a, c, t, g, unknown, or other
  misc_feature (847)..(847): n is a, c, t, g, unknown, or other
  misc_feature (1014)..(1014): n is a, c, t, g, unknown, or other
  misc_feature (1048)..(1048): n is a, c, t, g, unknown, or other
  misc_feature (1318)..(1318): n is a, c, t, g, unknown, or other
aaaagcaagtaaaacacccgggtaaaagggagcccacccccccccccccccccccaaaaatccccnttacccaaaacccaaaactcaccacggtggcggccgctctagaatagtggatcccccgggctgcaggaattcgtctcacccctagaaaaaatggttggataccctcccatgggacccaagagggagctcaagtttgccttggagtcttgctggtatgcgaagatcagcgcccaggattatcagaaagttgccactgaccatgaggtccagtctctcggaaacacatgtcagatcttggtatcaagtacattcccaggaagacattcttttcctacaaccaggctcatgatacaaaaggacacgcttggcgatgtccgagagcgctatgtactcgaatggacgagacatcggcctgaatacctacttctctatggctagcgtcaaatgccactggccctgtgatgggtgtcccaaccccaatgatacaatcgacgaccaaattctccccgaacttggcctcatcacccagtgcacttgacgctttctcacaaaggagccttcacgagtactagggatgatcaaggcagctccgcaacttgatccaggtcctatctgtatagaattggacccaggtctatctaactttgccatcccttctcaaaaagccctgactagaggagctgtctgacaagaaaattcattttccttcggcgattctatttttaaaacatttcgtttgagatatgccatatgtcgttaacccaaaatctatcacctacattgtgatagaggtcttgtatttggtccgtggaaaaacccattgaatatcagttgtcagagnccatgggcggctcggtccttgttcgccgatacgagggaagattttccacacacactctatgtatactatagaccgactcctttagcccccccatatatgggcaattgtaaaaagaaaaacaccgcccttggaaatgtgtccgttgcttatcgccatattttttgggncccccccgcccattttcatctaactagtcacagnccaagatatatacacgttttgaaaagcgctgtggggaaggtccaccttacggagttatcctccatgcagtaagtactccacaacgggcttgcccacgctcgctttcatacacacacggatcttgagcgctattataaaaagattgccgcttaggcgattaagagcaccatgaacataggacatctcctattacacattcgttattataaagcgcgagtgtgggtcaacagatctcttatgagcgctttaccagatatttgtgaatgctgn

SEQ ID NO: 93785 - protein, 95 aa, Zea mays
  misc_feature: Ceres CLONE 1583259
  misc_feature: SWISSPROT Homolog: EC 2.1.1.14 5-methyltetrahydropteroyltriglutamate--homocysteine S-methyltransferase
MVGYPPMGPKRELKFALESCWYAKISAQDYQKVATDHEVQSLGNTCQILVSSTFPGRHSFPTTRLMIQKDTLGDVRERYVLEWTRHRPEYLLLYG

SEQ ID NO: 93786 - DNA, 1261 bp, Zea mays
  misc_feature: Ceres CLONE 1583260
  misc_feature: Encodes the peptide sequence at SEQ ID NO. 93787
  misc_feature (440)..(440): n is a, c, t, g, unknown, or other
aaactataagaaagaaagaaaggaaggtcccccccaccccccccccccccccccacaaaccccccaaaacaaaaccacaactcaccgcggtggcggccgctctacactagtggatcccccgggctgcatgaattcgtctcacccctagaaaagcccggctgtcctcctcgatttcacaagctcctggttacggcggcatctatcgttccgccgcaagggccgcatcgtctctctcgcgacgctgccccagaccgccgagataatggctggccaccgaaacagtcatggaaagcgccagtctgattttactgaaaatggaggcagtaatacaagaaatcctggcgatgatacatatgcacctggtcctgatgacactgtgtatcgctacctctgtgcctctagaaaaattgggagtatcattggcaggggtggagaagaanaaagcaattgaggaccgatactcttggcgaaccaaccccggaaagagtgtccctggatgtgatgagccagttgttacccatatcccgcacgaggcaggaaagactaatacctttcccggccgcctccaaaaagaatgtttgccccttgctcacggatgcccctcttttagatgttcattgagagggccttcgccacctgaattaaggggtctttgggggaaacggaagaagcagttaaaagaaaaattttcacccgttccaagcttaacctggtttcggccttgggcctttggttgtgtcagtttcaacacacgcgatatatttgcagcaaccgcccattttatttttcgtgatacaacaaatggtatggggggacactgaaaaatttcagtagcccccaagagagggagataatcccccgcccctagtctttatgcgcaatctatgggtttcggccccccacataatcgacccgctttgataccttctttcaggagttcaaatgtgaattctatatcataactcccccccgcacaattgttctacccgcgctattaatgtgtggtgagagcgcgacagatctgttctttcctcacaaaaatatattctggggggcgaaacaacaccgttaaggtatttctcccctgacaaaatagagatcgcctctcataatcaaagtgttggtcaatcttatggtgtctctccgaagtgagaacaaattcagtatccgaaatgtcttacatgcattattttctagttttgctatacctcgattatagaatcccgcaatcctataattcagtaggagcggcactccctgc

SEQ ID NO: 93787 - protein, 62 aa, Zea mays
  misc_feature: Ceres CLONE 1583260
  misc_feature (60)..(60): Xaa is any aa, unknown, or other
MAGHRNSHGKRQSDFTENGGSNTRNPGDDTYAPGPDDTVYRYLCASRKIGSIIGRGGEEXSN

SEQ ID NO: 93788 - DNA, 841 bp, Zea mays
  misc_feature: Ceres CLONE 1583261
  misc_feature: Encodes the peptide sequence at SEQ ID NO. 93789
  misc_feature (654)..(654): n is a, c, t, g, unknown, or other
  misc_feature (742)..(742): n is a, c, t, g, unknown, or other
ctccccgcggtggcggccgctctagaactagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaagaacgacggagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacggcccggaactgatgctgctccgcctcggcgccgtgccgaccgtggtggtctcgtcgccgcgcgtcgccgaggccgtgctccgcacctacgaacacgtnttcttctcccgcccgcgctccctggtgtccgacatcatcatgtacggcgccaaccgactcgtgcttcgcgccctacggcgaacacttncgcaaaggggcggaagctggtaacctggcacctgctcaacgcagccaagtgcgggtccaacggccccccggaaaaaagaaaaaggggcccgcggccccc

SEQ ID NO: 93789 - protein, 168 aa, Zea mays
  misc_feature: Ceres CLONE 1583261
  misc_feature: SWISSPROT Homolog: EC 1.14.13.68 4-hydroxyphenylacetaldehyde oxime monooxygenase
  misc_feature (162)..(162): Xaa is any aa, unknown, or other
MAAQLHHALYELLHEAAAAQRALLLAIPFSLLLLPLLLRYLAASASASATKNDGAAPASDPDKLLSLLPSPPMKLPIIGHLHLMGDIPYVSLAALATRYGPELMLLRLGAVPTVVVSSPRVAEAVLRTYEHVFFSRPRSLVSDIIMYGANRLVLRALRRTLXQRGGSW

SEQ ID NO: 93790 - DNA, 1276 bp, Zea mays
  misc_feature: Ceres CLONE 1583262
  misc_feature: Encodes the peptide sequence at SEQ ID NO. 93791
attattatttgaaggtagggaaatagtaatgatttttactctcgctacataagacgaaccacaaccataactttaatgtggaactccccgtggtggcggccgctctagaatagtggatcccccgggctgcaggaattcgtctcacccctagaaaaactctctctctctcctctacctccttttcctctaacctttagctttcctccctccctctcctctctcccccctcctctaacaagaactactcccagccattcagatcctaagttgctgaccttgctgctgcttgttggagatagatttgttggttctaagttccaagtaccatgagtccaccgagtgtgatggggcagtttggggacacaacctacaccaaggtttttgttgggggactcgcgtgggaaacccagaaggagacgatgaggaagtacttccagcagattggggagatcctggaggctgttgtcatcacccacaaaaacactggcagatccaaggggctacgcgatttgttaccttttccggcatccggaactcgggcgatgaagagccttgccgttgaattcccgcccaccggtggatttgaatggggagggaaggggctaaactgggaaatccttggctttcccctcgggggggtttcataaaggaattttaagggtccttccctagcctctccccgctcatggggaggggaagcctagggaaaacctttctataaaggaaatatgaaaaaatttcctgttctcgaccccacggcattgggcacaaggcaaaattctcacatagtgggggaggaaataaatctggaaaggcgccacagcctttgtttattacacctgttgtcctgcacagtgtggagcgacgaatcgctgttgtctccctctctgccattttttatgggggcgcctcaatcacaccacatacaaaagggggagctctttcttaccccatttttctccaatatgggtttccttagtaggggggaatatcctttgtctgccagagaaaaataaccactccccccaatagacctgagttgggggtgttatatactgcgcgaagaagaatcttagataccgccgaaaaatcataatcgcggggggaaggagactcaccagataatctcccccgtctatctcgattgggaagagcaagataccacgagatcgttcgaatgagtggggtagagacggggaatctaagggtcgccccgtctgttattacacaaagttttgcgacatatttagaggggtaatcacggcgagaacacatt

SEQ ID NO: 93791 - protein, 106 aa, Zea mays
  misc_feature: Ceres CLONE 1583262
MSPPSVMGQFGDTTYTKVFVGGLAWETQKETMRKYFQQIGEILEAVVITHKNTGRSKGLRDLLPFPASGTRAMKSLAVEFPPTGGFEWGGKGLNWEILGFPLGGVS

SEQ ID NO: 93792 - DNA, 1025 bp, Zea mays
  misc_feature: Ceres CLONE 1583264
  misc_feature: Encodes the peptide sequence at SEQ ID NO. 93793
  misc_feature (14)..(14): n is a, c, t, g, unknown, or other
  misc_feature (72)..(72): n is a, c, t, g, unknown, or other
  misc_feature (469)..(469): n is a, c, t, g, unknown, or other
tataataacaacancccggggtggtggggtgagaatcctgcgccccaacaaaaaaaaataaaaaaaacaaanaaaaaagggactccccgcggtggcggccgctctagaactagtggatcccccgggctgcaggaattcgtctcacccctagaaaaagttcgccttcctcgcccccatctctttctcgccgtgccactcccacctcttttcgctgataagcacgccgctactccccactccatccatccacccgccgcttttctctcttctttggagaagagccgcacgcagtggttgctgccgctggtccgccagggtcccgggcgctgtgctcattccaccggtcggcggtgcactttcaggcttcttcgacggcgtcgagagtggaggaaatgtcgaccacggagtgcgcggacctcggggaggagttctggctgccggaggactttttggacgacgacttcttctnccaccaccacaaggcggccgtggcggcccccacctagagcgaccaggaggacagcctggcgggtctctcgcgccgcctcgcgggcctcctcggcgacggggggagagcgcaaggcctcccgcggcccaagcggaagtgacggttggggtcgccgcaatccgacgcctggtgcgggctgccccaaggtgggggcagggagagcccccagcggccggggcggtcaaaggggcaccttcgcccgccggttgttttacccctgggaagaaaaagggcccccattaccccttggggaactggctcctaacaaaggcgggccgggaaaaagtttgcttccgcaatgcgcccccccccaaaaaaccctgcccgggtcagaggcccccacaaccttttttccaccggtccaaaaggaggtgttttcgccctcccgccccagataagccccccccccgcacattccaaaattgaaccctccccccttccgcccaaaaatcccctgggcggggggggaaaatataataaacaccctcttcgccccctttgttcccaaccccaaaaa

SEQ ID NO: 93793 - protein, 37 aa, Zea mays
  misc_feature: Ceres CLONE 1583264
  misc_feature (26)..(26): Xaa is any aa, unknown, or other
MSTTECADLGEEFWLPEDFLDDDFFXHHHKAAVAAPT

SEQ ID NO: 93794 - DNA, 853 bp, Zea mays
  misc_feature: Ceres CLONE 1583268
  misc_feature: Encodes the peptide sequence at SEQ ID NO. 93795
  misc_feature (758)..(758): n is a, c, t, g, unknown, or other
  misc_feature (790)..(790): n is a, c, t, g, unknown, or other
  misc_feature (853)..(853): n is a, c, t, g, unknown, or other
gcggtggcggccgttctagaactagtggatcccccgggctgtaggaattcgtctcacccctagaaaaagttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccaagaacctgcccgatgagttcgaggccgtaccggcgacgccgccgccgccgctgccggacgccgccccgaagctggggatttctaacaagttcatccgaggcctctgcggtgacccgcagaccgagcagctggccttcgagggctacaggagggcgctgctgcagcccgagttccggctggagaagaagacggccaacgcgctgaccctgcagctgatcagggagaagcagtggggctccctggagctgctggtcgaggacttcagggcccacggcgtgctcccggagaagcggacgtgcgcgcggctcgtcgcctgctgcatcagggcgggggaggttcggcctcgccgacgcggtgctcggggtcgtcgaggcgaagaagggagccccccgctgcatggccttcagcgcggccatgcaggcgtacaacaagctgcacatgtacccggagaacggtgcttctgtacggggcaggcgaaggttgcccgnctgccgctgaacgccgacccctatcgtggccncaatggccgcttgcggcgccctgggcgagcccggacatggtggcttcgctggtccagctgtan

SEQ ID NO: 93795 - protein, 246 aa, Zea mays
  misc_feature: Ceres CLONE 1583268
  misc_feature (226)..(226): Xaa is any aa, unknown, or other
MAKCYSDWPPIPPFHPSRRTPPQSHASPITIRRQLASFVLHCSRSCAPLLEPKNLPDEFEAVPATPPPPLPDAAPKLGISNKFIRGLCGDPQTEQLAFEGYRRALLQPEFRLEKKTANALTLQLIREKQWGSLELLVEDFRAHGVLPEKRTCARLVACCIRAGEVRPRRRGARGRRGEEGSPPLHGLQRGHAGVQQAAHVPGERCFCTGQAKVARLPLNADPYRGXNGRLRRPGRARTWWLRWSSC

SEQ ID NO: 93796 - DNA, 953 bp, Zea mays
  misc_feature: Ceres CLONE 1583269
  misc_feature (402)..(402): n is a, c, t, g, unknown, or other
  misc_feature (505)..(505): n is a, c, t, g, unknown, or other
ctggagctccccgcggtggcggccgctctagaactagtggatcccccgggctgcaggaattcgtctcacccctagaaaaaacactttttctccgccccccaaaccacatcgattattgcgttgagcgcttagactcttgttgtctttgtttttgtggtcggcgagcatggaggaggcggaggcggctcacgggctctgattggcggatggcgcgtcggatcggagcagtcgagcttcggggatttcctgtccctctggaagggatgaaatgcggcgactacctggtgaactgggtggagctctagtgtcagccagtgttcctgctgacgcctgcctcatctagcccccccctttcgtcagtttctgtggcgagttgttaatcaccgtgtccgggatccgttnggcctggggtttttgaggagatggacgacgaggactactcgtggggtgcgcggcacaggtttctgccattcaatcgtccgattcaatttctggcagggagcantatgggccgtttcatcaaagcatttaaccggtgcccccaaactaaggcaaaatggggtggggccccgggaacaggaaacccttccccaaattttaccgccctttggggaaagggattccggggttccccaactttggagggggtgcctttccccggggggaaaatccccagttttttccctcggaaaaagaactttaaaaaccttcttttttaagggggcttttaaaaaaaaggggggtctccccccttgtaaaaaatttcttgaaaaaaaaacccgggagaggggcgccccccccatatttgaaatttccccccctcgtgggtggtcccccccacagggggggcccccccccccgtttttttttttttcccccataaaacccacggggggggaaaaagagggtgttcccccccccctctttttttcagagagggggggcggggcggc

SEQ ID NO: 93797 - DNA, 872 bp, Zea mays
  misc_feature: Ceres CLONE 1583272
  misc_feature: SWISSPROT Homolog: EC 2.7.11.1 Non-specific serine/threonine protein kinase
  misc_feature (507)..(507): n is a, c, t, g, unknown, or other
  misc_feature (688)..(688): n is a, c, t, g, unknown, or other
  misc_feature (728)..(728): n is a, c, t, g, unknown, or other
  misc_feature (854)..(854): n is a, c, t, g, unknown, or other
ctccccgcggtggcggccgctctagaactagtggatcccccgggctgcaggaattcgtctcacccctagaaaaatcgccacccaaaagacaccgcgatcccgtgcttccttctcgcacctgcggatctactctccgcacctgcggatctaccccccggcgaaacaagcgccccgacgcctcagggaatgcggagcgatgaggcggcgctcaggcactgacgtcgccggtcagcgcgagctgcgcggcgaccgaacctgccatcgcaagcacgtcgaggacgggtagactcgtccatccttccttcctcttgttagtggtcgtagggtagtttgcactttgcagatagctagctagctagtagttaggggatcaggcatgggtgagggcgaggcggaggtgaagggcggggtgctgcagggccgctacgagctcggccgcgtgctgggtcacggcaacttcgggcgcgtccacgcggcgcgggacctgcgcaccgggcgggccgtggncggtgaaggtgctcgacaaggacaagatgctgcgcacgggcatgatggagcagatcaagcgcgagatcgccgtcatgaagcgcgtgtcccaccccaacatcgtggagctccacgaggttatggccacgcgctccaagatctacctcgcgctggagctcgtccgcggaggggagctctttcncgcggatcgtgcgcgccgggcgcgtcaaggaggacgtggncgcgcgctacttccggcagctcatccacgccgtggactttctgcacgcgcggggcgtgtaccacgcgacctgaagctcgagaactcctcctgacgacgcggggaacctcaggtcgtcgactttggnctcgcgcgctggcgacac

SEQ ID NO: 93798 - DNA, 1130 bp, Zea mays
  misc_feature: Ceres CLONE 1583273
  misc_feature: Encodes the peptide sequence at SEQ ID NO. 93799
  misc_feature (55)..(55): n is a, c, t, g, unknown, or other
  misc_feature (73)..(73): n is a, c, t, g, unknown, or other
atcactgagtaaacaacctactatttttaagcataatatcttaaaacaacaaagngaagacccccccaataanatataaaactcacgcggtggcggccgctctcacaatgcgacagcagatgtcttcgttccccggacaggctggggacggtagcatcgacgtggaggtgtgcctcgcgtcagacaccatggcgcatctcctcctcgacaaggagttcttgcaatacgtgtcctcccctgcaccgtgaggcggtgacagagtgaatgtgtggctagttgctgcgccactacatataataactggattttgtcccgtttcgcagatatcaagtgcttgccaactttaatgaatttgagtgaacaagaagatggaaaaaaggccgccctgctgatatccttccggatgccgttgtgaagtaattttaataaaaaacccccccccaccacgcggtgtaaaaaatgggtattttttccccccccccgggcaaaagagtttttagggctcctgtgcgcgtaaaaaacccccacctcagggttatttttcgaaaaaatctctgccttggtcccccaaagaggggattaaacctcccccattagaggggaaagcccataaccccccccctctcacaatacagacataaaaaacagaagagaccctccgaaggcgccccccatatattccccccctaatatctggaggggcccgaaatattatacggtgagacctctaacggggggggcgatacgtttctccctccaaaaaattccttgttgtgaatattgttgccaataacacacctttgttcgcttaccccccccaccattcataaatcgaaccattgaagataatactcctttcgccgcaccttgttatcccaagggcaggggggcgtgataatacttccacaaaaaagagccccccacccacagcaaatgggccctcctatcttccaaaaaatatgggacacctgcggccctttgtgacgggcccaacaagcgcaaaaaaacctgcataaccgcccggaaaatatttttgtcagaaaaaaaaacacgcccgagcgaaacttttgtccagacacaccacaatccccagcttattttcacacaccatacagtcccttgtataagag

SEQ ID NO: 93799 - protein, 46 aa, Zea mays
  misc_feature: Ceres CLONE 1583273
MRQQMSSFPGQAGDGSIDVEVCLASDTMAHLLLDKEFLQYVSSPAP

SEQ ID NO: 93800 - DNA, 943 bp, Zea mays
  misc_feature: Ceres CLONE 1583276
  misc_feature: Encodes the peptide sequence at SEQ ID NO. 93801
  misc_feature (326)..(326): n is a, c, t, g, unknown, or other
ccgctctagaactagtggatcccccgggctgcaggaattcgtctcacccctagaaaaaagtttggcacctccgaagcttccgtccgaatctctgctgcctccttcctcggccaggcttgcgggcgatggcggcggagcagaccgccgagcagttccggggccaggcgcggctgccccacttcgcgtccccgcggcgctacgacctgcgcctcacgcccgacctccccgcctgcgtcttcactggctcggtggcggtttccatcggcgtggccgcgcccacccgcttcctcgtactcaacgcagccgagctcgacgtcgcgaccggnggcgtcagcttcgcgcctcagggctccgaccaggtgctacaaccttcccccagttaccaacgtgccagaagatgagatcctgattattcgcttcaatgaggtgctttctatcggggagggaactttgacgattgctttcaaggggactttgaaatgataagatgcattggattctacagaaagtgtggtataaactttaatggaaagaaaaaaaaacttgggtggtaacacagttttggaacccccttattccaggggcctgctttcccttggtggggatgaacctggtttttcagggctggttttcaaaatttcccctttaagtttcctttttgagaacaattgtctctttctaaattttccccttaatttgaaagaaaagggccatgggcccctcccccaaaagtgctcctttcccagaaaatcgggaaaaagggctacaaatctctagggggggttattttgggggcattttttccctgtgggggaaaatttcccccccaagtgggttctgggcccgtgtttttcacccactcttataaaaaatgccccgggggggtgttttctcaaagggtggccttaaaaaaaattgtcttctttaagaagattatttttgc

SEQ ID NO: 93801 - protein, 91 aa, Zea mays
  misc_feature: Ceres CLONE 1583276
  misc_feature: SWISSPROT Homolog: EC 3.4.11.7 Glutamyl aminopeptidase
MAAEQTAEQFRGQARLPHFASPRRYDLRLTPDLPACVFTGSVAVSIGVAAPTRFLVLNAAELDVATGGVSFAPQGSDQVLQPSPSYQRARR

SEQ ID NO: 93802 - DNA, 800 bp, Zea mays
  misc_feature: Ceres CLONE 1583277
  misc_feature: Encodes the peptide sequence at SEQ ID NO. 93803
  misc_feature (304)..(304): n is a, c, t, g, unknown, or other
ctccccgcggtggcggccgctctagaactagtggatcccccgggctgcaggaattcgtctcacccctagaaaaaagtttggcacctccgaagcttccgtccgaatctctgctgcctccttcctcggccaggcttgcgggcgatggcggcggagcagaccgccgagcagttccggggccaggcgcggctgccccacttcgcgtccccgcggcgctacgacctgcgcctcacgcccgacctccccgcctgcgatcttcactggctcggtggcggttttccatcggtcgtgggccgcgcccaccccngcttccctcgtacttcaacgcaggccgaagttccgacgttccccgaaccgggggggcggttcggcttttcccccccttcaagggggttccccaccccgggggggcccaccaacccctttttggggggggattaaccacccctccgcgccaaaaaaaaaaaaaaaaccccgggaatttttccccccccaagggggggggttttttctggggggggggggaattttcggaggggtttttcccgggggggttttttataaaaaaaaaaaccgtgttttttttcccaaaaaggggggggtttctcttttttggggggaaaaaaaaaaaaaattttttgttgctcccccccctttttttaccaccccctggggagggggggcggggggcgcctccttctccttgtcggggggaggaaggggccccccccccccaaaggggggggggtttttattataaaaaaaaccaaccccaaggggggtctcctttcctgatagaaaag

SEQ ID NO: 93803 - protein, 98 aa, Zea mays
  misc_feature: Ceres CLONE 1583277
  misc_feature (55)..(55): Xaa is any aa, unknown, or other
MAAEQTAEQFRGQARLPHFASPRRYDLRLTPDLPACDLHWLGGGFPSVVGRAHPXFPRTSTQAEVPTFPEPGGRFGFSPPSRGFPTPGGPTNPFLGGD

SEQ ID NO: 93804 - DNA, 1159 bp, Zea mays
  misc_feature: Ceres CLONE 1583281
  misc_feature: Encodes the peptide sequence at SEQ ID NO. 93805
  misc_feature (63)..(63): n is a, c, t, g, unknown, or other
  misc_feature (66)..(66): n is a, c, t, g, unknown, or other
  misc_feature (1043)..(1043): n is a, c, t, g, unknown, or other
caagggcggggagctagtttggggagtccgtgggcacccccctcccccccccccacgactccnccnccccaaactggagctcaccgcggtggcggccgctctagaactagtggatcccccgggctgcaggaattcgtctcacccctagaaaaaaacctcgcgggcgacccggcgctgaccgaggtactgaaccgggaggccaggtcccggcccctgccgctgggctgcgccgacgtcgcgcccagggcgatgcccttgttccagcggatcatgaagggagcacggcaagacgtctatcacctggttcgggccggcgccgagggtgaccatcactaagcctgagctggtgcgcgaggtgctgtcccacaagggaggccgttacgagaagctcaagttgcgcaagctctagaggatgctgcgcaactgcctgggcagccacgagggcgacaagtgggataagcatcggcgcgcccaccaaccccgcgttccgccacgagaaactcccgcggatgttgcccgccttcgccgcttgctgcacgggacctggtggacaggtgcgaaggccgggccgcggatgggcagaaaccccccgtgcgaggggggacgtgtgtgtcttgagatgcagaatcccgcacggggggacgttcatcctcttgcgcgggcgaatccgtcttgcaacctatctttcgaaagggctggtaaggaacctgtatcgggcgtcccgggtggggaagccagggttcctgagcctccggtccagtgccacggcccgaatggccacaaagccgttgtcgactttttgcgccgaggcatgaccactgtggagacatgggcctccaatggaaaagagccgatatcctagaaaggcaatggaaaggtgcggtaatcccctcccccgtggaaacaatcccgggggaaggcgtcccgccaaagggggtaattccatgtccttccatcgttgggggacaagggccctcccttaagcgacacctagatttgccgcggagatgttctagagcggatgcaaacgcctgtctgtgggncctaggttcccagcgggaatctcccgcccaagggagccatctgtgcacggatctggtgccggcacggtaatattctgaaaggcccttgatggcattctccaagcgaggggagatcc

SEQ ID NO: 93805 - protein, 111 aa, Zea mays
  misc_feature: Ceres CLONE 1583281
QGRGASLGSPWAPPSPPPTTPPPQTGAHRGGGRSRTSGSPGLQEFVSPLEKNLAGDPALTEVLNREARSRPLPLGCADVAPRAMPLFQRIMKGARQDVYHLVRAGAEGDHH

SEQ ID NO: 93806 - DNA, 1333 bp, Zea mays
  misc_feature: Ceres CLONE 1583283
  misc_feature: Encodes the peptide sequence at SEQ ID NO. 93807
  misc_feature (64)..(64): n is a, c, t, g, unknown, or other
ataaagttttggaaaaaaagaaagaagtaatttaaagagacgtccgcactaaaaaaaaaacctnccccctccataacttacactccccgcggtggcggccgctctataatagtggatcccccgggctgcaggaattcgtctcacccctagaaaaaatggattagcttcaatccccctgaaccgggccctgaccgttcgcctcctcggatgcttgttttttctcccccttcccacctccgcgagatctgacagctcggcctccaatggcgcccttctccctgtaaacctagctgctctacctacccgcacccccaccccgtggagagcaagtgcacccatggcggcggatcgggagaaggatcgcgaggcggagctggagggcgccatgtacactaactgcctactcctcggcctcgatcccgcggtccttgggtctccctcatcccccgccggctgcgtgggacaaacccccacctcttacccccgtcttggcgagcaactcctctacattctttctctcctcgctccgcggtctcggcgcagtcacgcgaaggaattttcaacaaggttccgggcccaattctttttccttctttttagttctcagggaggtttcacggaaagaatctttgctaaggggaatcatattatccgaagcctgggaaacccgccattgggcgggcaacatgtcctctcgccgaaattaatttttcacaagcgggactcggttttcacctttgtgcccaccaacaggtaactagtgcgggatacccggataaaaatttattgcggtagaaaggctcattattatagagaggcgggcgaataacgttatatatctttgtgtataatacacagtgccacacactcctcaacactaagatataatggtcttcatccccttcactgtaagtaaaactacatgtttgtactctatgcccttttaaatgtatgtgtcggtgtttttctgcagtattcttgtatatctagactcttgtgcgacatgtatacctgatgaaccagtaaaagtgctattttctctttgaacttatttacatgagggcgttgcgccgcttttgttattatacctcttgcagaacgtaaatgcctccagagtgggcctaaagaaataatgagtctctctcttggtaaaacgagagtatgtaaccacatgtctttattttagtaagagtgtttggataatattattctcacatttgtattatatataggcgacagatagcacactttgttctacaaatatatcgcggccccttaatcaagtattaaatcaaacttaacattttcacgctgaaatcccaatagattgcgg

SEQ ID NO: 93807 - protein, 139 aa, Zea mays
  misc_feature: Ceres CLONE 1583283
MAADREKDREAELEGAMYTNCLLLGLDPAVLGSPSSPAGCVGQTPTSYPRLGEQLLYILSLLAPRSRRSHAKEFSTRFRAQFFFLLFSSQGGFTERIFAKGNHIIRSLGNPPLGGQHVLSPKLIFHKRDSVFTFVPTNR

SEQ ID NO: 93808 - DNA, 982 bp, Zea mays
  misc_feature: Ceres CLONE 1583284
  misc_feature: Encodes the peptide sequence at SEQ ID NO. 93809
  misc_feature (62)..(62): n is a, c, t, g, unknown, or other
  misc_feature (72)..(72): n is a, c, t, g, unknown, or other
tgggggctggggggggaggcacgtgtgggagctcctacccacactcaccaacccggggccanacccaaaacnctcaaaactgggactccccgcggtggcggccgctctagaactagtggatcccccgggctgcaggaattcgtctcacccctagaaaaaagggtttcacagccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggagcaccgggatcgggataaggatgacgggaaggagaaggagaggagccgcgatagccgcgggaaggacagagacagggaagggagagaacgggagaaggacaccccggacaggcaccggcccagagagagggaggtggaacgggagcggaggagcctgagccgttcggagcggcgccgtatcgaggaagaggagatggtgagggagctggagatggagcgcgagcgcagcgagcgacaccactatcgcgaccgtgacgtcaggcgtaggaaagatgacggggcagagccagaagttgatccagaaagggaccagaggactgtatttgctttccagctatctctgaaggcagacgaaaaagatgtttatgagttcttctcaaaggctgggaaggttcgtgatgttcgtcttatcagggaccgaaactcaagactttctaaaggagttgggattacaccctgaaattttaatagtttgctcctccatgttggggattatccggcaaatttacagttttacaggcaaataaaggggggcaccccagaaaacaaggttcgaaaaccctctaacaattttttggaatcaaaatggccctgaagatttta

SEQ ID NO: 93809 - protein, 214 aa, Zea mays
  misc_feature: Ceres CLONE 1583284
MEFDEYEYLEKAVEPAPPPANGSGSGEKDRGSRRREGDEGRISKRSRSGEDRERGRHRSVREHRDRDKDDGKEKERSRDSRGKDRDREGREREKDTPDRHRPREREVERERRSLSRSERRRIEEEEMVRELEMERERSERHHYRDRDVRRRKDDGAEPEVDPERDQRTVFAFQLSLKADEKDVYEFFSKAGKVRDVRLIRDRNSRLSKGVGITP

SEQ ID NO: 93810 - DNA, 1237 bp, Zea mays
  misc_feature: Ceres CLONE 1583296
  misc_feature: Encodes the peptide sequence at SEQ ID NO. 93811
  misc_feature (94)..(94): n is a, c, t, g, unknown, or other
  misc_feature (1201)..(1201): n is a, c, t, g, unknown, or other
  misc_feature (1237)..(1237): n is a, c, t, g, unknown, or other
ttgaggggttggtacagagtactattttttaaagtaagcggttggtgtttcaaccgccaaccacacagcggccacgaaaaactggaactccccncggtggcggccgctctagaactagtggatcccccgggctgcaggaattcgtctcacccctagaaaaaattccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaagttccccctgctctcgaaatgcatgctcctgaaagcgctttccccccaccccagcgacgtcatcgttcaactccccggggttccgggcggcgccgaaggcttttcgaagcctgcggcaaagtaactggtaaggcaatcacccattcacgggtaaccaccccgccaacttgggtcccccctgccgggtgcgccggccgggctccaccttctcggaaattattcgggaagagccctccaaaagggggggaaaaacctttttgggggccaaaaatcttcgaaaggcggtttttcttttgacgcttccttggcccctcccttgtcgccccccgtcttgggtgaaaaggaacaaccccgccctcgggtggcgggtgatttatatattccaaaatatgtcctatgagggggggctcgcaacccaaaagagtagggtgcctccaatctttcttttcgagtgagaggagaaacccctatgtgggtgcgctctccaacctatatatccaccgcatagttgggactgtcacaaatacgacccccagtgtggacgcagtgtccccctctgtatgttcctctctcagattctcgcggggaaatagactcgatctcccctcaaagagaggtcacacacgttgtttgtgggatattatacctcctgctggtgatggggtgatgacacccgataagtaattctccctacataatattttagtgggatataataaacacttctttcttgggggggaggaaataaaatagtgagatcnccctcccttaaggagtgaccgtccttggtgtacacn

SEQ ID NO: 93811 - protein, 84 aa, Zea mays
  misc_feature: Ceres CLONE 1583296
MKFMRLGTRPDTFFTAADSVRSVCTEVATDLQILVDNCLYHLHKFPLLSKCMLLKALSPHPSDVIVQLPGVPGGAEGFSKPAAK

SEQ ID NO: 93812 - DNA, 1130 bp, Zea mays
  misc_feature: Ceres CLONE 1583300
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (76)..(76): n is a, c, t, g, unknown, or other
tttggtgggaaacgaagaaaaaaaaacataatcctcttagagtcatacccgcgttcattggaaaaagaaantnntnaaaactggaactccccgcggtggcggccgctctagaactagtggatcccccgggctgcaggaattcgtctcacccctagaaaaaagcttggtacgtacgacgctcaaatcctaatcgcctcttgctactttctcagctaagaattctgcgccatgtcgagtgagcacacagacgatcacatttggggccgagatcaggcagctcgacttcactcgtcactcacaccttctactgcgacaaggagatcgacctcccccgatctcatctccatgtcttccgatgcgcttgacaagatcatgttcgagagcctcactgaccagagcaagatctatgcgcagcctgagcttttaatccaggggtgtccgatacaaggccacgaactcgcactccgtggttcatagcccccccccacaataacaagtccgacgttgacaaccagctttgttacccttcgctcgggggcgggtaccaacgagggacgtgaaaaatccccttacttgccggccccgggaaaagttttccaatgattgggacagattctggactttcaggtgttaatgagtgttaccctaaccttcagttgggacaaaaaaaaaaaaaaaagtctttggtctttacccaagcgggcttgggaactcgaaccttgggaaggaaacgggggggcggcgcaatttccccacaaagcgtgggggagaaagaaaacccttctcccctttttaaaaaagcccggttaattctcttgaaaaggggggcctctctatatattgtgtccagtgggtggaaaaaccaaagtgacgcctccgggtgaacactatcgggggctttttttttttgaaggaagagtcctttttggaggggcgggccccacctagaggtattcggtgcaaaaaaaagccccctctgaaatttgtttcaaattatttccgcggttctttttttggggggcggaaatattcccccttgttgggtaattttttttctccccggaaactcgtaggctcctatatatatcccttaaacagaaacaattgtagtgttgattctatcaaaaaag

SEQ ID NO: 93813 - DNA, 860 bp, Zea mays
  misc_feature: Ceres CLONE 1583310
  misc_feature: Encodes the peptide sequence at SEQ ID NO. 93814
tagaagctggagctccccgcggtggcggccgctctagaactagtggatcccccgggctgcaggaattcgtctcacccctagaaaaaactctcctccccgctctcgacttcccatcccctgcggccccgccccccgactcttctcgtcgcggcgcgcccaatcggctcggtggcaggcttgcgcaccggctcggctcgggtccggttctaccgccaacgcgggccgccgcgctcccggatctcggtctagtcagagagttagcagacaaagatggcgacttatgagcccaagaacattctcataactggtgctgctggtttcattgcatcgcatgtcgccaaccgtctggtcaggaactatccccaatacaagatcgttgtccttgacaagattgactactgctccaacctaaagaacctcaatccttcacggtcttcaccaaatttcaaatttgtcaagggtgatattgcaagtgctgacctggtgaattaccttctgatcaccgagtcaattgacaccatcatgcactttgctgcccagacgcatgttgataaatctttttggcaattcatttgagttcacaaaaaacaatatatatggcacccatgttctttcttgaggcttggcagggttactggtcagattcagaggtttaatcatgtccgtacccgacgaggtggatggtgaaactgatgaaaatgctgggggttggaaaccatgaggccttacagctgcttccaacaaatccataattccgctacaaaggttgggggtgaaaatgcttgtgatgggaaaacggaaaggtcttaggggcctttcggggaattaccaccccgggggcaaacaagtgggtatgggca

SEQ ID NO: 93814 - protein, 101 aa, Zea mays
  misc_feature: Ceres CLONE 1583310
  misc_feature: SWISSPROT Homolog: EC 4.2.1.46 dTDP-glucose 4,6-dehydratase
MATYEPKNILITGAAGFIASHVANRLVRNYPQYKIVVLDKIDYCSNLKNLNPSRSSPNFKFVKGDIASADLVNYLLITESIDTIMHFAAQTHVDKSFWQFI

SEQ ID NO: 93815 - DNA, 890 bp, Zea mays
  misc_feature: Ceres CLONE 1583311
  misc_feature: Encodes the peptide sequence at SEQ ID NO. 93816
ccaagctggagctccccgcggtggcggccgctctagaactagtggatcccccgggctgcaggaattcgtctcacccctagaaaaattcttgccgagatcggcgcgtatatcttttccggtgtccgatgattcatgcattagcaatttttgactcgtgcgtgcgtgactacagttgcatgctatggccatggtcaccacttcgccggcaactgtgcagccatcatcatgcaagcacacaagccgcggcgcggcgcggtgctgccctcctcctctgctgtcctggaagacacaaagctttgggcagcaggtgacgacaagggccacggcggcgagctcccgtgggcagcccgcgggcgtggcacaggcagggggagaagagggcgacagtatcaggcggctgcagaacgggtcggacgtgcggggcgtcgcgctggagggcgagaaaggacgggccgtggacctcacgccgctggcggacgaggccatcgccgagagctaccgggagtggctgcgagaggaggatgctcggctccggggccaggagcccgaacagctgcgtgtgtccgtcaggcgcgaccccaggatgtcggggccgcggctcagcgcggcgctttttgcggggctcgccagggcggggcgcctcggtgttcaaaatgggggctcgcccaccccacccgggccggcttaaaagagaaacaaaaatgcccacggcttcaaacaatgaagggcccttatataggaggacggggggtaacaccttacccatacacccagaaacgggggttcaaaatctgttccccaaaggggcggggcgggcgctcacccttccggggaaaagttccaggaaaatattcggggcaacccggctccaagggcaggagaaatacgtg

SEQ ID NO: 93816 - protein, 168 aa, Zea mays
  misc_feature: Ceres CLONE 1583311
MAMVTTSPATVQPSSCKHTSRGAARCCPPPLLSWKTQSFGQQVTTRATAASSRGQPAGVAQAGGEEGDSIRRLQNGSDVRGVALEGEKGRAVDLTPLADEAIAESYREWLREEDARLRGQEPEQLRVSVRRDPRMSGPRLSAALFAGLARAGRLGVQNGGSPTPPGPA

SEQ ID NO: 93817 - DNA, 913 bp, Zea mays
  misc_feature: Ceres CLONE 1583313
  misc_feature: Encodes the peptide sequence at SEQ ID NO. 93818
  misc_feature (1)..(1): n is a, c, t, g, unknown, or other
  misc_feature (303)..(303): n is a, c, t, g, unknown, or other
naaaagctggagctcaccgcggtggcggccgctctagaactagtggatcccccgggctgcaggaattcgtctcacccctagaaaaaacgagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaagctgcccgcgcggcgcgatccggtgtccaccgctgccccgccggaggaggaggaggaaggggtggcggtggatctagganctgaatatgtggatgtcgagcttaaggtggctgacaaatttatgaaacttatttctgggaggaaacctgataactgtaaacttatagtttcatcccacaactatgagaccacttcatcgttccgaggaacttgcaaatttggggggctcagatttcagcaaacggggggctgatatcgtggaaattgctacaaccggctcctgaaaattggtgaagtgggcaaaaagggtttcaaaaaacttttttccctgcccaggaaaaaccagggggccaatctcttgggggtggcttaataaaaccaaaaaagggttttatttttctccggggtttttttgccccaaaagttgggggggaattccctttaccttttgggggccccccccaaaaagggaaaaaaaaggttgggcccctgtggaaagagcaaatgtggtggaaaaaatgtgggaaaaaatcgtggacaacaaatttaggggggaaaataaggggcccacaaaaaacaaaaggggtctttgggggggaaaaatggggggaaaaaacaggtggggcgctttgggaaaaaaaacgccccatttttgggctaaaaaaaaaaaactcttctttaaagaaaggg

SEQ ID NO: 93818 - protein, 157 aa, Zea mays
  misc_feature: Ceres CLONE 1583313
  misc_feature (101)..(101): Xaa is any aa, unknown, or other
KAGAHRGGGRSRTSGSPGLQEFVSPLEKTRPSTATRSLARAPVLPFPLHLRGARGNLATPHRVRAPTVAGPLIKLPARRDPVSTAAPPEEEEEGVAVDLGXEYVDVELKVADKFMKLISGRKPDNCKLIVSSHNYETTSSFRGTCKFGGLRFQQTGG

SEQ ID NO: 93819 - DNA, 829 bp, Zea mays
  misc_feature: Ceres CLONE 1583314
  misc_feature: Encodes the peptide sequence at SEQ ID NO. 93820
  misc_feature (495)..(495): n is a, c, t, g, unknown, or other
  misc_feature (594)..(594): n is a, c, t, g, unknown, or other
  misc_feature (595)..(595): n is a, c, t, g, unknown, or other
  misc_feature (612)..(612): n is a, c, t, g, unknown, or other
ggagctccccgcggtggcggccgctctagaactagtggatcccccgggctgcaggaattcgtctcacccctagaaaaaactcacttcccttccacaccgccgcctccggagaagggtccacggcggcgtccttcctcgggaggcgctcggctcggattcgctcctgctcggcggcggcgtcgccggctggtgggctcgcgcgcgcacctggtgctgggctccgcgggcgctcctcgtgcgtgacacgcgcccgatgcgtcaggatcgcgcggccggcgcccggggcctgccgtgattctgcggggaggctggatctcggtgcttccgcgtgcgggaaccagtgagttttctttttgtcttctcttccccggcggctagcggcgggccgcttggtgcacgtcagcgcgggaggccggaggttagccgatctggtgctctcgccgcccggagagatggtgctgggcccactgccgggttctgcttagtaggaggcgngaggaggtaagtccctcgtctcatggggctcgcgccgccggagctgggccagttcgacgggggggagagctccgggggagagggaacgggagcgggacnnttttggggctggtgccnccgcagccgccgcggcagcagcaggcgccgcgcggcccccaagggcaccgacgacgacaccgcggtcgacaccggctgctgcatccgcctctgggccgtcgggacatgccctccgccgccgcagaggtccaaggtcgacaccctccaccagcagccccagcacgcacgggggccagagaagtccaccggaaaatgggtggtagggattccaccgggg

SEQ ID NO: 93820 - protein, 104 aa, Zea mays
  misc_feature: Ceres CLONE 1583314
  misc_feature (26)..(26): Xaa is any aa, unknown, or other
  misc_feature (32)..(32): Xaa is any aa, unknown, or other
MGLAPPELGQFDGGESSGGEGTGAGXFWGWCXRSRRGSSRRRAAPKGTDDDTAVDTGCCIRLWAVGTCPPPPQRSKVDTLHQQPQHARGPEKSTGKWVVGIPPG

SEQ ID NO: 93821 - DNA, 842 bp, Zea mays
  misc_feature: Ceres CLONE 1583316
  misc_feature: Encodes the peptide sequence at SEQ ID NO. 93822
ctggagctcaccgcggtggcggccgctctagaactagtggatcccccgggctgcaggaattcgtctcacccctagaaaaactagaaaaacccctagaaaaaaaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtcttctcctcccgcccgcgctccctggtgtccgacatcatcatgtacggcgccacggactcgtgcttcgcgccctacggcgaccacttcggcaggcggcgaaagctggtcaccggcacttgctcaacgccagcaggtgcgtccacgcccggaaaaaaaaaaaaaa

SEQ ID NO: 93822 - protein, 190 aa, Zea mays
  misc_feature: Ceres CLONE 1583316
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYDHVFSSRPRSLVSDIIMYGATDSCFAPYGDHFGRRRKLVTGTCSTPAGASTPGKKKK

SEQ ID NO: 93823 - DNA, 885 bp, Zea mays
  misc_feature: Ceres CLONE 1583317
  misc_feature: Translation starting site: 276
aaagctggagctccccgcggtggcggccgctctagaactagtggatcccccgggctgcaggaattcgtctcacccctagaaaaactagaaaaacccctagaaaaaaaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacattgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggaccggcggcggtggcggccagccaccccgacaagctcatgaggcctgctgccgtcgccgccccataagctccccatcatcgggcacctgcaccctgaggggggacatcccctaactggtccttggccgcgctgggcaccaggtaagggcccgggaacctgaggctgcttccgcctcggggaccgtgcccaacccggggtgggtctcgtacgccgccccgtccgccgaaggccggggctcccgcaccctagggaccacgttttttttccttcacgaccagggatttcctgggggtcccaaaagtaatcatgggaggggggccccccgaaatcgggggtttgcgggccccgaagggggaaaccctttcccccaaggggcgcgaaaagtggggccaacggggaaccgtgcttaaacctcaaggaagggggcggtcccaccggcccc

SEQ ID NO: 93824 - DNA, 891 bp, Zea mays
  misc_feature: Ceres CLONE 1583318
  misc_feature: Encodes the peptide sequence at SEQ ID NO. 93825
aaagctggagctccccgcggtggcggccgctctagaactagtggatcccccgggctgcaggaattcgtctcacccctagaaaaaatcgccaactcggagaccttgagaggaaagccaccgcgcgctagggcctagggcagggcacgagcaaaggccctcccgcgggttccattggagcgcgagcgaacggcgccgacgcggcaacacacattcgctttatttgccatgacatcgccgtcctcgtcgtcgtcctggctgctgctgctcctctcgtgcctcgcgcttgccctgctcgcggcggacgccgaagtgcaccaccatgagttcgttgtccaagagacgccagtgaagaggctgtgcaagacgcacaatgtcatcacggtgaacgggcagtacccggggccgacgctggaggtcagggagggcgacacgctggtgatcaacgtcgtcaaccgggcgcagtacaacgtcaccatccactggcacggcatccggcagatgaggaccgggtgggcggacgggccggagttcgtgacgcagtgccccatcaggcccgggggccagctacaagtaccggttcaccatcgaggggccagagggccccctgtggtgggacgcgcacagctcctgggctcagggaaaacgtctacgggggcgcttcttcatccgcccccagggaagaaaaagaccttacccctttcggcaaaggccctcggggcgaaaatcccccgttcattccttggggggaattggggggggaagcccaaaatccgtaatcgaaggttccttcccggggaagagggcccgaaaggagagagggcgggggcgcccccgcaaaaggagctttcggaacgcgggtttttacccatatagaagggagtcgaagcccgg

SEQ ID NO: 93825 - protein, 215 aa, Zea mays
  misc_feature: Ceres CLONE 1583318
  misc_feature (35)..(134): Pfam Name: Cu-oxidase_3 Pfam Description: Multicopper oxidase
  misc_feature: SWISSPROT Homolog: EC 1.10.3.2 Laccase
MTSPSSSSSWLLLLLSCLALALLAADAEVHHHEFVVQETPVKRLCKTHNVITVNGQYPGPTLEVREGDTLVINVVNRAQYNVTIHWHGIRQMRTGWADGPEFVTQCPIRPGGQLQVPVHHRGARGPPVVGRAQLLGSGKTSTGALLHPPPGKKKTLPLSAKALGAKIPRSFLGGNWGGKPKIRNRRFLPGEEGPKGERAGAPPQKELSERGFLPI

SEQ ID NO: 93826 - DNA, 977 bp, Zea mays
  misc_feature: Ceres CLONE 1583319
  misc_feature: Encodes the peptide sequence at SEQ ID NO. 93827
  misc_feature (948)..(948): n is a, c, t, g, unknown, or other
  misc_feature (969)..(969): n is a, c, t, g, unknown, or other
aaagctggagctccaccgcggtggcggccgctctagaactagtggatcccccgggctgcaggaattcgtctcacccctagaaaaatccccggaccccgggccagtctcacctccttccctcgatcgcacgccactcccgtaggaatcccgaatccccccacccaaattcccgtctagccgtctacccgatcgccgtccttctcgctgcccgtaaaccctagcccagccctctacccccgccgtcgttgcccgtgcgctgtcgtgctcgggctgcccccgcggcgccgcgagccaaaccctagctgcctcctccagatcccgattccgcagggaagccggagaggtgagggccgccccgccgcagagggagccccgcgggggcgcgcaaggagtgggcgcgcgtccccgactccttcggctcggttccaatgggcgccaaggatgcccgcggaacatggggaaacctggggcaattccgaggaaacgagctattcttcaaaggaagggggcggggtgggactggggcgaaccttctggaacccattacctttttggatggggaggcgggagggggctttaagggaggggaaaatccttggccaaaaaggccgccctgttcaaaaaggtgttcccacccggggaaaccgggggaaagaaaatcttgccaccaagagattcgagaatattcaaaattttttggttgtggcccgcggggcccattttggcccaaccccccgcgaaaataattcgtgggaggggggacaaaaagagattttccccggggtggtcgttttccaaaaggggaaatatgtttccgaactttggggtggagaaaagatttgggaggggccatttttccttttaaagcgggggaaaagaaacaactctttttgggattttgaaaaagagaagacttttgtgggggggggggttatagagttgtccganactgtgtcgccatatattgtnttttttta

SEQ ID NO: 93827 - protein, 178 aa, Zea mays
  misc_feature: Ceres CLONE 1583319
  misc_feature (169)..(169): Xaa is any aa, unknown, or other
MPAEHGETWGNSEETSYSSKEGGGVGLGRTFWNPLPFWMGRREGALREGKILGQKGRPVQKGVPTRGNRGKENLATKRFENIQNFLVVARGAHFGPTPRENNSWEGGQKEIFPGVVVFQKGKYVSELWGGEKIWEGPFFLLKRGKRNNSFWDFEKEKTFVGGGVIELSXTVSPYIVFF

SEQ ID NO: 93828 - DNA, 826 bp, Zea mays
  misc_feature: Ceres CLONE 1583320
  misc_feature: Encodes the peptide sequence at SEQ ID NO. 93829
  misc_feature (704)..(704): n is a, c, t, g, unknown, or other
aaagctggagctccccgcggtggcggccgctctagaactagtggatcccccgggctgcaggaattcgtctcacccctagaaaaaagaatccaatgagcaatctcgactgacgcctgcttcaccagattatggcgacgccggcgggcctccttctcgcctcgccgccggtgatatcaggtgtcgcggcgatggcggcgtgcgccgcaatggcagtattctacgtcgctgtcctctatgccccgacggtcatcctccggttcccacccccaacctcactccgcaccttcctccaccgtcgcttcgcctgtgccgccgtcgcatccgccgcctccgtccttgccactgcgtccctcctccgagtctggagcctcagcgacttcgctgatatgtttgctgtgttcggcattaggaaggatcacttgattcaggccgtggctattccacttctcctgacatccctagtgtatgctgggtcattcgtcgctagagtgtggctcctagtgagctcgtggggcggtggcgatgaggtggagataggctgcgcacagaggcttgcacaatggatccaagctgctgttgcggatgttatggtttggcggaactatgtagtggcaccatttactgaggagctggttttcagggcatgcatgatacctcttctgctctgtgggggattcaaaatgtctacaattatatttctgagntcaatcttcttcagtctaggtaaaattctatagtatcggtctaattttttgtattccaaagggaaccactttgcccgcatcattttaaccttctcatgtatgccccgcacgttctgtggaca

SEQ ID NO: 93829 - protein, 182 aa, Zea mays
  misc_feature: Ceres CLONE 1583320
  misc_feature (172)..(172): Xaa is any aa, unknown, or other
MAACAAMAVFYVAVLYAPTVILRFPPPTSLRTFLHRRFACAAVASAASVLATASLLRVWSLSDFADMFAVFGIRKDHLIQAVAIPLLLTSLVYAGSFVARVWLLVSSWGGGDEVEIGCAQRLAQWIQAAVADVMVWRNYVVAPFTEELVFRACMIPLLLCGGFKMSTIIFLXSIFFSLGKIL

SEQ ID NO: 93830 - DNA, 965 bp, Zea mays
  misc_feature: Ceres CLONE 1583321
  misc_feature: Encodes the peptide sequence at SEQ ID NO. 93831
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (91)..(91): n is a, c, t, g, unknown, or other
nnnnnnntttttttttttttctcgcaaaagctagggcgtgtgggggtggtagggaatttttttnnnnnnnnnnaaaaagctggactccccncggtggcggccgctctagaatagtggatcccccgggctgcaggaattcgtctcacccctagaaaaaagaatccaatgagcaatctcgactgacgcctgcttcaccagattatggcgacgccggcgggcctccttctcgcctcgccgccggtgatatcaggtgtcgcggcgatggcggcgtgcgccgcaatggcagtattctacgtcgctgtcctctatgccccgacggtcatcctccggttcccacccccaacctcactccgcaccttcctccaccgtcgcttcgcctgtgccgccgtcgcatccgccgcctccgtccttgccactgcgtccctcctccgagtctggagcctcagcgacttcgctgatatgtttgctgtgttcggcattacgaaggatcacttgattcaggccgtggctattccacttctcctgacatccctagtgtatgctgggtcattcgtcgctagagtgtggctcctagtgagctcgtggggcggtggcgatgaggtggagataggctgcgcacagaagcttgcacaatggatccaagcctgctgttgcgggatgttatggtttgggcggaactatggtagtgggcaccattttactgaagggagctggtttttccagggcaatggcatgataccctcttcctggctccgggggggggaattcaaaagatgtcctacacaattatatgttccttgaaatcccaattcatccgttccaggtcctaggataaaaattttcccattagggacgcggctgtcctaaaattttttgtggcaatctctccaagagggaaaccccaacacttttgtgcccgtgtcattcgccgattttcagaaccccgtttcctccgaggtgggaat

SEQ ID NO: 93831 - protein, 179 aa, Zea mays
  misc_feature: Ceres CLONE 1583321
MAACAAMAVFYVAVLYAPTVILRFPPPTSLRTFLHRRFACAAVASAASVLATASLLRVWSLSDFADMFAVFGITKDHLIQAVAIPLLLTSLVYAGSFVARVWLLVSSWGGGDEVEIGCAQKLAQWIQACCCGMLWFGRNYGSGHHFTEGSWFFQGNGMIPSSWLRGGEFKRCPTQLYVP

SEQ ID NO: 93832 - DNA, 875 bp, Zea mays
  misc_feature: Ceres CLONE 1583322
  misc_feature: Encodes the peptide sequence at SEQ ID NO. 93833
aagctggagctccccgcggtggcggccgctctagaactagtggatcccccgggctgcaggaattcgtctcacccctagaaaaagcggaaaagcgccatctcattcttcttcctccatcttgtctctacttgccccgcgccggggagccgcgagcgtcgcgccactcccatcgcctgcccacaactccggcatggagccgtcggcgtgggccgtcgccttcgccgcactctgcatcgtcgcgctcgcgccgccggcctcagggttctacctccccggcgtcgcgcccaatgacttcgagaagaaagatccacttcctgtgaaagtcaacaagctgacctcaatcaagacacaacttccctactcctactattctctcccattctgcaagccggataccatagttgacagtgcagaaaatctcggtgaagttcttcgtggagatcgcattgaaaactctccctatacgtttgaaatgagggagcctcagatgtgtcaagtagtctgcaagatatctgtttggggagaaagaagcaaagcttctcaaggagaagattgaagatgaataccgtgttaacatgattcttgacaacctacctttagtcgtttcctattcaaaggaggggatcaagaaggggcatatttctatcaacctggattccctgttgggggccaaaggaaaattttcagggagcaaagaataaaaaaactttcttccccaacgattatcttttaccggtgaaaaaacccaggggatgagacaaagggattttttccggaattggggccttttaaaggaaaccctcaccgcgttaaggggggaaaatgagggggcattggaattgaaaaaagaagccccctcggaaaacggtttacct

SEQ ID NO: 93833 - protein, 121 aa, Zea mays; identical to SEQ ID NO: 93303
  misc_feature: Ceres CLONE 1583322

SEQ ID NO: 93834 - DNA, 933 bp, Zea mays
  misc_feature: Ceres CLONE 1583323
  misc_feature: Encodes the peptide sequence at SEQ ID NO. 93835
ctggagctccccgcggtggcggccgctctagaactagtggatcccccgggctgcaggaattcgtctcacccctagaaaaaagctctactcctctccccgagtcctctcctctccggggtattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttgccagtctcctctggctgtgcggtccgctgtccggcctcctcgtccagcccctcgtcggccacctctccgaccgcatcggccccgccgcttcgccgctcgggcgccgcaggcccttcatcgccgccgggcgccgcgtggattcgcgcagccggggctcaccgtcgggcttctccggctgacctcgggccgactctttgggcggacgacgtcacccccgggggtcaaggcggccctcggggggccatctgggggcgtacccttgggaggatttctggggcgggctcgcacacggggggcaacaacccggcactccgggggggcccctggccagggcgggttcgctggccccgagccgcccaggaggaatgggccccggggcagggagtctggaatcgcctaggtgccaaacctttttccactgctttccggggccccgggggaaaaaatgccttggggataatggccaccgggagcccagaaaccgggggggggggaattacggaagggttccccgctcgcccgtgtaccaagagatccctgggggggcggtcaatgtggtgcgccagcccagaaggcctcgcct

SEQ ID NO: 93835 - protein, 115 aa, Zea mays
  misc_feature: Ceres CLONE 1583323
MPPRTAPAATSTPPRKVPLRKLLRAASVACGVQFGWALQLSLLTPYVQELGIPHAFASLLWLCGPLSGLLVQPLVGHLSDRIGPAASPLGRRRPFIAAGRRVDSRSRGSPSGFSG

SEQ ID NO: 93836 - DNA, 1033 bp, Zea mays
  misc_feature: Ceres CLONE 1583325
  misc_feature (365)..(365): n is a, c, t, g, unknown, or other
aaagctggagctccccgcggtggcggccgctttagaactagtggatcccccgggctgcatgaattcgtctcacccctagaaaaagttccaggtcgtggtctttgccaaattcccacgcccctgcccaccctgcccgaatcctctcgccctttacccccgcccgcgaccccattcacactctcgctgctccactccgctccgctcagctcgtcgggacgcgcccccgcctcccatcccatgcccgcccccgcgctcgtcggaggccgctcgcggcggcctcccatcccgccgcgctgacgagagggcctctcggtgggggcgcttcgggtgttcattttgtccgttcgggggaaggggagtgcggncgatggggaagcagcaggaaggggaagcggcggcccggggagaaggaacgggaagcggaagggggaagggggaaaaacacttttcagcggcgggagccggaaggacctcggcgcccatatggcccggggagcctggaatccgccttacccgcggccatccagggggttggaaaaggcgaaccacgcggcgcaagggtcgaaatctcctccaacaagacaggcgcggtggaatgggggggacgggggaaaaaaccaaaacaaggcaaactggaaaggaagtggtgtgcccagggaaacccaatccagattaacccacccccgcgcccctagggggttttcgccaaaaccgacccagggttataccccccggtaaaggtgacgctgagacctgctctataccacaaaaacttggggaggaaggggaaccctaaaagaatgagagtttgtaccgaaaacggggagagaaggaatgtacgcctctcttcgcgcggaaccttggacaaagtgggcccacgacaagaacgaaggttctggaacccgggagaagatgcactacatagatgagaagaggagaaggagattatgaccgcgacgactctccacacaagggattgttgataattcgaggggagaaatgagtaaatggcgcctcatatctaacatgacag

SEQ ID NO: 93837 - DNA, 801 bp, Zea mays
  misc_feature: Ceres CLONE 1583326
  misc_feature: Encodes the peptide sequence at SEQ ID NO. 93838
  misc_feature (637)..(637): n is a, c, t, g, unknown, or other
ctggagctccccgcggtggcggccgctctagaactagtggatcccccgggctgcaggaattcgtctcacccctagaaaaaaaccaaacacatcctacgtctcctcattcacattcatcctgtcggactgtagcgcgcacgccccggccggatcagagagatgggcaccgtcggcggcggcgagcttcccgtcgccgccccggccgccgccgacgcagaccgggcgcggctgcagcagctggggtacaagcaggagctcaagcgcggcctctccgttgtttccaacttcgccttctccttcgccatcatctccgtgctgacgggcgtgacgacgacctacaacaccgggctgcgctacggcgggccggcgtccatgacgctgggctggctcgtcgtggcgaccttcaacggctgcgtggcgctgtccatggcggagatctgctccgcctacccgacctccggcggcctctactactggagcgccaagctcgccggcaacgaatgggctccacttgcctcctgggtcaccggatggttcaacatcgtggggcagtgggcgtgcaccacgagcgtggacttctcgctggcgcagctgatccaggtgatcatcctgctgagcaccggtgggggcaacggcngcggctacctcgcctccaagtacgtcgtgctttgcatctacaccgccatcctcgtcgtgcacggcctcatcacagcctgcacatccagtggctcttctggttcggacagctcggagcctttgtggaacgtcccggggcgtgttcgtctcgtcatcctgggccct

SEQ ID NO: 93838 - protein, 214 aa, Zea mays
  misc_feature: Ceres CLONE 1583326
  misc_feature (160)..(160): Xaa is any aa, unknown, or other
MGTVGGGELPVAAPAAADADRARLQQLGYKQELKRGLSVVSNFAFSFAIISVLTGVTTTYNTGLRYGGPASMTLGWLVVATFNGCVALSMAEICSAYPTSGGLYYWSAKLAGNEWAPLASWVTGWFNIVGQWACTTSVDFSLAQLIQVIILLSTGGGNGXGYLASKYVVLCIYTAILVVHGLITACTSSGSSGSDSSEPLWNVPGRVRLVILGP

SEQ ID NO: 93839 - DNA, 891 bp, Zea mays
  misc_feature: Ceres CLONE 1583331
  misc_feature: Encodes the peptide sequence at SEQ ID NO. 93840
ccccgcggtggcggccgctctagaactagtggatcccccgggctgcaggaattcgtctcacccctagaaaaaatattcccgtcggctcaatcccacgttgatcgtacaacacaccagcccgtgaccccgtgggcgtgtgcttgcactgtgatgagggatgacggacgatgacgagaaagcacaacctgcgcagtggccgcaactgccaccgcaagcacgtctaggacgggtaggttcatcggtctcgtcgccgttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggcccacggcaacttcgggcgggtgcacgcggcgcgggatctgcgcaccggccgcagcgtcccggtcaaggtggtggccaaggacaagctggagcgcgcgggccatggcggaacagatcaagcgggagattcgccttcctgaagatggtgtcccacccccacatcgtggagctgccgcaggtgatgggcacccgctcccaagaactaacctcgcgctcgagtctccttccgcggcgggggagctctttctccccattcgctcgccgcggggcggatcccgtgaagaccttggccccctgtttacttccgggcagctttcccccccccaggtccaatttcttggcaaggcgccgccgggttggttcccacccaaggacctgaaaccttccagaaacctgcctccctcgagcgaaggtaggggtcaacccccaaaactggccggaaacttttgggggctttaggcggcggacttcgcccgggagacacctcctcggctg

SEQ ID NO: 93840 - protein, 69 aa, Zea mays
  misc_feature: Ceres CLONE 1583331
  misc_feature: SWISSPROT Homolog: EC 2.7.11.1 Non-specific serine/threonine protein kinase
MEDAMAADGKSVLQGRYELGRVLAHGNFGRVHAARDLRTGRSVPVKVVAKDKLERAGHGGTDQAGDSPS

SEQ ID NO: 93841 - DNA, 887 bp, Zea mays
  misc_feature: Ceres CLONE 1583332
  misc_feature: Encodes the peptide sequence at SEQ ID NO. 93842
tggagctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgtttccggagctgctcgcccgcaacggcgtcaagttcggcgaaggccttgtggttcaaggcccgggtcgcagatttttcagccaagggtgggctggaataacttcgcaacccgagcctgattcacgcgaagaacatcctccccaactgggccctgccaggtccctgctccagggggcgccattaggggggaaccccgtcccccggggggcccccttccggaaaagggggttcaaaaccccctttttaccccgggggggaaatttttgaacccggtttggggctttgtgccgaagaaaaccctgaaggggcctttcccgcgaaaccccccaaggggggaagaggagagccttcaaaaaaaaggagggcggcccccctccccccacaaggttttccccccacgggggtttggg

SEQ ID NO: 93842 - protein, 201 aa, Zea mays
  misc_feature: Ceres CLONE 1583332
  misc_feature (64)..(151): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEGLVVQGPGRRFFSQGWAGITSQPEPDSREEHPPQLGPARSLLQGAPLGGNPVPRGAPFRKRGFKTPFLPRGGNF

SEQ ID NO: 93843 - DNA, 812 bp, Zea mays
  misc_feature: Ceres CLONE 1583333
  misc_feature: Encodes the peptide sequence at SEQ ID NO. 93844
  misc_feature (310)..(310): n is a, c, t, g, unknown, or other
  misc_feature (326)..(326): n is a, c, t, g, unknown, or other
ctggagctccccgcggtggcggccgctctagaactagtggatcccccgggctgcaggaattcgtctcacccctagaaaaacgagttcttcgacgaaattgaccgcgctatcgctgagaagcgggaggagttcacgcggcgcgggctcatcaagccatcccctgcttcgccgccgccgtcgcaatcgcagccggaggacgaggacctcaccgacgagctctcccctgaggaggtgatcgatctcgatgagattcggaagcttcagggactcagtgttgtatccgtggccgacgaggaggatgaggaggtgngaggggggcgaggacnaggacgatggattgccgctcgatgaggacggggaaggctttgacgtggccgaggagctcggcctcgagggtgccacgatgcgacaaccggctttccgcatgacgctggctgagctccttgacgagagcaagctcgtcccggtggccgtgacgggcgaccaggatgtcgccctcgcaggagtgcagcgcgacgccagcctggtggcggccggcgacctgtttgtgtgcgtgggagaggacgggctcgcggggctcaccgaagccgacaagcgtggggccgttgccgtcctagctgatcaggacctcaacattgagggcaccctggcctgtcgcgcgctggtcattgtagacgacattttgactgcgctccggggactccctgcctgcttgtacagccggccggccgatgaacatggctatcataggggttactgggcacagagggcgtaactaccaccactcacctcggggaaagcagtgttccaga

SEQ ID NO: 93844 - protein, 176 aa, Zea mays
  misc_feature: Ceres CLONE 1583333
  misc_feature: SWISSPROT Homolog: EC 6.3.2.13 UDP-N-acetylmuramoyl-L-alanyl-D-glutamate--2,6-diaminopimelate ligase
  misc_feature (22)..(22): Xaa is any aa, unknown, or other
  misc_feature (28)..(28): Xaa is any aa, unknown, or other
MRFGSFRDSVLYPWPTRRMRRXEGGEDXDDGLPLDEDGEGFDVAEELGLEGATMRQPAFRMTLAELLDESKLVPVAVTGDQDVALAGVQRDASLVAAGDLFVCVGEDGLAGLTEADKRGAVAVLADQDLNIEGTLACRALVIVDDILTALRGLPACLYSRPADEHGYHRGYWAQRA

SEQ ID NO: 93845 - DNA, 851 bp, Zea mays
  misc_feature: Ceres CLONE 1583334
  misc_feature: Encodes the peptide sequence at SEQ ID NO. 93846
ctggagctccccgcggtggcggccgctctagaactagtggatcccccgggctgcaggaattcgtctcacccctagaaaaaacacccaatctgatctgaccaagccctctgaacacccccgcccatcctcctcctcctcctccgccgccgccgcccaagatgggcttcgacgtgggcctcgtcccctacaaccccgacgggtggggtccacctgaagttgccgccgcgccgccttccctcggtggtggctcctcgtctgtccccttcgctcccttctcccgctccgacaagctgggccgcatcgccgactggacgcgcaacccgccgggccccggggctttcgccgcagctcgcgacgccgtcttcgatttcgcggggctcgaggactccatcgggctcgcgtccgcggacgactcgtccttccgcctcgtcgatggcaaaccgccgccgcggcacccgcggtttggacctcgctggcgcttccagcagcggccccaactcccgcagcgccgcgacgaagaggtcgaggctcggcgtcgcgaggccgagaaggagcgcgcttgccgcgacccgcactggcagcagaaccgccgcacgcaccaccaggtcaaccgcggcggtccctcctcgtcgtctgccaaaccggtccgttgacatccagccccgagtggtcggtgaaggagcagatccttttctcatccttctccaagctcttcttcgccgttcgccgaacaggcccgaggatctcctcgttctgtgcgccattcaagtactacgaccgggacctacaatcgcgttcaccccaggggcgaagcgttcccctccagccgcttcaggtgggggaacttctta

SEQ ID NO: 93846 - protein, 164 aa, Zea mays
  misc_feature: Ceres CLONE 1583334
MGFDVGLVPYNPDGWGPPEVAAAPPSLGGGSSSVPFAPFSRSDKLGRIADWTRNPPGPGAFAAARDAVFDFAGLEDSIGLASADDSSFRLVDGKPPPRHPRFGPRWRFQQRPQLPQRRDEEVEARRREAEKERACRDPHWQQNRRTHHQVNRGGPSSSSAKPVR

SEQ ID NO: 93847 - DNA, 910 bp, Zea mays
  misc_feature: Ceres CLONE 1583337
  misc_feature (339)..(339): n is a, c, t, g, unknown, or other
acccgcggtggcggccgctctagaactagtggatcccccgggctgcaggaattcgtctcacccctagaaaaaacgacccgcgtgtaggtgtagcactctccatcctcattgctaactgctcgattctcctccatacccttgtgcacgcacagccgacactgcagtgaggaacttgaacagaggaagaagcccggctgagcgctctctcgtctagctagctgcgctgcggcgatgaagatgcatcgcttcgctctgcgtggcctggggtttctcgtcctgtggatgctgcattgcggaagcgaagttcgccgcggcggtgcctccagatggctggtacgnatactccgcctacaccgactgcagaagccaggcgggagccggcgctgtacaacggaaggcattctccagttcgggagcagcagcagccggcggggggcaatccggaaggggtaccccaacgaagggaaaacgggggtcttcttccccgggggttttggggggggacaacccctcaaaaaaaacccccttgttacccccttttccaatgccggggggaaaacctgggaaagggcccttaactccgggttttttaataacaccccggggggggtgggggggccccggaaaaaaaaaccgcggggcgccagggggggccttcccccccccgggggggggttccccaaaagaaaaaaaatctgtgggggcccccttctttaagggggggggaggattttccccccgggaggaggggggcaacaaaaaaaaaacaccgggaggatttttttttttttttaaaaaaaagggtgaaaaaaaacacccccccccaaaaaaaaaaaaccccccggggaaaaagaaggggttttttttttatacccttttttctcccacagagaaaaaaggtggggggggg

SEQ ID NO: 93848 - DNA, 826 bp, Zea mays
  misc_feature: Ceres CLONE 1583338
  misc_feature: Encodes the peptide sequence at SEQ ID NO. 93849
agctccccgcggtggcggccgctctagaactagtggatcccccgggctgcaggaattcgtctcacccctagaaaaattccgccggtcgaccgatccccccccccccaccccccaccggataccaccgcctccaccaaccgattccgttccatcccccctcccccctcgctcgagcgcgaggcttctctcccctcccttccccttccctcccctcccccccggcgcggattcctacagccagctccctcgccgatcgcggtcccgtcccgagggagaggtgatgataaaggatatctgctgaccaaacttgcagtagttcttcttaaggaaatagaaattggcgtcatgacacatagaaatatgctctggacacatcagtctgttaatcctgaatgggagcaaagacatgtccaagttcaaccaggaagttcctattatgcaggcactgcaagtgatccatccaacctgggtgtgcaagttgctgtgggagttccaggaaatactgctaatgttggtatatgtgatttgcggaatcatgagtgcccgcatgttcataattcatacccacatgccggtgttacatcaagatttgtcttcccaactactatgtacagccctagcatgtcagcagcagctgtcaacatatatatacctcagactcaaagctttggactgggcagtgtgctaccaccatctttacataatccagtttccacaggtaattattgatgagagtagcagcagtgtcaattttggtgatagtgctatggaattctggaaaggaaaaagcagtagttgcttggagcccataatttcttcagggata

SEQ ID NO: 93849 - protein, 127 aa, Zea mays
  misc_feature: Ceres CLONE 1583338
MTHRNMLWTHQSVNPEWEQRHVQVQPGSSYYAGTASDPSNLGVQVAVGVPGNTANVGICDLRNHECPHVHNSYPHAGVTSRFVFPTTMYSPSMSAAAVNIYIPQTQSFGLGSVLPPSLHNPVSTGNY

SEQ ID NO: 93850 - DNA, 850 bp, Zea mays
  misc_feature: Ceres CLONE 1583342
  misc_feature: Encodes the peptide sequence at SEQ ID NO. 93851
ctccccgcggtggcggccgctctagaactagtggatcccccgggctgcaggaattcgtctcaccccctagaaaaaaccaccaccaccaccgcctcatcccccaccacggcaccaccgagcagcacagcacagggcactgcccgattccacccctgcagcctctcgctgcccactttccatgtcactgcaccactgccgcgctgccacgacgcccgccatgcccgccaccggcctctcgtccgcgggcgcttccccgttccgcctgcccgcctccagctcctccgcccagggccacctccgtctctccccccctgctgccactgccagtgccaccgcctgccgccgccgcttgcttctccgctgcgccgcctcttctggcggtggcggcggcagcggctccgacccggtcctagaggagcagcggcgccgccaggccgagctcgccgcgcgcattgcgtccggcgagttcaccgtgcaaggccccgggtggattgcgcctctcgtggggaggctctccaagctgggccccgccggggggaagctcgccgccgcgctgctcaccatgggtagcggggcgctggtcggcccggagatccccgcagcaagggggggtccgatcaacggcggtcctgggggcccagggccttccttcgtgcgcccctggaaaaaacctctttcctcaccctaagggcgggcatcttttcgccctcaaactttgggcccctaaagaccggtttccttaattgtcccccgaaatccgggttattcgcctaaagcacaatccccggggggggagaaaacccccaaaggcttatttcccaaggggaaaattccctagcctgaaaaaaaa

SEQ ID NO: 93851 - protein, 169 aa, Zea mays
  misc_feature: Ceres CLONE 1583342
MSLHHCRAATTPAMPATGLSSAGASPFRLPASSSSAQGHLRLSPPAATASATACRRRLLLRCAASSGGGGGSGSDPVLEEQRRRQAELAARIASGEFTVQGPGWIAPLVGRLSKLGPAGGKLAAALLTMGSGALVGPEIPAARGGPINGGPGGPGPSFVRPWKKPLSSP

SEQ ID NO: 93852 - DNA, 842 bp, Zea mays
  misc_feature: Ceres CLONE 1583344
  misc_feature: Encodes the peptide sequence at SEQ ID NO. 93853
  misc_feature (746)..(746): n is a, c, t, g, unknown, or other
  misc_feature (830)..(830): n is a, c, t, g, unknown, or other
aaagctggagctccccgcggtggcggccgctctagaactagtggatcccccgggctgcaggaattcgtctcacccctagaaaaaattcactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccttcggaaatccctcgaagggactggttcccctccgacttcatctttggtgccgccacttcagcgtaccaaattgaaggtgcttggaacgaagatggaaagggggaaagcaattgggatcacttctgccacaattttccggaaaggataatggacgggagcaatgcagacattggagcgaattcgtaccatatgtacaaaacggatgtcagattgctgaaggaaatgggcatggacgcatataggttctctatctcttggcctagaatactgcctaagggaacggtcgaaggaggtattaaccaggatggcatcgattactacaaaaggctcatcaacttgttgctagagaatggcatagagccatatgtaacaattttccactgggatgtcccctcagcactagaagagaagtacngcggaatcttagataagactcataagaagattgtaaatgatttacaaaacttcgctaaagtgtgcttcgacaactttggtgacnaggtgaagaatc

SEQ ID NO: 93853 - protein, 228 aa, Zea mays
  misc_feature: Ceres CLONE 1583344
  misc_feature (63)..(228): Pfam Name: Glyco_hydro_1 Pfam Description: Glycosyl hydrolase family 1
  misc_feature: SWISSPROT Homolog: EC 3.2.1.21 Beta-glucosidase
  misc_feature (197)..(197): Xaa is any aa, unknown, or other
  misc_feature (225)..(225): Xaa is any aa, unknown, or other
MNHAAHPVLRSHLGPNNESFSRHHLSSSPQSSKRRFNLSFTPRSARVGNQNGVQLLSPSEIPRRDWFPSDFIFGAATSAYQIEGAWNEDGKGESNWDHFCHNFPERIMDGSNADIGANSYHMYKTDVRLLKEMGMDAYRFSISWPRILPKGTVEGGINQDGIDYYKRLINLLLENGIEPYVTIFHWDVPSALEEKYXGILDKTHKKIVNDLQNFAKVCFDNFGDXVKN

SEQ ID NO: 93854 - DNA, 827 bp, Zea mays
  misc_feature: Ceres CLONE 1583346
  misc_feature: Encodes the peptide sequence at SEQ ID NO. 93855
  misc_feature (579)..(579): n is a, c, t, g, unknown, or other
ggagctccccgcggtggcggccgctctagaactagtggatcccccgggctgcaggaattcgtctcacccctagaaaaactctgctttctctctctctctctctctctctctctctctctctctctacatacaaagtggaaaaaacgcacccaaaagaaaggctcacaccacccacctccatagcagcctactatcctctccttcctccattctctcgctatcttccccactccccagccaacaaatcgaccttgctgggaacgagagggctatagagcctggggagggcagcgcaacacgcgccacggagcagcggcggcggcggcggcggcagagcagtccgccgggagcagaggccgcgcgcgcagcgcaggcagccatgggcgcgccggtgaacggcgccgtcgtcttgttcctcctgctgctggctggaacgggggcggtgaccgaggagacggctccgcaggaacccacattgcccgccgccggctccggctccggctccggcgccggcgccggcgccgcggtcggggtcaactccaactccgtgctggtcgcgctgctcgactcgcactacancgagcttgcggagctggtgggagaaagcgctgctcctgcagacgctggaagaacgcgtcgggaaacacaacgtcaacatctttcgcgccccgaacgaaggcgctggaacgggacccgggacccggagttcaagcgctttctggtggaagccgcccaaactcaaggtcccttcaggggctgcttggtttacaagttccggcccttggggcttggccttcgggtttggggccccgggcccccaaccccca

SEQ ID NO: 93855 - protein, 149 aa, Zea mays
  misc_feature: Ceres CLONE 1583346
  misc_feature (67)..(67): Xaa is any aa, unknown, or other
MGAPVNGAVVLFLLLLAGTGAVTEETAPQEPTLPAAGSGSGSGAGAGAAVGVNSNSVLVALLDSHYXELAELVGESAAPADAGRTRRETQRQHLSRPERRRWNGTRDPEFKRFLVEAAQTQGPFRGCLVYKFRPLGLGLRVWGPGPPTP

SEQ ID NO: 93856 - DNA, 821 bp, Zea mays
  misc_feature: Ceres CLONE 1583347
  misc_feature: Encodes the peptide sequence at SEQ ID NO. 93857
aaagctggagctccccgcggtggcggccgctctagaactagtggatcccccgggctgcaggaattcgtctcacccctagaaaaaaagtctccccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggttcttgctcaggggctgatcgctgagggtgttaaggttgtggcagctggtgctaatcctgttcagattactcgtggtatcgagaaaacagcgaaagccctaggttgaagaactacggaagttgtctaaggaaggtccaaagatggtgagcttgccaaatgtgctggctgttagggcgggcaacaacttccaaaattggtaaatatgatagccagaagcccttgagccaagggtgggtccggaaa

SEQ ID NO: 93857 - protein, 162 aa, Zea mays
  misc_feature: Ceres CLONE 1583347
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALG

SEQ ID NO: 93858 - DNA, 855 bp, Zea mays
  misc_feature: Ceres CLONE 1583349
  misc_feature: Encodes the peptide sequence at SEQ ID NO. 93859
  misc_feature (575)..(575): n is a, c, t, g, unknown, or other
  misc_feature (598)..(598): n is a, c, t, g, unknown, or other
  misc_feature (706)..(706): n is a, c, t, g, unknown, or other
  misc_feature (758)..(758): n is a, c, t, g, unknown, or other
  misc_feature (855)..(855): n is a, c, t, g, unknown, or other
ctccccgcggtggcggccgctctagaactagtggatcccccgggctgcaggaattcgtctcacccctagaaaaactcccaaaaccctagcgctgcttccaccagccacccagatcccatggcgcgctcgacctcactctccgaggcggaggcgggcatctcctgctttgcctcctccctccctggattccgcggcgtcctcaagcaccgctatgccgacttcatcgtccatgaggttgcccgcgatggcgctctcgtccagctcacctcgttcgacctccccaccgagagcgttggtgtgaacgaagaggacaaggcggccccgtcggctgaagcggatcactcgcaggccctcgagtcgttccgttcgctctgcggcgatgccgattgcaacgcattgaggggtctcctggagaaggtgtcgggcgagggtggcggtgatgtctcgcctgtcattctatcgcctgatgccgacaaagcacaccgttcggaggtgcataacttctttaagaagaccttcaagttcctggtcacggacacggtggaacacagtgatggggtccagaagtgcatcanggtgcggttcgggtcagaagcangtgtcggaaggggtgctggcggccgtgggagaggaaggaaacggaagaacatgggtagttctgattggagagatggtaggccatttgatagtagagggtcaagtattnggccagataatgttgggaagttcttgaggtttcaccttgtacaagagaacanggacaccccagaagcattaggagtaaataggaaaatgctaggacttcagcacgggtcatttgggtttgcaggtaccaagggataagcgtgctgttan

SEQ ID NO: 93859 - protein, 241 aa, Zea mays
  misc_feature: Ceres CLONE 1583349
  misc_feature (153)..(153): Xaa is any aa, unknown, or other
  misc_feature (161)..(161): Xaa is any aa, unknown, or other
  misc_feature (197)..(197): Xaa is any aa, unknown, or other
  misc_feature (214)..(214): Xaa is any aa, unknown, or other
MARSTSLSEAEAGISCFASSLPGFRGVLKHRYADFIVHEVARDGALVQLTSFDLPTESVGVNEEDKAAPSAEADHSQALESFRSLCGDADCNALRGLLEKVSGEGGGDVSPVILSPDADKAHRSEVHNFFKKTFKFLVTDTVEHSDGVQKCIXVRFGSEAXVGRGAGGRGRGRKRKNMGSSDWRDGRPFDSRGSSIXPDNVGKFLRFHLVQENXDTPEALGVNRKMLGLQHGSFGFAGTKG

SEQ ID NO: 93860 - DNA, 809 bp, Zea mays
  misc_feature: Ceres CLONE 1583350
  misc_feature: Encodes the peptide sequence at SEQ ID NO. 93861
  misc_feature (737)..(737): n is a, c, t, g, unknown, or other
  misc_feature (738)..(738): n is a, c, t, g, unknown, or other
  misc_feature (750)..(750): n is a, c, t, g, unknown, or other
  misc_feature (809)..(809): n is a, c, t, g, unknown, or other
ctggagctccccgcggtggcggccgctctagaactagtggatcccccgggctgcaggaattcgtctcacccctagaaaaaaagtttcaacgggcaggtgcttccattcccctccgtctccctatatatatttggagttgcccgcgtgaccaactcacacataagaggcgacatcacatcgcgttccgccgcctcacacgctagttggagctgtagtattagccaaccagccagcctccgatctccatccatatggaggaggctgcgcccgcggcggtcatggagcgggagcgcctcacggccgagatggccttccgcggcgcggacgaagctcggcgggaaggcggcgacccggcgcccagcatcgtcatcaagatccgccgccggctcccggacttcgcccgcaacatcaagctcaagtacgtgaagctcgggatccgccacggcggcagccccacgtcgctgctgccggcgctctgcgtgccggcggtcgccgccgccgcctactcgttcgtccgcctcgacgtcatctactactccgtcgacctgctcacctgcgtcgcctggctcggcaccgcgctgctgctgctcaccgtctactacctcaagcggccccgccccgtgtacctcgtcgagttcgcgtgctacaagccggaagagcggctcaagatctccaagtcggccttcctcgagatgaccgagagcaccggctccttcaatgaggcggctctggacttnncagacaagatcnacagccgctccgcgctcggggacgagacgtacctgcccccgggcgtcaggcgcgcccgn

SEQ ID NO: 93861 - protein, 186 aa, Zea mays
  misc_feature: Ceres CLONE 1583350
  misc_feature: SWISSPROT Homolog: EC 2.3.1.119 Icosanoyl-CoA synthase
  misc_feature (162)..(162): Xaa is any aa, unknown, or other
  misc_feature (163)..(163): Xaa is any aa, unknown, or other
  misc_feature (167)..(167): Xaa is any aa, unknown, or other
MEEAAPAAVMERERLTAEMAFRGADEARREGGDPAPSIVIKIRRRLPDFARNIKLKYVKLGIRHGGSPTSLLPALCVPAVAAAAYSFVRLDVIYYSVDLLTCVAWLGTALLLLTVYYLKRPRPVYLVEFACYKPEERLKISKSAFLEMTESTGSFNEAALDXXDKIXSRSALGDETYLPPGVRRAR

SEQ ID NO: 93862 - DNA, 1119 bp, Zea mays
  misc_feature: Ceres CLONE 1583351
  misc_feature: Encodes the peptide sequence at SEQ ID NO. 93863
ggagctccccgcggtggcggccgctctagaactagtggatcccccgggctgcaggaattcgtctcacccctagaaaaactcccaaaaccctagcgctgcttccaccagccacccggatcccatggcgcgctcgacctcactctccgaggcggaggcgggcatctcctgctttgcctcctccctccctggattccgcggcgtcctcaagcaccgctatgccgacttcatcgtccatgaggttgcccgcgatggcgctctcgtccagctcccctcgttcgacctccccaccgagagcgttggtgtgaacgacgaggacaaggcggccccttcggctgaagcggatcactcgcaggccctcgagtctttccgttcgctcgtgcggggatgctgattgcaacgcattgaggggtcttcctcgagaaggttgtctggcgagggtggccggtgatggtctctccctggtgactcctatcgccgtggagggcgcaccaaaggcgctactggttcgggagggggcaactaacttttctgttaagggaagaactgtgtaaagggttggctgggtcccccggggatgaacggtgtagaaaccacctgttcggactgggggggttctccgggaatgtgttgcctttccggaggggtgggcgggtctcttccggtgagcgtcgggagaatggtacggggttggcgacaggaagaactggggggggttgttataggcagacgggccgccctgggtgtggatcctaagggacaagggtctataccgcgggtacgctcaagattctggctgggtgagctctctcccagcaactttggcgaaagtcacacgggggcccagtgcacccacatatgtgtgactataggtctatacatggggcgtctagacccctactctttggcggcactcgcttctatatggggcggggggcagagtggttgtcccatcaggggggtcttatccccttgttgtctagaagttgtacaaaccaaagggaggctgcgggcgagtagtatgtcccattacgccgccagtcacattcggacgagatctctcgtttggattttttgaaaggtgttgaatgctaatttttccgtttattggaggtgcggccg

SEQ ID NO: 93863 - protein, 89 aa, Zea mays
  misc_feature: Ceres CLONE 1583351
MARSTSLSEAEAGISCFASSLPGFRGVLKHRYADFIVHEVARDGALVQLPSFDLPTESVGVNDEDKAAPSAEADHSQALESFRSLVRGC

SEQ ID NO: 93864 - DNA, 807 bp, Zea mays
  misc_feature: Ceres CLONE 1583352
  misc_feature: Encodes the peptide sequence at SEQ ID NO. 93865
ctccccgcggtggcggccgctctagaactagtggatcccccgggctgcaggaattcgtctcacccctagaaaaaattactgacaggcgccagagagagagaccacaactcctcgagacaccacaagggcaagggaggcgcgctcctctcgcctcgcctcgcctcccccggggaagaagaggaggagagggagctgagcagcagccggccgacgcgggaatgctcgtcggcggcgggcgggacgacgaggaggtgctccggaagctcaagagcatggacgtggacaagctggagaacggcggaggcggcggcgacgcggagagcccgcgccccgtcgtcaagtaccacggctggaaggccatgcccttcatcatcgggaacgagacgttcgagaagctgggcacgctgggcacgtcggccaacctgctggtgtacctgacgcaggtgttccacatgcggagcgtggacgcggccacgctgctcaacgggctcaacggcaccaccagcctcgcccccatcgtcggcgccttcctctccgacgcctacctcggccgctacctcgcgctcgccatcgcctccatcgcctccctcatcggcatgttcctgctgacgcttacggccggcgcggacagccttcacccgccggagtgcggcgtgggcgaggcctgcgagaaggcgacgtcgtaccagttcgcggtgctcttcgtcgccttcgcgttcctggtgctgggctcggcggggatccgcccctgcagcatgcccttcggcgccgaacagttcgaccccacacggagtccgggcagcgcgt

SEQ ID NO: 93865 - protein, 196 aa, Zea mays
  misc_feature: Ceres CLONE 1583352
MLVGGGRDDEEVLRKLKSMDVDKLENGGGGGDAESPRPVVKYHGWKAMPFIIGNETFEKLGTLGTSANLLVYLTQVFHMRSVDAATLLNGLNGTTSLAPIVGAFLSDAYLGRYLALAIASIASLIGMFLLTLTAGADSLHPPECGVGEACEKATSYQFAVLFVAFAFLVLGSAGIRPCSMPFGAEQFDPTRSPGSA

SEQ ID NO: 93866 - DNA, 829 bp, Zea mays
  misc_feature: Ceres CLONE 1583353
  misc_feature: Encodes the peptide sequence at SEQ ID NO. 93867
tggagctccaccgcggtgggcggccgctctagaactagtggatcccccgggctgcaggaattcgtctcacccctagaaaaaatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtctagtagtagtagtagtaatttcatgtacgaagctccccttggctacaagatcgaggacgttcgcccagccggaggaatcaagaagttccagactgctgcttattccaactgcgtccgccagccatcctgatatcgcctcacatgcaattcgcggtagagtaggattttaattcagttttcctcttgtgtcggtagttttccgttggctctggctgccttcctctgcttctgagattccaacttgtcttgcccatctctcctttttctctctcatcctctctttcttgcaacacgtcatccagtggcgatgtcttcagcagattcttgtgtctcttctcctggcctcccctattggctttgagggctatgagaagcgcctcgagatcacgttctctgacccgcctgtcttttgaggccccttgtgggccggccctgggcgcccctctccggggagcaaatcgactccgtttctggatcttccaggggggcacctaaggggccaagctttcccaagcagagacttcaaatccaaatggttta

SEQ ID NO: 93867 - protein, 51 aa, Zea mays; identical to SEQ ID NO: 45852
  misc_feature: Ceres CLONE 1583353
  misc_feature (1)..(51): Pfam Name: AdoMetDC_leader Pfam Description: S-adenosyl-l-methionine decarboxylase leader peptide

SEQ ID NO: 93868 - DNA, 1265 bp, Zea mays
  misc_feature: Ceres CLONE 1583354
  misc_feature: Encodes the peptide sequence at SEQ ID NO. 93869
  misc_feature (5)..(5): n is a, c, t, g, unknown, or other
  misc_feature (6)..(6): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (54)..(54): n is a, c, t, g, unknown, or other
  misc_feature (57)..(57): n is a, c, t, g, unknown, or other
  misc_feature (59)..(59): n is a, c, t, g, unknown, or other
  misc_feature (71)..(71): n is a, c, t, g, unknown, or other
  misc_feature (1081)..(1081): n is a, c, t, g, unknown, or other
  misc_feature (1117)..(1117): n is a, c, t, g, unknown, or other
  misc_feature (1218)..(1218): n is a, c, t, g, unknown, or other
atatnnaaannnggagnnataggggacaatgtctctccccctctacatcaagcnaanancggtgcgttggncaaaactggagctccccgcggtggcggccgctctagactagtggatcccccgggctgcaggaatgcgtctcacccctagaaaaatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtctagtagtagtagtagtaatttcatgtacgaagctccccttggctacaaagaatcgaggacgttcgccccagccggaggaatcaagaagttccagactgctgcttattccaactgggccccccagccatcctgatatcggctcacatgcaattcgccggcaaaggaggaattttaattgccgttttgcctccttggggtccggtaacattttcccgtttgggctcatggggggagcatgcctctgggctttctggagaaattcaccaaccttggctctttgcgcccatcccccccacccttgttttccccgcccacacaaacaccacgtccgtgttacatgtggcagaaaaaccctcctcaattccaaaaactgtgcgagaagcggcacgctttcatcccgtaacaagaatgctagctcaggggaggggatcaaatcattatacacgcgccgcagtgagccgatatacgcccacgcctcaaaatatttgtgcgactacctttcgcgccaaggaggtggtccttttgcttttcacgagagaaaggaggcttcaccacctcagtctcgaacggggatatgtgagcatgcacgctcttcacttcccttgtaggaaaccgcgacccccccacgaggatgtcacgtttggggagggagaaacaccacctgatgttatagtgcaccccaatagaagatctcccgtggagtcgtagatagaacagtntcttgaacgggggagtaggaggcagagaaacaccanacaccccccggctacgcatactgggttatctctggtgagagagggggtggggcgccgacatgatgagtgtgttaaccagacgctcgttttctatcccaacncgaggagaacctctctactactcaatcaatagtctgctcctccagca

SEQ ID NO: 93869 - protein, 52 aa, Zea mays
  misc_feature: Ceres CLONE 1583354
  misc_feature (1)..(52): Pfam Name: AdoMetDC_leader Pfam Description: S-adenosyl-l-methionine decarboxylase leader peptide
MESKGGKKSSSSSSNFMYEAPLGYKESRTFAPAGGIKKFQTAAYSNWAPQPS

SEQ ID NO: 93870 - DNA, 837 bp, Zea mays
  misc_feature: Ceres CLONE 1583356
  misc_feature: Encodes the peptide sequence at SEQ ID NO. 93871
  misc_feature (799)..(799): n is a, c, t, g, unknown, or other
  misc_feature (800)..(800): n is a, c, t, g, unknown, or other
  misc_feature (802)..(802): n is a, c, t, g, unknown, or other
aaagctggagctccccgcggtggcggccgctctagaactagtggatcccccgggctgcaggaattcgtctcacccctagaaaaaggtggtgccttctgaatgtgtgtcatttgatttggtagtattgcaaaaagttgtgtcccccgaccccgaggccccgaccccgagacggtcgacgcatcaaacccactccctcgtccaacttgctcccaaatccaaacgacaaaatgctcctcgctgcggtttgatcgaggccgcggccccccgaaccctcgcctccccctcccgccgccgtcatggacgacgaccgcgaccacgaccaggaccccgatgcgtcgtcgccggccgcgccgtggcggcggtccgtgaagcggaagctgggcgcggaggcgggggacgaggcgggccccgcggcgcgggtcgaggcggaggacgagcgcgcggcgctgcgggaggcggcggcggcagcccagtccacggcgtcggcgctgcgggccgaggtcgaggaggagcgactcgccgcggccagcgccgccagcgaggccatggccctgatgctccgcctgcagcgcgacaaggccgaggtccagatggagctccgccagttccgccgtttcgccgacgagaagatggcgctcgacgccgccaaaatcgtacagctgcgcgcgctcctcgcccagagagcgcgacgcctgctgcgcctgcgctccaagctccgcgagtacaggctgcagtgcctgcacctcggcatcccgcttcccgatggcgatgacctcgtcgccagaacgccacccagaanntngtaaaagaagaaggaccccctccggctcgaggggg

SEQ ID NO: 93871 - protein, 167 aa, Zea mays
  misc_feature: Ceres CLONE 1583356
  misc_feature (48)..(141): Pfam Name: DUF593 Pfam Description: Protein of unknown function, DUF593
MDDDRDHDQDPDASSPAAPWRRSVKRKLGAEAGDEAGPAARVEAEDERAALREAAAAAQSTASALRAEVEEERLAAASAASEAMALMLRLQRDKAEVQMELRQFRRFADEKMALDAAKIVQLRALLAQRARRLLRLRSKLREYRLQCLHLGIPLPDGDDLVARTPPR

SEQ ID NO: 93872 - DNA, 968 bp, Zea mays
  misc_feature: Ceres CLONE 1583357
  misc_feature: Encodes the peptide sequence at SEQ ID NO. 93873
ggcggccgctctagaactagtggatcccccgggctgcaggaattcgtctcacccctagaaaaaactcgcacggacgagcgaggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcgaagtcggagcgagcgaggatgggcggcggcaacggtgaaaccacccagcctgggggagccactgctggcgaagaaggccaaggcgtaccgccctaggtgccccggctgccgggtggaccgcctcaacggggagcgtgaagggggttttcccccctcaggggacctcttccttatctgggctcggtcaccgtctccgtgcatcctgatcgatccaggtctctggttccgccgggcctgggatttgcattgagtaagggaatctggccgtatctgcgtgatctagaacacgcggacgggttgggaattttttggggcccgggctcttggtgggggggcgcagccttagtgggggcggggggggagggggtgggggcccggaggtggaatgtgggggggtgggtgggaaactcaaaggagggttgaagttttcacggtgggggaggagggtagacccggcgttattgtggtgggcgggacgcctcggagagggggctgagggcgagggattctatatgtggcctcggtggcggttggccgcttagggcgccccgccgtcttgctagccgttatttggccgctgtaattggtgtggtgggcggatgcgcgggcggggaggttagcgccgggtggtgcgtatctcttccttccactccccgatacggaggtgctgcccggcagggctggctgatcactcgacgaagtgttattagccggattactcgtggcgtt

SEQ ID NO: 93873 - protein, 162 aa, Zea mays
  misc_feature: Ceres CLONE 1583357
GGRSRTSGSPGLQEFVSPLEKTRTDERGSPAGRSHNPSAAICLRSGSAPALPPPSIPPRGAAECRRRPRRSFWFLGWISRSRSERGWAAATVKPPSLGEPLLAKKAKAYRPRCPGCRVDRLNGEREGGFPPSGDLFLIWARSPSPCILIDPGLWFRRAWDLH

SEQ ID NO: 93874 - DNA, 808 bp, Zea mays
  misc_feature: Ceres CLONE 1583360
  misc_feature: Encodes the peptide sequence at SEQ ID NO. 93875
  misc_feature (176)..(176): n is a, c, t, g, unknown, or other
tggagctccccgcggtggcggccgctctagaactagtggatcccccgggctgcaggaattcgtctcacccctagaaaaagccgtcgcttcctctgcctccctggcccttcggcttggctcggttctacgcgtatgctgcccttgcggcaaacgcaacaacacggagcgggcgtggnggagcggagcggtgagcgaggatcgagggcaacgtggcgaggggcactcccgaagggggagaggcgactttgcttccagttccaggaaagagtgggctataaaaaggcgctcgagatccagatctgggccgatgcgaccgccctcgctgctctccctcaccctcgacgccgcgctcctccgcatcgccaatatcgccgacctctcccacctcccagaccacctcctcatcgatctcttccgtgtgaaatcatatcacagtcacagcctcacaggagtgtgcgggctgatttcctcttatgcttatgctgcagaggattcaacattagaacacattttgtaatgtgctcttgcatttttattgcagagaaccctcagtgctggtaagctgacagagaaagttctcaagttgtttctagcaaccgactgtgaggatatcatattgggctggtcgggtgctcaacattagcaggcactcgtaccagtccttcccaacaggtgctctgagagattctagacctgctgccgctcactcgttttgattactggagagatgcctttggaaatccagaatatgaggttgacattgggattgcggaactccgcccaacttggacactttctttgagcatgg

SEQ ID NO: 93875 - protein, 69 aa, Zea mays
  misc_feature: Ceres CLONE 1583360
MRPPSLLSLTLDAALLRIANIADLSHLPDHLLIDLFRVKSYHSHSLTGVCGLISSYAYAAEDSTLEHIL

SEQ ID NO: 93876 - DNA, 839 bp, Zea mays
  misc_feature: Ceres CLONE 1583361
  misc_feature: Encodes the peptide sequence at SEQ ID NO. 93877
caaagctggagctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactaacgtggcccgtggggaacaagttcggctcctgtcacgccgactgctgctgctgccggcgaacgcgaggatcctggggtcgcggcatggcgagcgagagatctcgacgaggccatctcgtcgctgttcctgtttcccactgggcaacgctaccgaaaaggagctggagacggggcgtcgccgcctgcgaacataatggtggcaagcgccgccaa

SEQ ID NO: 93877 - protein, 148 aa, Zea mays
  misc_feature: Ceres CLONE 1583361
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICY

SEQ ID NO: 93878 - DNA, 809 bp, Zea mays
  misc_feature: Ceres CLONE 1583362
ggagctccccgcggtggcggccgctctagaacgcggggatccacacggctggatgaattcgtctcaaccctggaataaatctctttctatacatcctccggtccgcggactttcgcatcttggccgacttgttagcctccctgccccagcccttgcgccgccacctctgtggaagagttcatgcaccataggtggcgtacgtgtcctgcgcctgaccgacgtgcactaatgcaggcacgcacatagagaccgacagagagtccaacacaccggagggtctccgcggaggtggcataccccacgacgtggatcccagctctggtctgcggttgatctgcggcggcccgtaagatgtacatgaaagattgcggtcaggctgccgcccgcttgctggaccactccatcatggcgggggacctgcccgaggacagcgaacatgtctgctatcacgatcaggactgccctgggcaccgtgaacgtcctgagcttcatcagtcttgccacgatgactagctcaatctcgactgatctacacgtgctcttcgtggaggggacccgccacaacgacaaaccagcctaggatcgccaaatccgcgtaaaccctgcaccggtagatggggatcccccggcccacacctcttgctgatgatcgtgaagatgctccgagcggggttccctgagctcccgggaacggggaacgtcatcgataaatctcggggagaaaggaaaaaacaaatctcccttaccggatgggggaccctggactttcctcggggcaaatttctaatcagtgggaaaagggaggggga

SEQ ID NO: 93879 - DNA, 795 bp, Zea mays
  misc_feature: Ceres CLONE 1583363
  misc_feature: Encodes the peptide sequence at SEQ ID NO. 93880
agctcaccgcggtggcggccgctctagaactagtggatcccccgggctgcaggaattcgtctcacccctagaaaaactttgggagaaggggatctgaactaggtccaactcatgttttagttgttcgtggcttggatgaaaatgctgatgaggaaatgcttcggtacgaatttgctaagcacgcaccaataaaggacatccgccttgttcgggataagtttactcatgtgtctagaggttttgccttcgttcatttccattcggtggaagatgctacgaaagctctggaagctacaaacgggattacacttgagaaaaacggtcaggttttgcgtgtagcatatgctaaaagtacacatggacctgcatcagggggttctcagtcaaacagccttgctgcagctgccattgaggctgcatcatttgctcagcagtatgatgccataggttgggctccaaaagagtacaatcctgatgacaaacagaacaacaactctgaatctcaaaaagatggcagcacagcacagtcgggatttgtttgggatgaaaaatctggttactactatgattctgcatctggattctattatgatggaactactggcctttactatgacagcaactctggagtttggtattcatatgatcaacagactcaacaatatgtcccttgtaatgaccagagcaacactaaggcagccggggaggcggccagcgaaaacacgaaaacctcagatagtaatagtggcaaaaagggtgtgatctctgcgcctgctgcacaattaaacaaagtgt

SEQ ID NO: 93880 - protein, 213 aa, Zea mays
  misc_feature: Ceres CLONE 1583363
  misc_feature (1)..(61): Pfam Name: RRM_1 Pfam Description: RNA recognition motif. (a.k.a. RRM, RBD, or RNP domain)
MLRYEFAKHAPIKDIRLVRDKFTHVSRGFAFVHFHSVEDATKALEATNGITLEKNGQVLRVAYAKSTHGPASGGSQSNSLAAAAIEAASFAQQYDAIGWAPKEYNPDDKQNNNSESQKDGSTAQSGFVWDEKSGYYYDSASGFYYDGTTGLYYDSNSGVWYSYDQQTQQYVPCNDQSNTKAAGEAASENTKTSDSNSGKKGVISAPAAQLNKV

SEQ ID NO: 93881 - DNA, 851 bp, Zea mays
  misc_feature: Ceres CLONE 1583365
  misc_feature: Encodes the peptide sequence at SEQ ID NO. 93882
aaagctggagctccccgcggtggcggccgctctagaactagtggatcccccgggctgcaggaattcgtctcacccctagaaaaactttgggagaaggggatctgaactaggtccaactcatgttttagttgttcgtggcttggatgaaaatgctgatgaggaaatgcttcggtacgaatttgctaagcacgcaccaataaaggacatccgccttgttcgggataagtttactcatgtgtctagaggttttgccttcgttcatttccattcggtggaagatgctacgaaagctctggaagctacaaacgggattacacttgagaaaaacggtcaggttttgcgtgtagcatatgctaaaagtacacatggacctgcatcagggggttctcagtcaaacagccttgctgcagctgccattgaggctgcatcatttgctcagcagtatgatgccataggttgggctccaaaagagtacaatcctgatgacaaacagaacaacaactctgaatctcaaaaagatggcagcacagcacagtcgggatttgtttgggatgaaaaatctggttactactatgattctgcatctggattctattatgatggaactactggcctttactatgacagcaactctggagtttggtattcatatgatcaacagactcaacaatatgtcccttgtaatgaccagagcaacactaaggcagccgggggagcgggcagcgaaaacacgaaaacctcagatagtaatagtggccaaaaagttgtgatctctgcgcctgctgccacaattaaacaaagtgagaaaacttcacttcctgacgctgttcaagctgctgcaaatgctgcat

SEQ ID NO: 93882 - protein, 229 aa, Zea mays
  misc_feature: Ceres CLONE 1583365
  misc_feature (1)..(61): Pfam Name: RRM_1 Pfam Description: RNA recognition motif. (a.k.a. RRM, RBD, or RNP domain)
MLRYEFAKHAPIKDIRLVRDKFTHVSRGFAFVHFHSVEDATKALEATNGITLEKNGQVLRVAYAKSTHGPASGGSQSNSLAAAAIEAASFAQQYDAIGWAPKEYNPDDKQNNNSESQKDGSTAQSGFVWDEKSGYYYDSASGFYYDGTTGLYYDSNSGVWYSYDQQTQQYVPCNDQSNTKAAGGAGSENTKTSDSNSGQKVVISAPAATIKQSEKTSLPDAVQAAANAA

SEQ ID NO: 93883 - DNA, 1152 bp, Zea mays
  misc_feature: Ceres CLONE 1583366
  misc_feature: Encodes the peptide sequence at SEQ ID NO. 93884
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
ttttttttctttnnncccgggggtggtggagggggtgtgggacccacaccccccaatattatttggggggggcaaagctggagctccccgcggtggcggccgctctagaactagtggatcccccgggctgcaggaattcgtctcacccctagaaaaataattcttgcgccccgccttcttcctccaggagccccgctcgttcttccggcctcgcgttccgtctcctaagccgcaggcagccatggaaatcaacgaggatgcaatggcggcgcataaacgcgccttcctcgacttcctcgaccaagacgtcgggaagggggtttacatgcatgccgtccgcgacatggtccagaacaagcgccaccgcctcatcatcggcatggacgacctccgtaatcacaatctcgatctcgcccgcagggtgatccggaccccgggggagcatatgcagccggcgtcagacgcggtgtcggacgtggcataggaacctggatcccatgttttttgaacgaagggggagcgcggtgatggctgggctttctcctgggtcaaggtcggggttccacaggggggcacggcctaaggggaatccccaaggtcccctcccttcaatcaggccacccagtgggttctggggtttggaaggggccctaccccctcccaaaaatgtgcttccggttggggttttagggggcccaaaaaagcggttgctttatatgaatttgggcccccacccttgttttggtcccccctcgggtggaaatcctgggggggggaaactcttctcctctttttctcgcgctggtggtataataaaaccgagggggaaaaaattcgaacaatttttcctttttgttggggtaaaagccctcttggtcgccagataacaagggtgcttgcccggtgtttcattttcgccaaatagtggggggggggagcggttacccatctggggggccaaccccctcggggtttgggggctgtaccccggagggttatgtggcgcactcgtggggccgagaaataaactatggggatgtccacccaccaagacacattgggctctcctctagcccgataataaagggggccgcggaaaataaaagtgcgcggcaactccgcggataacagcgcttgccccaagaagaaggg

SEQ ID NO: 93884 - protein, 80 aa, Zea mays
  misc_feature: Ceres CLONE 1583366
MEINEDAMAAHKRAFLDFLDQDVGKGVYMHAVRDMVQNKRHRLIIGMDDLRNHNLDLARRVIRTPGEHMQPASDAVSDVA

SEQ ID NO: 93885 - DNA, 834 bp, Zea mays
  misc_feature: Ceres CLONE 1583367
  misc_feature: Encodes the peptide sequence at SEQ ID NO. 93886
  misc_feature (806)..(806): n is a, c, t, g, unknown, or other
acccgcggtggcggccgctctagaactagtggatcccccgggctgcaggaattcgtctcacccctagaaaaagccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctgttcagattactcgtggtatcgagaaaacagcgaaagcactagttgaagaactacggaagttgtctaaggaggtcgaagatagtgagcttgcagatgttgctgctgttagtgcgggcaacaactacgaaattggtaatatgatagcagaagcatgagcaagtcggtcggaaagggtgtggttacctcgaagaangggaggagtctgaaaacttctctatgtt

SEQ ID NO: 93886 - protein, 198 aa, Zea mays
  misc_feature: Ceres CLONE 1583367
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKEVEDSELADVAAVSAGNNYEIGNMIAEA

SEQ ID NO: 93887 - DNA, 858 bp, Zea mays
  misc_feature: Ceres CLONE 1583370
  misc_feature: Encodes the peptide sequence at SEQ ID NO. 93888
aagctggagctccccgcggtggcggccgctctagaactagtggatcccccgggctgcaggaattcgtctcacccctagaaaaaacaccaccactccctcactgccctctcactcccgatccctgcaccactaccgcctcctccgcttcacccctctcgtcgcctcttgcagcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagaattggtgcagatggatcaaaggctactggtgccttcatcttgacagcgagccataacccagggggtcctacggaggactttggtatccaatacaatatggggaaatgggggaccggcccctgaatcccggtaccgacaagattttccccaatacaacgacaatcctctgaatcccccacctctgaaaaaccttcccgagggtggaaatttccgggtgggcgggggccacccggctctcaggtggaccccgaagggcccctgtggagggggggaaggtccttttgacccctggggggaaaattcaccctaaaaggtgtaatggaaaaagg

SEQ ID NO: 93888 - protein, 147 aa, Zea mays
  misc_feature: Ceres CLONE 1583370
  misc_feature (16)..(147): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFEGQKPGTSGLRKKVTVFQQPHYLQNFVQSTFNALPADQVKGATIVVSGDGRYFSKDAVQIITKMAAANGVRRVWVGQNSLMSTPAVSAVIRERIGADGSKATGAFILTASHNPGGPTEDFGIQYNMGKWGTGP

SEQ ID NO: 93889 - DNA, 1234 bp, Zea mays
  misc_feature: Ceres CLONE 1583371
  misc_feature: Encodes the peptide sequence at SEQ ID NO. 93890
  misc_feature (11)..(11): n is a, c, t, g, unknown, or other
  misc_feature (18)..(18): n is a, c, t, g, unknown, or other
  misc_feature (47)..(47): n is a, c, t, g, unknown, or other
  misc_feature (48)..(48): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (774)..(774): n is a, c, t, g, unknown, or other
aataaataaanttttttntgtggggggtttgcagcaccaacgcgtcnnttnntnttnnnnnnnnnnnnnnnaaaaactggagctcaccgcggtggcggccgctctagaacagtggatcccccgggctgcaggaattcgtctcacccctagaaaaaatgagcaagcagccgacgaattacttctgcaagacgctgactgcgagcgacaccagcacgcacggcgggttctctgtgccccgtcgtgcggccgagcgcgtcttccccccgctggatttcacacagcagcctccagcacaggagcttattgcacgggatattcatgatgttgagtggaagttcaggcatatcttcccagggcagcccaaaaaacacctgctgaccactggctgggagtggggttgtcagggctaaaaaacaccgtgctggagattccccccccccccgcgggggggggggggcacccgctttttgcttgggagcagaaaaggttactcgggcaccgaaaggggaggccccccctccgggtgttttcggagtgacaaacaaggtatcatggggaaaactcttccaaagagcacacctaatgactttcttgctactaaaatacgggcgggccaaccgcgaattcgccctacaaaagcgtcatcgggagacaacgtattcccctcccacacatttggggcaaacacccccccccttacccaccgtgtgacaaggtcacgcgggggatgcgtttgactgtttagacaccctgcccgtcgcatgtattcatatnctttaggagtaaggagaagggaagagacacacgcggtcctgagtagggcgcttgtttcctggggtactgactcacgctcaaagtaaacaaatctgaaatactgattcaccatatgacagggcagctagtactagtaactgatgggggaggagagacgaaaccgagtgagaaacctgatcgctaatcgcagaggtgagggagcaacgccgcccgcgggggtgctccgcgcgtgcctcctcacgctgctccccggagcatcaggggtagaaaaggcgactgagccgacctagtatagtggagcgagcggagggaagtcctgagtggtggggctggaggaggaaacggggagctcgggacagggaacctaagtcgcgtcgcgtcaccgcaagatagagctgtgagcgggcagacctaaataacagcggtaaaattacgtaaatcgggagcacgctggaggcgg

SEQ ID NO: 93890 - protein, 84 aa, Zea mays
  misc_feature: Ceres CLONE 1583371
  misc_feature (8)..(85): Pfam Name: B3 Pfam Description: B3 DNA binding domain
  misc_feature: The sequence is a functional homolog of SEQ ID NO 1186 in the 10/666,642 US patent application
  misc_feature: The sequence is a functional homolog of SEQ ID NO 398 in the 10/666,642 US patent application
MSKQPTNYFCKTLTASDTSTHGGFSVPRRAAERVFPPLDFTQQPPAQELIARDIHDVEWKFRHIFPGQPKKHLLTTGWEWGCQG

SEQ ID NO: 93891 - DNA, 1014 bp, Zea mays
  misc_feature: Ceres CLONE 1583372
cccgctggagctcaccgcggtggcggcgctctagactagtggatcccccgggctgcaggaattcgtctcacccctagaaaaatttttaatctggtgccctcagttttggtgatgtgttcatttataccccttgtttacttcaaatcagattttgtatgatagtgttattgtgccaattctacctcctgtaacccaaaggtcctagcgaaaggccttactctcagcaggacataaacggatactaacagttaggagagagtacaaccccatccctcgtttgtcttgagctggtagttgtacctttagctcatgacggggtgggcctgcctggctaccctattagcggtcaaacaataaccctaaaaggtattattatgtatgagcatcacaccctacaggttcttaaatacacctcgaccgataaaaaccaagacaatacaacacatttttagtcgaaaattgcatatataccatcataattaaagagactaaaattatactataacaatttttcccattcactgtgagaaatagtaaggacttatattataaaataagacttataagaaaacaataagtgaaccgtaggaagtgaacttgtaaaacttagttaacccaccaacagacgtctcctctttaatcacaaaaaaaataataagtgtagaatacgaccaccgacgagcacatcttatccgatcagccttagagaggatagatatgaaaggtattcttgtaatcgaatccactctgccaatgtgtagaaaaacgacacaattcaactcgtcacaaactcatcaatgacgttgcacaatcatcacatgaacagtctgtccccttaatcgatgaatctgcttccgatgtaaatctccactaatactattaacaataaaccgcaatcaattactgacaattatgatcaattagttcaattatgctatgctgaccacaacccgtagaaatgtctggatgtagttccatgcgatctagaggacagaaataaccacctcccacacg

SEQ ID NO: 93892 - DNA, 797 bp, Zea mays
  misc_feature: Ceres CLONE 1583377
  misc_feature: Encodes the peptide sequence at SEQ ID NO. 93893
aaagctggagctccccgcggtggcggccgctctagaactagtggatcccccgggctgcaggaattcgtctcacccctagaaaaaacatagcgacccatactctctcccgctattgtttatacttccttctctcctgccaagccttgcattgctccctcaccttctctcaatgtcaggcgcgcgcggcccgacaacgcgcctcgtgcccgtgccgcccctggatcgagctctcggatcctcgtacatactcgacgacctgctcgctggacctctttcgcgattttctgctcccattaggagaccctgaatctccggacctcgatccggatatatcaccggaccacctactcctgtgtcggcgtgtacaagaacacgacatgtcgagatcatctatcaatgaccccgcaacctgtatcacaccctcatgcgttgccatcacctatacctacatgctcctccgtgaagctgcattcaacccctgttccctcaacactaaaaggaccatctttgacggcaagcatctcatcttacagaattcgcgtactacgaactccaaatggacatgagacttgctccctacaaaatgatgctctaggacggcgagtcctacattcatgtcaagatcgcagatcgtgacaacaaagtcttctgccctgaggagatctctgcgatgactcttgtcaagagtaaagatactgctgatgcatatcttgcacagaacatctctgatgctatcatctctgtatcctgcctacttcagagcagcgcatatgcatgcaccaaagtatgctggtggt

SEQ ID NO: 93893 - protein, 42 aa, Zea mays
  misc_feature: Ceres CLONE 1583377
MTLVKSKDTADAYLAQNISDAIISVSCLLQSSAYACTKVCWW

SEQ ID NO: 93894 - DNA, 820 bp, Zea mays
  misc_feature: Ceres CLONE 1583382
  misc_feature: Encodes the peptide sequence at SEQ ID NO. 93895
  misc_feature (448)..(448): n is a, c, t, g, unknown, or other
  misc_feature (449)..(449): n is a, c, t, g, unknown, or other
ctccccgcggtggcggccgctctagaactagtggatcccccgggctgcaggaattcgtctcacccctagaaaaagatggagctgtgagctgagctgagctgagctcaccaccaccacacacgggagatagctatagctagcatagcaagccagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggcggcacaccgcagcaccgtgttcccgcacaacatcccgcccaccttccccttcttcgtgggcgtggacccgcgcgtggtcgccatcgtggacgccgnncgcttcaccgcgctcttcgaccgggacctcgtggacaagcgcgacatcctcatcgggccctataacccgggcgccggcttcaccggcgggacgcgcgtcggcctgttacttggacccgccagaggaggaacccgcccccgtcaagaccttcccatgggaatccttcaacggtccgcccggacttggtcggccaatttcccggaaaggttgggcccttggtgaaacccggggaaccgaatttccgcaaggaaaacgccccaaaaaaaacccctccccaataaacttggcccccgtgaaaagagggatttcggggccccccaaaaggggtgtggggggccccacacccccccccaatgggtggggtgaaaatt

SEQ ID NO: 93895 - protein, 161 aa, Zea mays
  misc_feature: Ceres CLONE 1583382
  misc_feature: SWISSPROT Homolog: EC 4.2.1.92 Hydroperoxide dehydratase
  misc_feature (88)..(88): Xaa is any aa, unknown, or other
MLPSFVSPTASAAASVTPPPRPIPGSYGPPVLGPLRDRLDYFWFQSQDEFFRKRAAAHRSTVFPHNIPPTFPFFVGVDPRVVAIVDAXRFTALFDRDLVDKRDILIGPYNPGAGFTGGTRVGLLLGPARGGTRPRQDLPMGILQRSARTWSANFPERLGPW

SEQ ID NO: 93896 - DNA, 946 bp, Zea mays
  misc_feature: Ceres CLONE 1583387
  misc_feature: Encodes the peptide sequence at SEQ ID NO. 93897
aaagctggagctccccgcggtggcggccgctctagaactagtggatcccccgggctgcaggaattcgtctcacccctagaaaaacccacccagagctctgtagaagagaggggagaggaaggaccgaggaccaaccggagccccactcggccgccgcctctcacctccaccgactgcctgcgtcccaccgctcctgctgccgcccgttgctctcgtcattgaagccctcaccgcctccgcccgcttgcccgccctcccgtcggctgccttccggatgagaagcggcgcaacctgggcggtggaagcgtggtcggcctgagccttcgtgggggttagcgccgagaaggatcctggagattaagcgcatgggttccttggatgcccggtacaggccggccgggggcagctgaggacacagctaagagaaggacccagaaaagcaaaagtttcaaagagggtgagaaatttgatgtttttgtgctggagaaaagttctgggttgcaaattccggtcgttgcaactttttgctcttcgctaatatggtctggctggcgtttctaaccacatcctattacagcaccattcttgtggtatgaaacatcaagtttgcagttcaaggctcctccggctttggcccatggggggggaatactgggaactaaggagggagtttcggaatcccccgaaaaagtaattcttcttggcccgggcatttcaatgggggaggaatgttgatataaaaaggttttcccaaaaatctggaaagttttggtgtgaaacaaaaagccccaaggggtttgggacctctttgaatttttaaaacgggacgcggagttttggggtagtttgggcacacatttgccctccccacaaaaagaggattttttccgcgtgcataggggttggaggactgcccccagatgaaggcttttaccctcggcagaca

SEQ ID NO: 93897 - protein, 60 aa, Zea mays
  misc_feature: Ceres CLONE 1583387
MPGTGRPGAAEDTAKRRTQKSKSFKEGEKFDVFVLEKSSGLQIPVVATFCSSLIWSGWRF

SEQ ID NO: 93898 - DNA, 1015 bp, Zea mays
  misc_feature: Ceres CLONE 1583393
  misc_feature: Encodes the peptide sequence at SEQ ID NO. 93899
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (1010)..(1010): n is a, c, t, g, unknown, or other
tttttattttttttttttattttcgttgaaacagccccccccccgtttggtattggggtnnnnnnnnnnnnnnccaagctggagctccccgcggtggcggccgctctagaactagtggatcccccgggctgcaggaattcgtctcacccctagaaaaaacgtgtctcgcctcgagtcgtccctaatccgacgatgccttgttctactcctaaaaaaacccaaagatcctgactttctcttgctgctagcctcccttttcccttctcccttaatcgcactgttggaagctcttcgctgtcacccccacccacctccggcgctcttttttagcattttccttgggctctggactccaaaatcccagccttttgtttgcttctctgtctcctgctgattggtgtccccgggtccaggactcttgatttgctcctcgcgggggttcggtcccatggcggcagctgcgctggcaatggcagagcacgtggtggccgagctccgagtgaggtgtgagacgccgccgtcgatgctgcgcgaggtggccgtggagatggcccgcgagatgggcgcggggctggagaaggacggcgggagcagggtcaagatgctcctctcctacgtcgataaagctccccacaggggagaagaggaaggattattcctatgggattgggaccttaggaggaaacgaatttttccgcggtcttgaaaagtgcaaactagggtggggaaatgccgaaagccatggtcgtttggacccgtggacctcccggaaaaaagtccgggcattttccgcccaccatccttaataggtcaggggagacctcccttccggaaacctttttttggggttttccattggccctcctgagaattggggccccaagtttttgttttgaacccaatgtaatgaaaaaaatttgggggccctaacactttttccaaaaggcggccaagaagagcctgagaataaataggggggttaccccgggttttgtcggtttcccccaganggaat

SEQ ID NO: 93899 - protein, 85 aa, Zea mays
  misc_feature: Ceres CLONE 1583393
  misc_feature: SWISSPROT Homolog: EC 2.7.1.1 Hexokinase
MAAAALAMAEHVVAELRVRCETPPSMLREVAVEMAREMGAGLEKDGGSRVKMLLSYVDKAPHRGEEEGLFLWDWDLRRKRIFPRS

SEQ ID NO: 93900 - DNA, 826 bp, Zea mays
  misc_feature: Ceres CLONE 1583394
  misc_feature: Translation starting site: 197
  misc_feature: SWISSPROT Homolog: EC 1.4.1.2 Glutamate dehydrogenase
atgctggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacgtttgcaccgaaaagatctcctccatggttctcatcagatgcgtgagatcgctgaaccttaccttggcagcacgatcaggaatgctggtggtacgggccccgccttacttcaacgactctccaaaggcggggcccgaagggagccgggggggattgcctggcccacatgtggctgggtttcctcgaaggagccaaccgccggctgctattggcctaggggctttggaaagaaagggcacccacggcccggggaaaaaaaagggcctccccgtttgacccgg

SEQ ID NO: 93901 - DNA, 1308 bp, Zea mays
  misc_feature: Ceres CLONE 1583397
  misc_feature: Encodes the peptide sequence at SEQ ID NO. 93902
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (13)..(13): n is a, c, t, g, unknown, or other
  misc_feature (15)..(15): n is a, c, t, g, unknown, or other
  misc_feature (891)..(891): n is a, c, t, g, unknown, or other
  misc_feature (1079)..(1079): n is a, c, t, g, unknown, or other
nttttttnnaggncnttttcatgttttaatgtttagataggatttgtattatatggagtatcacacccctccaactggaactccccgcggtggcggccgctctacaacagtggatcccccgggctgcaggaattcgtctcacccctagaaaaaagcagcaactgcagtggccggcgcctaaccccgcgcgcctccgtctcccgctcctcttccgcgccccgcgctccggtcactgtagacccgcttcttcctccaggcttctgcggatctcgtgcagtgccgccactatgggagacgagacctcgacctccgttgctcctcaggagcaggaatccactgttgacgccctctgggagtgtcaagcaacagctctccagactggacctttcatccctccagactaaattgcccgaggtggaggtagaaccgatgggatgaagtttccacaaacttttggctgactaccccgtggcagcaatggctagggggaatttaggggtcaaagcgtttaaggaatcccggggacaatgtttgcaaaaaacggaaagttcaacttaggggcccaggcctcatttcccagaaaaaaaagggccggtcgtaacggggagggggagggggggatcttcccagaaatcaataagcactaaggagatcggatttattgtgttgtaaccaagaactcccctgaggcccataaacaccgtcggggtggggggatcgcaatggagagacgagggataatgtgcgacagttggtttggtgggtggttgtcgcgggggagaagcggactataacggcgtccggtaggggcgagccagaagcactgggatcggtgccccgtatacccgcaacagtggagagtattcgcgtagagaaatgtgatacaagagngcggagaaaagaagatgtagcgacacgaaccccccctcccggcactcagaagattattctgggaaaagaagggaggcgcaatcaagagaagggacatcctcactctgggtgagacatgagtcatcagttacattaaacgatagtcgcaatgtcgagacatagtatatctaatgggggaatacgagaanactgactctctgaaataaagctgtgcaagagctagatatcgtggatgagtataggtacacgacatatgaaatagatgttgggaatgtatgtcgatctatactgaaccagaagtcgaagtgtgtgatgtagtgagcgggagctgtcgatgggggcgtcgcgcgcccatgtagccgcacacagtgggtatgtgtggcagggagggagatagtaaattgtgcgtagaagaat

SEQ ID NO: 93902 - protein, 38 aa, Zea mays
  misc_feature: Ceres CLONE 1583397
MGDETSTSVAPQEQESTVDALWECQATALQTGPFIPPD

SEQ ID NO: 93903 - DNA, 849 bp, Zea mays
  misc_feature: Ceres CLONE 1583399
  misc_feature: Encodes the peptide sequence at SEQ ID NO. 93904
ctggagctccccgcggtggcggccgctctagaactagtggatcccccgggctgcaggaattcgtctcacccctagaaaaagcgacccgcgtgtgcttccgttccagctttccttccccaacagctcgacttcctccgcaagccgccgtgccagtcgccgccggccgcgatgggtagcagggtggcagcggcgctgatccggcggggcaggtacctggcatcctccctgctgacgcctcgtctgccgagaagcgccctcgctccggctccaccgcatagggttggatctgcctcctcctcttgcggcggcggcggcggcggaagctgcctcctcccgccaaggtctgggccagcgggggccttctcttacgcttcccggttcggcaacttccacgccttccgatccctcgctcccaaggccatgtttggccaatgcacaaggagaatgtcaactacggcgacagcactgaactcaactgtggccagtggagcagcaaattcaggattcaagctgcttgttacaaaaggggctcatgtgcaagaaggcggccggaaaatggctccttttggtggggctgccctgggggttcagcttggtcataccggggaagggattcttcgggttccacggtttcgggggctggcaaaggacggactgggaaattccccgggggaaaaatccccccaaggaaaaaaaaaaaatggggcgcggggattttgaaaaaaaaacaagcgccccccgggggaaaaaaagggggaaaaaaaggggaagggcccccagaaaatcccaatattttttcggggggaggggaagtccccccacaaattgggggagaaaaaactttgggtt

SEQ ID NO: 93904 - protein, 183 aa, Zea mays
  misc_feature: Ceres CLONE 1583399
MGSRVAAALIRRGRYLASSLLTPRLPRSALAPAPPHRVGSASSSCGGGGGGSCLLPPRSGPAGAFSYASRFGNFHAFRSLAPKAMFGQCTRRMSTTATALNSTVASGAANSGFKLLVTKGAHVQEGGRKMAPFGGAALGVQLGHTGEGILRVPRFRGLAKDGLGNSPGEKSPQGKKKNGARGF

SEQ ID NO: 93905 - DNA, 836 bp, Zea mays
  misc_feature: Ceres CLONE 1583400
  misc_feature: Translation starting site: 603
  misc_feature: SWISSPROT Homolog: EC 2.8.1.7 Cysteine desulfurase
caaagctggagctccccgcggtggcggccgctctagaactagtggatcccccgggctgcaggaattcgtctcacccctagaaaaaaccttcccccttaaccagcaattcccatatcgcccctccaccaaaacgggagctcagcggcggcggccgcaacccctcccctgaaccctacccccttctacccggccaccaccccacaacatggccctctcccgccgcctcctcccgctcttcctccgccgcggcgcccccatccccgcccgcgctctctccacggctgtcgcacctgcggcggtggcctcggaggaggacgaggcggccgtcaccgtcaagggcgtgcgcatctcgggccgcccgctctacatggacatgcaggcgacgacccccgtcgacccgcgtgtcctcgacgccatgcttcccttctacctctctcgctacgggaaccctcactcccgtacccacctctacggctgggagtccgacgccgccgtagaggacgctcgcgcccgcgtcgcctccctcgtcggcgccgaccacgcgcgagatcttcttcacctcgggcgccaccgagtgcaacaacatcgccgctcaaggcgtcatgcgcttctactgcgagcgccgccgccacgtcatcacgacgcagaccgagcacaagtgcgtgctggactcctgcaggtatctgcaacaggagggattcgagatcacctatactccagtgcgcaagaacggactcgtcaaactctcgcagctcgaagacggcatccgcccggacaccgggctggtgtttaataagggcggcaaaaacgaaattggcggacgtcagccagctcga

SEQ ID NO: 93906 - DNA, 844 bp, Zea mays
  misc_feature: Ceres CLONE 1583404
  misc_feature: Encodes the peptide sequence at SEQ ID NO. 93907
aagctggagctccccgcggtggcggccgctctagaactagtggatcccccgggctgcaggaattcgtctcacccctagaaaaagcgcactctagaagagttgttgtgcggcgccgggcgcggaggccgttggatccagtgtcgtgcccctgtcttggtcccgcccgtcctcggcgcatcggctaccccctcacatgtggctgcgtgtctgcgtcggccatcccggttgctttgcccctcgcttctcttcaaatggtagagccgctgcaagctgaacgaccaccagcttgacccctgcgctagtcggctgacacctcaccttgtcggcacctggattctgatgacccctagcttccgccactgaggctcagcgcctcttgaggcggcgcgatgaatagtccactctccagctcctcctgtgataccttcgtcagcatgcatggcacaccctcaggtatgctgaatccgtgcggtctatgggtacaaaaacttcgcgcaacgttggaggcgtcctcgtcggagatagagttcatgacggtccacaagtaacacaccactgatgcgttcttcattgacggctgattctacgacgtccacctgttagcccccacggagagcgatggcatcaaatgagacgacaagttcattgatgggcctgaactctgcttgaagcctactgagattccggaactaggcgatagatgctgtcctggacaatttcactgagactgggacgcgggacctcttggggagcaggcaggcggagtaacgatggctcttccccaacttggtggttgatgcttttaataaccattttttaaagagaatctttcctcaatttttct

SEQ ID NO: 93907 - protein, 52 aa, Zea mays
  misc_feature: Ceres CLONE 1583404
MNSPLSSSSCDTFVSMHGTPSGMLNPCGLWVQKLRATLEASSSEIEFMTVHK

SEQ ID NO: 93908 - DNA, 870 bp, Zea mays
  misc_feature: Ceres CLONE 1583406
  misc_feature: Encodes the peptide sequence at SEQ ID NO. 93909
cggccgctctagaactagtggatcccccgggctgcaggaattcgtctcacccctagaaaaagttccgtttctggcgcacagcacagtcacagtgctcggcatcttttccgctccgctctgacgctctcccactcccccacagtcccacgccctccagtcaaagcaagccgctgcttggccggccgggaaggctcggtcgcagcgccgaggaatggcggccaagccggtcaccgtcggcgacctcatccaccgcgtcgcctcttcctgcctctccaaccgcctgccgtgcaaccacaccttccgcgactccgtggacagcgactttgacgacgacgacgacgacgacgaccccttcgccgacgccgtctccagcagcgagaaatgccagcggtccccgcccgctgcggaggtcgaggaagaggaggaggaggacgagaagcctcaagatctggggaggagagggagcaggagaaggagaggctggccgcctcgttcaaggggcgccgaagcgcgccccgcgacgcggacgcgctgattgggggaagtgttcgacgcccgtctcccggggtggccccgcgccctaatcccgcgtttcaaggaactctcactgcccccgggggacccctacaagaatgcgtaacggcggtaacccggcccgttggttctcccgagcttccgcctaccttgccgcgccatcccgggaaccgctttctgtccggttcccgcagacccgtgggggcccacatttcccgcggccccgaaaacctgtaccggcgcccgccccctgggggcgaagggcccgtgggcctccccatagagaagggggggcaggctttggataaaacctcccagaggctcatgtgtttcgat

SEQ ID NO: 93909 - protein, 107 aa, Zea mays
  misc_feature: Ceres CLONE 1583406
MAAKPVTVGDLIHRVASSCLSNRLPCNHTFRDSVDSDFDDDDDDDDPFADAVSSSEKCQRSPPAAEVEEEEEEDEKPQDLGRRGSRRRRGWPPRSRGAEARPATRTR

SEQ ID NO: 93910 - DNA, 856 bp, Zea mays
  misc_feature: Ceres CLONE 1583407
  misc_feature: Encodes the peptide sequence at SEQ ID NO. 93911
ggagctccccgcggtggcggccgctctagaactagtggatcccccgggctgcaggaattcgtctcacccctagaaaaactagcgccgcaccctcccgcccaccgccgtcgccgcccagccgcagtaaggaggaaggagcaggaagatgccggcggggcacgggctgcggtcgcggacccgcgacctgttcgcgcggcccttccgcaagaaggggtacatcccgctcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccattggcgtcgagatcaacaagcaggttaacggtcgcatcatcaggaagcggatccatgtccgcgtggagcatgtgcagccctcccgttgcacagaggagttccgcctgaggaaagccaagaatgaccagctcaaggcggatgccaaggcccgcggtgaggtgatcagcaccaagaggcagcctgtgggacccaaacctggcttcatggtcgagggtgctacactcgagacagtcactcctattccttatgatgtggtcaacgatctcaagggcggttactagagagaattcttgtaccttcagcagttcaaacgagctggcaaacttatctggaatcttttttgataattggctagttcttgtagaagccggcaggcagaggcaagaggcccctcaccctcagtggatcaggtcgctagctcccgggcttacctagtaggcagccatgaaatttcgggggggaatgggcaccccgacgaatccggtgcaagtactgcc

SEQ ID NO: 93911 - protein, 164 aa, Zea mays
  misc_feature: Ceres CLONE 1583407
  misc_feature (2)..(100): Pfam Name: Ribosomal_L21e Pfam Description: Ribosomal protein L21e
MPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRKAKNDQLKADAKARGEVISTKRQPVGPKPGFMVEGATLETVTPIPYDVVNDLKGGY

SEQ ID NO: 93912 - DNA, 851 bp, Zea mays
  misc_feature: Ceres CLONE 1583409
  misc_feature: Encodes the peptide sequence at SEQ ID NO. 93913
ctggagctccccgcggtggcggccgctctagaactagtggatcccccgggctgcaggaattcgtctcacccctagaaaaaagtcggggagaagtggaagtggactcgaggatcactctcgctatcgactacgctatctcaactgccacggacaatcgaaaccaacagtgagagctagcctcgccaaaccgccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagagatgaacgccgacttcggcgcgcccaaggagctcgcgggaggcctgcagcagcggcgggccctctaccagccccgcctcccgccatgcctccagggaccgacggtaagggcggagtacggtgacgcgaccacaaccatagatcccacctgtgcccaagccgtcgcgcaggccttcccgcacacctttggccagccgctcgtcagcttcgtcgcgccggccgccggcgccggcgccgttgaggagcgccacccgatcagggtgggcgtggtgttctctgggaggcagtcgccgggagggcacaacgtcgtctgggggcctcatgacgcacttaaagcctacaatcctcagagcttgctctacgggattcgtcggtgggacggaaggactgtttgcaaacaagacgttggagatcaccagagatgttcctgcctttctataaggaacaaagggggtttccaatttgccccggaagggggaatcgatt

SEQ ID NO: 93913 - protein, 161 aa, Zea mays
  misc_feature: Ceres CLONE 1583409
  misc_feature: SWISSPROT Homolog: EC 2.7.1.90 Diphosphate--fructose-6-phosphate 1-phosphotransferase
MNADFGAPKELAGGLQQRRALYQPRLPPCLQGPTVRAEYGDATTTIDPTCAQAVAQAFPHTFGQPLVSFVAPAAGAGAVEERHPIRVGVVFSGRQSPGGHNVVWGPHDALKAYNPQSLLYGIRRWDGRTVCKQDVGDHQRCSCLSIRNKGGFQFAPEGGID

SEQ ID NO: 93914 - DNA, 959 bp, Zea mays
  misc_feature: Ceres CLONE 1583410
  misc_feature: Encodes the peptide sequence at SEQ ID NO. 93915
  misc_feature (959)..(959): n is a, c, t, g, unknown, or other
ggagctccccgcggtggcggccgctctagaactagtggatcccccgggctgcaggaattcgtctcacccctagaaaaaatccatttcttccttccctgttcacggattccaatccttcctccacacccccaccctcccttcgcctccacatccaccaccatccaatccgcgcgggtgcttcgccaccctatcccgattgctacctcctcgtggtgggcgccgctccgatccgcccgatccgcgctgctcctggggttccggcgcgcggcggcgagcggcggaggcggcgcaggaatggaatccgaggacgatatgcacgacgcaaacgactccgccgaagatgacttttacagcggcggggaggctggtctcgccgccagcgacgacggagacgccgactacgacttcgcggaccacgactccgacgactccgcggagctcctctcccacagacagcagcaaaattacagtatattggagtgaagttgatatcaaagcggcgccaagagggatgaacaaaaaaagggtttccactggttcctttcaattttccaaaaccagaagggagtgtggttcttcttccccgaaccaataactggggagggggtaagtaaaggtggcaatgaacgaaaagggttttccctgaattgaaaaagccggggtttccggaaaaggggggattgggtttggcgccggagaaaggcaattatttgaaaatggcccaagtggacaaaaaaaaaagttaagcatgggcgggaaaaaagggttttcgtagagaaattagccctctccttggaaatcccagaagagaaagcaagaacagcacatgatagggctaactccgtttacctgggagatataccatagatgggggagagaggtaacacattgagcacactcggcgacaataagatgaataggttaccgcggagtcgcttgaggaagcacaaaagagtctn

SEQ ID NO: 93915 - protein, 62 aa, Zea mays
  misc_feature: Ceres CLONE 1583410
MESEDDMHDANDSAEDDFYSGGEAGLAASDDGDADYDFADHDSDDSAELLSHRQQQNYSILE

SEQ ID NO: 93916 - DNA, 841 bp, Zea mays
  misc_feature: Ceres CLONE 1583411
  misc_feature: Translation starting site: 357
  misc_feature: SWISSPROT Homolog: EC 2.7.7.27 Glucose-1-phosphate adenylyltransferase
  misc_feature (365)..(365): n is a, c, t, g, unknown, or other
ggagctccccgcggtggcggccgctctagaactagtggatcccccgggctgcaggaattcgtctcacccctagaaaaaattctcatttccatttgcctcgctcgccttcctcctccccactccactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtngagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttggggtggtggtaccgggactcagcttttccctctcacaagcacaagggccacccctgctgttcctattggaggatgttacagggcttattgatatcccccatgagcaactgtttcaacagtggcataaacaagatatttgttatgactcagttcaactcagcttctcttaaccgtcacattcatcgtacctatcttggggggggggggatcaacttcacctgatggaactgtttgaggggctggctgcaaaaaaaaatgccttggggaagcctggctggtttgga

SEQ ID NO: 93917 - DNA, 930 bp, Zea mays
  misc_feature: Ceres CLONE 1583415
aagctggagctccccgcggtggcggccgctctagaactagtggatcccccgggctgcaggaattcgtctcacccctagaaaaattcgcgccgtcgtcgaccaatcgaatggaggcggagcagtaaaagcagcagccccagcgcccgcgccgaaaggggctgaagcggaagctggaggacgaggcatccgccgccgccgccgcggccacatccgcaacagcatccgccgccgcgtcctcgctcggcagcgcgggcgccgacgatgacaactaggaggaggacggctcggcgggcaccgccgagatctgctgccggcactcccacgcggctcttgcccgacgagtccgcgcgcaggttgatgccctcgtccgctgcacctcctcgtgggcgcacgacgaccaggccaaccccaaagcgccccacctatgttcctcttcgaagtttagcaaaaaccaaggatggtggtcaacgtcaatttaacgaaggggggggccccatgcccgggcaggggggttccccacctaaaacaaacccttggttggggggcggggccaccaacccccggggaagaaaaaaaaaaaaaccttttgggggggggggagtttttgaaataaacactcttgggtggtgttttgttaaaaaaaagaagaaagggcgggtcttcctctaagtctctcatcttgtgggggggagggggacggcccccgccctttgtttttttttttgtgtgggggagggggggccacaaaagtgacgttcccgttttactagagagtaattggcgtgagtgaataggggtgcgtgcgttgcttgggcggttgggaggtgtgatgacgtgtggtgtttatataggaaagataagcaaatgtgctccagactgggctcgtctggaggacgaacataatgttttgctagaccgatatggggaaag

SEQ ID NO: 93918 - DNA, 889 bp, Zea mays
  misc_feature: Ceres CLONE 1583419
  misc_feature: Encodes the peptide sequence at SEQ ID NO. 93919
aaaagctggagctccccgcggtggcggccgctctagaactagtggatcccccgggctgcaggaattcgtctcacccctagaaaaacaacccaagttcacgatcgcgaggtcttcgtctccgcctgggtccagcactcggatttccgcgcgttccacttccacccacacacacacacacaccaaaggacgcaggccgcaatggcggagtccgaggtctcccccgcagcggccggcggcggcgggcggctccgcaacgccttcgggggcgtgctctgcgccttcacgcttctcctcatcggcgtcgttgccttctcgatccgtctcttctccgtaatcaagtacgagagcgtgatccacgagttcgacccctacttcaacttccgcgtcactcagtttctgtccaagaatggaatttatgagttctggaactggtttgatgataggacatggtacccccttggccgtgtgatcggtggcactgtgtatcctgggttgacattgactgctggaactatgtggtggttgctgaactcctctaacatcccattgtcggggggaaaaagtttgtgtgtttcccagcctccaattttctcagccaaaggcatcatggggctacctacctggctaaaaagggaaaccaaaagggacttgggactgggattaaaggcaaccacccattttaagcaaggggccccccccaaaaattttaaaaaattggtgtgcggggcgcctttgaaaaaaaaaacgggaccaaaaattgccccgtggaatttaacttttttcctcattgggaaaaaaccctaaaaacggggaaaccctcttttttttggaaacacaaaggagccccccaatatttacacaggggcccccccctgggggggagcaaaaa

SEQ ID NO: 93919 - protein, 201 aa, Zea mays
  misc_feature: Ceres CLONE 1583419
  misc_feature: SWISSPROT Homolog: EC 2.4.1.119 Dolichyl-diphosphooligosaccharide--protein glycotransferase
MAESEVSPAAAGGGGRLRNAFGGVLCAFTLLLIGVVAFSIRLFSVIKYESVIHEFDPYFNFRVTQFLSKNGIYEFWNWFDDRTWYPLGRVIGGTVYPGLTLTAGTMWWLLNSSNIPLSGGKSLCVSQPPIFSAKGIMGLPTWLKRETKRDLGLGLKATTHFKQGAPPKNFKKLVCGAPLKKKTGPKIAPWNLTFFLIGKKP

SEQ ID NO: 93920 - DNA, 831 bp, Zea mays
  misc_feature: Ceres CLONE 1583421
  misc_feature: Encodes the peptide sequence at SEQ ID NO. 93921
  misc_feature (760)..(760): n is a, c, t, g, unknown, or other
ctggagctccccgcggtggcggccgctctagaactagtggatcccccgggctgcaggaattcgtctcacccctagaaaaagcttccctcccccacgtcgcgtccgatcggcgacggtgcgccatgtcgatgctggacaccttcttcagcaagggcggcggcggcggcggcggcggcttccgcggcgccaagtgcaagacgctgctgaagctgtcgatcccgcggataaagctgctgcggaaccggcgggagctgcagctgcgccagatgcgccgggacatcgccaagctcctagaggccggccaggaggccactgcccggatcagggtggagcacatcatccgggaggagaacatgatggccgcgcaggagatcctcgagctcttctgcgagctcatcgcggttcgcctgcccatcatcgaggcccaaaaggagtgtcctattgatctcaaagaagcaatatcaagtgtctgttttgccgctccaagatgtgcagatctacctgaactgatgcaagttcaaatgatgtttgcaactaaatatgggaaggaatttgtcgctgcagcttcagagttgatgcctgattgtggggtcaatcgtcagataattgaattgctttctattcgtcctcctcctgttgatgcaaagttgaaactgctgaaggagatagctgaagaacactgagttgattgggatccatcagagacagagacagaatttctcaaacctcatgaagatctattgaatggagcgacctactncattgggtccacactacctctttcccaaggagaacatgagggaaacggtattttgcaagtgctggccaacc

SEQ ID NO: 93921 - protein, 186 aa, Zea mays
  misc_feature: Ceres CLONE 1583421
  misc_feature (30)..(151): Pfam Name: DUF292 Pfam Description: Eukaryotic protein of unknown function, DUF292
MSMLDTFFSKGGGGGGGGFRGAKCKTLLKLSIPRIKLLRNRRELQLRQMRRDIAKLLEAGQEATARIRVEHIIREENMMAAQEILELFCELIAVRLPIIEAQKECPIDLKEAISSVCFAAPRCADLPELMQVQMMFATKYGKEFVAAASELMPDCGVNRQIIELLSIRPPPVDAKLKLLKEIAEEH

SEQ ID NO: 93922 - DNA, 830 bp, Zea mays
  misc_feature: Ceres CLONE 1583426
  misc_feature: Encodes the peptide sequence at SEQ ID NO. 93923
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (688)..(688): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
ctggagctccccgcggtggcggccgctctagaactagtggatcccccgggctgcaggaattcgtctcacccctagaaaaaacctctgtccatccatcacagcttcgagactcgtcctccatgggttctggcggcgtcagatggaaggctctgccgctgtgcctagctctcgtggctctgcaagcatgcctccctgctcgcggggcagctcccaagacttacatcgttcagatggccgcgtctgagatgccgagctcgttcgatttccaccacgaatggtacgcatccactgtgaaatccgtgagctctgtgcagctggaaggagacgcggacgaccattacgccgcgaggatcgtctacaactaccagaacgcgtttcacggcttcgcggcgaagctggacgaggacgaggccgagcggatggccgaagcggacggcgtggtggccgtgctcccggagacgggtcctgcagctgcacaccaccacgagaccccggactttcctggggatcagccccgagaatcagccaacgccatattggtccgccggcctgggccgaaccaccacattcgttctttcggggtgctccaaaaaccggcatcttgggcccgaaagaccccccgcttttaacccaacaaggggcctctcggcccctggttcccccgggaccaagtnnnnnntnnnnnntntgggtggggggggnnnnnnnttttagaaaaaagggccttttccaccggccgggttttcccctggcccgtggaaaccccaaaatatttggggggcgcccctttttttataaaacgggtttaaaaaaaggccccccctcggggc

SEQ ID NO: 93923 - protein, 169 aa, Zea mays
  misc_feature: Ceres CLONE 1583426
  misc_feature (32)..(119): Pfam Name: Subtilisin_N Pfam Description: Subtilisin N-terminal Region
MGSGGVRWKALPLCLALVALQACLPARGAAPKTYIVQMAASEMPSSFDFHHEWYASTVKSVSSVQLEGDADDHYAARIVYNYQNAFHGFAAKLDEDEAERMAEADGVVAVLPETGPAAAHHHETPDFPGDQPRESANAILVRRPGPNHHIRSFGVLQKPASWARKTPRF

SEQ ID NO: 93924 - DNA, 790 bp, Zea mays
  misc_feature: Ceres CLONE 1583430
  misc_feature (220)..(220): n is a, c, t, g, unknown, or other
  misc_feature (690)..(690): n is a, c, t, g, unknown, or other
ctggagctccccgcggtggcggccgctctagaactagtggatcccccgggctgcaggaattcgtctcacccctagaaaaaattttttctccctcgtcgacggctgtgtccggcttgatttcgatcggcagctggagagaatcgattcgattccccgtctgccgctgtcctttggctctggctcgctcattcgttcgctcgtcctaattgtctccaccacntttttttttctgcccggccactgccagtccaccacaccacgtccgcgtcgtcgtacgcttcccccagcgcgccccgtcgcgtcccgggctgctgttgagtgcccccgcccccgccccgtttcccttaaagttggttttcggggggccgccccccgcccgcttggcttggggtggggtttcaaaatcaaacccgaagggggggggggaacggggcccccaaaggggacccaacaacccccgggggggaaaacccgggggggagtttccggaaaaaaggggggacacccccggggaaaccccttttttggggggggaaaaaaaaaaaaaaaaagggggtgggggtttttttttaatcttcccccggggggggaaacaacccccccccccggggggaaatacttctcctcttttttcttggggagagggggaggttttttctccccacaaccacgggggggaggggggggggngggggccccccccccccttttttttttacccaccacaccacaaaaggagggggggcggtggtttgccccgcagagaataacccttcccccccccccccca

SEQ ID NO: 93925 - DNA, 793 bp, Zea mays
  misc_feature: Ceres CLONE 1583435
  misc_feature: Encodes the peptide sequence at SEQ ID NO. 93926
  misc_feature (595)..(595): n is a, c, t, g, unknown, or other
ctccccgcggtggcggccgctctagaactagtggatcccccgggctgcaggaattcgtctcacccctagaaaaactgccacgacgcccgcgacaaatccctgcgcgacggcatcttcgcctcccatcccctcccagcttcccctcccactccggccctcacacaaattgcccctcttcttgtcctcctctttacacgctgccgaccacggctgccgccaaccacccgccccaccgctgccgagtgctagccatttggagctgccgcgccatggcgtccgtggccgccaccaccacgctggcaccggcactcgcgccccggcgccgggcgcggccagggagcgggctgctgccgccgcgccgggcctcggccgtccgctgctcgctcgacagtaacgtctccgacatgggcgtcaacgctcccaaagggttattcccacccgagccagagcactacaggggcccgaagctcaaggtggccatcataggggcaggccttgcgggcatgtccaccgctgttgagctcttggaccagggccatgaggttgatttgtacgagtcccgtccgtttatcggtggtaaggttggctcctttgntgacaggcaaggaaaccatatcgagatggggctgcatgtgttcttcgggtgctacagcaatctcttccgcctcatgaagaaaggtggcgctgataataatctgctggtgaaaggacatacccatacttttgtaataaaggggggcacgatgggtgacttgattttccggtcccggggggaagctcggtacatggcatt

SEQ ID NO: 93926 - protein, 174 aa, Zea mays
  misc_feature: Ceres CLONE 1583435
  misc_feature: SWISSPROT Homolog: EC 1.14.99.30 Carotene 7,8-desaturase
  misc_feature (109)..(109): Xaa is any aa, unknown, or other
MASVAATTTLAPALAPRRRARPGSGLLPPRRASAVRCSLDSNVSDMGVNAPKGLFPPEPEHYRGPKLKVAIIGAGLAGMSTAVELLDQGHEVDLYESRPFIGGKVGSFXDRQGNHIEMGLHVFFGCYSNLFRLMKKGGADNNLLVKGHTHTFVIKGGTMGDLIFRSRGEARYMA

SEQ ID NO: 93927 - DNA, 935 bp, Zea mays
  misc_feature: Ceres CLONE 1583437
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
aaagctggagctccccgcggtggcggccgctctagaactagtggatcccccgggctgcaggaattcgtctcacccctagaaaaaacggacccaccagacgggctgtctttagcagcgagcgactctcctctccgacggtcccgcccaggaagagagagagatctgccactccccttatcagcgcccgcggcgccggtggcctccctcctcgagcttgatatgtctgagaccggatctatgatgactaatggtggacgatctgctcccctccgtgctcgggatgtcggggggggccaccatggaggttattggcccccaggtggcccgacctcgagggcggccctagttgttagtggttaaacccccccccccaaggccccctaaagggagaaccctggggattcccccacccgggggggcccccaaactgttgtgaataaagaaacaaggggggggagaaccccttttttttgaaagaaaaaatttttgttataaaaagcggtttctgtgaggcgccaccataataatttaatacccgggggggaaaaacccccccccccagaacactaacagggaggcctgcgagcttggtataaaaaggggggaaaacaagagcgcccccccggggggggaaagagattcccccccccccccgtgttggggaggaaaggcccccccccagggggaaacacaaaagggcgggaggtaaaaataccccccccggtgccccgggtggcgcgccccatcccctcggcggtgaaatgtcaaaaaaaattttatttggccccccccccgccggggggggctgtttaattacgagaaagtaatatctttcaccaacaaatatacaaacatttgtgggaggcnnnnnnntggccaccacacccccgtaaacccatacgttagatttccccttacaatgtggccgaaaggag

SEQ ID NO: 93928 - DNA, 942 bp, Zea mays
  misc_feature: Ceres CLONE 1583439
  misc_feature: Encodes the peptide sequence at SEQ ID NO. 93929
ctaagctggagctccccgcggtggcggccgctctagaactagtggatcccccgggctgcaggaattcgtctcacccctagaaaaacctccggttccattccagtccacctgcccctccctccctatctatcctgtactctctctctctctctctccccccggttctccgttccacatcgcgtgcgcattgagacgacgagtttctagagcgtcgtaccgcgcacggctcccgagccccaccgcaaagcgccggaatcgtgagcgcgtccggcctcgcctgctccgcggcgagaggcggccgatgaggacgggcgatgtacccggtggtgacaggcacgccgccggcgcggctgccggcggcgtcgcgggtggacaaggccactagccacctgctgcaaggccccgactgggccgtcaacctcgaaatctgcgacaccctcaaccccgaccgctgggcaacgaaggatggaggaaaaaccggtgaagaaccgatttgcgccataagggatccaaaaggttaaattcgtttaccttttgaaggttttttgggagaacaatggatgaaaaaacccgtggggggaaatattggttccattttggaaagggtgggtagaatcaaggacaatattttttatcaaaaaaagaaatgggggtaaaaagatgggccccaagaaatagggggttggtatatgtgcgagagggaaggggaataaagggcttttgtgtgcctttcccggagaatcccggggcaaaaaaggggattctgggtgggaccctgtgggggggaaattatccccacccgggcgctcgtggggactaacggtgggatcctaaattatggggcagggaataattttttccacaaaaaccccccggtgaaaggccccccccaataattttgacgccttgcgggaaaaaatcaggggaaatggggtttcccaa

SEQ ID NO: 93929 - protein, 68 aa, Zea mays
  misc_feature: Ceres CLONE 1583439
MYPVVTGTPPARLPAASRVDKATSHLLQGPDWAVNLEICDTLNPDRWATKDGGKTGEEPICAIRDPKG

SEQ ID NO: 93930 - DNA, 1055 bp, Zea mays
  misc_feature: Ceres CLONE 1583443
  misc_feature: Translation starting site: 261
  misc_feature (1055)..(1055): n is a, c, t, g, unknown, or other
ccccgctgggagctcacgcggtggcggccgctctagaactagtggatcccccgggctgcaggaattcgtctcacccctagaaaaacttttcagcctcagtgctgcgtgctcgtcggcggaccacgacggcgtcacgcgggacctcgacctctccatctccgacttctcagtgttcggctcgctgtcaaaggtgggcgccctggtcggggcgatctgcccgcggccagatggccaagtacgtgggccgctgagggtcactgatgattgcggaggttccgaacgtcatgggctggctcgcgatctccctggaaagggacacttcgtttcagtacgtggggaggttgctggaaggattcggtgtcgggctcctcccctcgtgggtggcggtactcgcatgagagaaatctcctgcaaacatgacaagagctcttggcgccgtgaacccgattgtctgcagcattcggatgtcgctgtttgcccgatgtggcttacgattgtgttttatcctctgggaggctgcgttgccattaataaggaaacattggcccgtgtccaacctttttgaaaaacttggagcctgtgaccttcaatgtccacggaatcttcccgaaaattgagcctggccttaggcattgtaaatttgtcacggggatttgaggctggcccagggactattggcctaaaaaatatatttcaataaggggaggaagtgtggatagggctgggaaatatttccaattggagaacagggccgaactatgttcactcaaaagggaaaaccctggtgggccacctcgtataccaatccaaaaagagggggctgcaaacatgtgggcgtttccgctggacgtgtggtcacaccccgaacaagagcagcatcgggtcgcacccctacctgatattccatgagggtagggtggacccctttcttcgctgtgttgtgaatcatgacttgtacatgggaaatagaatctgtgtttataaagtcttagtgtgattagcgagaggactcaactatggctaaaagcccaaatagggcgtgacaagaaatatan

SEQ ID NO: 93931 - DNA, 1012 bp, Zea mays
  misc_feature: Ceres CLONE 1583448
  misc_feature: Encodes the peptide sequence at SEQ ID NO. 93932
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (120)..(120): n is a, c, t, g, unknown, or other
  misc_feature (341)..(341): n is a, c, t, g, unknown, or other
  misc_feature (342)..(342): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (407)..(407): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctgggactccccncggtggcggccgctctagaactagtggatcccccgggctgcaggaattcgtctcacccctagaaaaacgtctcgacctcgcagccgcaaacgcgaaaccctagcctcgagctctatctccggccacagctggtcaggttagcgacgaaggatgagcaggcgctggagccgcacgatctacgtcgggaacctccccggcgacatccgggagagggaagtggnnagatctgtctacaagtatggtaaaatnnngtgacatgacctgaaggtccccccagaacacctggntattgcttttgtgagtttgaaaatcctcgtgaagctgaagaagccattgcctgacgggaatgaaaccaactttgaatggacacccggctaaaaagggaagggctccccatgggggggtaaaaggtaagggttccccccccatgaaaccgttccaaaggggcttttgggggggggggggggggggaaaccccccttggggtgtggttccaaaaaacctctccaaaaaaatccggggggccctttgtgaacccggggaaaaggccccttttttttttgggggttaatagggggggggggggtttttttaaagaggaactcctaattttcccgaaaaaagagggggggggaaaaattttttttttttctcctctcaaaaaaaggaatactcccccaaaaaagagggggggggggagaaaaaaaaacaatctttgggggggggaaaaaaaaaaagccccgccccccctttttttggggggagtttttttaaaaaaagggttggcttaaaaaaaaaacctttttttaaagggcgcccccaaaaaaaactctttttttcgcgggggggggggtgtttttttttttttttttttaaaaaaaaaaaagaaaaa

SEQ ID NO: 93932 - protein, 32 aa, Zea mays
  misc_feature: Ceres CLONE 1583448
  misc_feature (24)..(24): Xaa is any aa, unknown, or other
MSRRWSRTIYVGNLPGDIREREVXRSVYKYGK

SEQ ID NO: 93933 - DNA, 829 bp, Zea mays
  misc_feature: Ceres CLONE 1583452
  misc_feature: Encodes the peptide sequence at SEQ ID NO. 93934
ggagctccccgcggtggcggccgctctagaactagtggatcccccgggctgcaggaattcgtctcacccctagaaaaaaacacaaccttcttcttcctcatctctctctctcttcttccgctgccaccctcccagcaccgagggaagggaagcccaggaatctccgtcccgctcccggccgccgtccttctcataacctcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctctcggagacggttgaagtcttcacaccctctcgacctctttgctgtctcattttttttaactgtcaaggataagcaagtgacctctgtgtgcataccaccaccaccatacgtagcatacacaggcacagatggcagagcataaagggaacgttctcttgcacaagtatgagatggggaaattgcttggccaaggcacctttgccaacgttgtacatgctcgtaacacggcgacttcggaaagtgtcgcgatcaaagtgattgataaggagcacgttatgaccggtggtctcattgatcaatccagcgagaaattctgtgatgaagctgttaggcatccaacatctacagctctatgaggtcatggccaccaaaccaaatatctttgtgctg

SEQ ID NO: 93934 - protein, 75 aa, Zea mays
  misc_feature: Ceres CLONE 1583452
  misc_feature: SWISSPROT Homolog: EC 2.7.11.1 Non-specific serine/threonine protein kinase
MAEHKGNVLLHKYEMGKLLGQGTFANVVHARNTATSESVAIKVIDKEHVMTGGLIDQSSEKFCDEAVRHPTSTAL

SEQ ID NO: 93935 - DNA, 827 bp, Zea mays
  misc_feature: Ceres CLONE 1583453
  misc_feature: Encodes the peptide sequence at SEQ ID NO. 93936
  misc_feature (562)..(562): n is a, c, t, g, unknown, or other
  misc_feature (727)..(727): n is a, c, t, g, unknown, or other
  misc_feature (756)..(756): n is a, c, t, g, unknown, or other
  misc_feature (803)..(803): n is a, c, t, g, unknown, or other
ctggagctccccgcggtggcggccgctctagaactagtggatcccccgggctgcaggaattcgtctcacccctagaaaaaactacaacatctgtcaccgtgaaatctcggctacctcctgacttctggtacctcgccgccggggacccaactccgacccccaccccaccataccaaagccaccgcggctgcggcttccgcatcatcaatggtgctgatcactctcgtccgcgactacatcgaccgcatgctccacgacatcccgggcatgaaggtcctcgtcctcgacccccaaaccgttgggatggtgaagcgtggtgtacagccagtcggatctgctgcggaaggaggtcttcctcgtcgagaccatggacaacgcctccagctccagggagtccatggcgcacctcaaggccgtctacttcctccgaccctccgctaacaacgtccagaagctccgcaggcacctcgccatgccgcgcttcgccgagtaccacctattcttctccagtatattgaaggtcccgcagattcaaatacttgctgactctgatgaacaggangttgtgcagcaagttcaggagttctatgctgatttttgtgccatttgaccataccatttcactctcaacatacaaaatacccacatgtatatgctcccaacagtggtcgacccctctggtatgcaaggcttctgtgatcgagccgttgatggcattgcttctgtnctcttggctttgagcgccgccctgtattnatatcagaagacatcagatgttgcaaaaagattgcacagaaactgcnagatgatgtatgagcagaaagtga

SEQ ID NO: 93936 - protein, 80 aa, Zea mays
  misc_feature: Ceres CLONE 1583453
  misc_feature (65)..(65): Xaa is any aa, unknown, or other
MDNASSSRESMAHLKAVYFLRPSANNVQKLRRHLAMPRFAEYHLFFSSILKVPQIQILADSDEQXVVQQVQEFYADFCAI

SEQ ID NO: 93937 - DNA, 839 bp, Zea mays
  misc_feature: Ceres CLONE 1583455
  misc_feature: SWISSPROT Homolog: EC 2.7.11.1 Non-specific serine/threonine protein kinase
aaagctggagctccccgcggtggcggccgctctagaactagtggatcccccgggctgcaggaattcgtctcacccctagaaaaagcttttcttgcaggtgaacggcctcaccggcagcataccgtcggagctgggctacctcaggagcctcagttctttggacctgtcgaacaatgcgctcaccggtgagataccggcgagtttctccgagctcaagaacctgacgctgcttaacctgttccggaacaagctgcgcggcgacatccccggcttcgtcggcgacctgcccagcctcgaagtgctgcagctgtgggagaataacttcaccggcggtgtgccacgccgcctcggccgcaacggccgcctccagctgctcgatctctcgtcgaacaagctcaccggcacgcttccgccggagctctgtgcggggggcaagctgcagacgctaatcgccctcgggaacttcttgttcggtgccatcccagactcactcggccagtgcaagtccttgagccgtgtccgtctcggggagaactacctgaatggctcaattccgaagggtctattcgaattgccgaagctgactcaagttgagttgcaagataacctcctcactggcaatttcccggctgtgatcggcgctgcggctcctaaccttggtgagattagcctgtccaacaaccagcttacgggtgcattgcctgcatctcttgggaacttctctggtgttcagaagttgctgcttgatcagaacgcgttctctggtgccatacctccggagattgtgcggatgcagcatctctccaaggctgaccttagcagcgacagttttaaggtag

SEQ ID NO: 93938 - DNA, 890 bp, Zea mays
  misc_feature: Ceres CLONE 1583457
  misc_feature: Translation starting site: 175
  misc_feature: SWISSPROT Homolog: EC 3.1.4.17 3',5'-cyclic-nucleotide phosphodiesterase
ccaagctggagctccccgcggtggcggccgctctagaactagtggatcccccgggctgcaggaattcgtctcacccctagaaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggctgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaagggcaagatccctgcctagcccaaggcggcgtcgccccaaacccaaggccagggccaaggccaagcctggtcgcttcctggcgccgggtcttcctaagcccccgcggggcgcccctccccaagggtcgcccaagaacctcccgccaagggcccccccctctgccaaaggcagcccaataaagggcgggtgggcttccctgcccgaaaaaagggataaagggctgggggtctggccttcctttaaaaataggtgggctaaccccccgt

SEQ ID NO: 93939 - DNA, 863 bp, Zea mays
  misc_feature: Ceres CLONE 1583460
  misc_feature: Encodes the peptide sequence at SEQ ID NO. 93940
  misc_feature (844)..(844): n is a, c, t, g, unknown, or other
aaagctggagctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattggccagttcggcgtcggtttctactctgcctacctcgtcgccgatagagttgtcgtgaccaccaagcacaacgatgacgagcagtacgtgtgggagtcccaagcgggcgggtcgttcactgttactcgtgacacgtcaggggagcagcttggcaggggcactaagatcacactgttccttaaggacgatcagctggaggtacttgaggagcgtcgccctcaaggatctgggtcagaagcactctgaggttcatcaggctaccccatcttcctggggaacttgaaaagaccaccggagaagggaaatttctggacgacgaagaactaagggaaganaaaaaaagatgcctgaagg

SEQ ID NO: 93940 - protein, 200 aa, Zea mays
  misc_feature: Ceres CLONE 1583460
  misc_feature (28)..(182): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHNDDEQYVWESQAGGSFTVTRDTSGEQLGRGTKITLFLKDDQLEVLEERRPQGSGSEAL

SEQ ID NO: 93941 - DNA, 887 bp, Zea mays
  misc_feature: Ceres CLONE 1583462
  misc_feature: Encodes the peptide sequence at SEQ ID NO. 93942
aaagctggagctccccgcggtggcggccgctctagaactagtggatcccccgggctgcaggaattcgtctcacccctagaaaaactctcgatccggaaacctctcaagccctagccgcctcctgcaagtatgagagctcaggaatctgcgccatggcgagtgagacggagaccttcgcatttcaagctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacgaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattgggcaggtcggcgtcggtttctactctgcctacctcgtcgccgatagagttgtcgtgactacaagcacaacgatgacgagcagtacgtgtgggagtcccaagcgggcgggtcgatcactgtaactcgagacacctccagggagcagcttggcaggcgcactaagaatcccgctggttcttaaaggacgatcagcctggaagtaccttgaaggatcggcctccttcagagatctgggtaaagaaagcaagtccgaaatttcattcaggctacgccccattttccctggggggaaccggaaaagagaccaccctcagaaaggggaaattttcctgacctgacgaaataaacgaggggaaagaaggatgtaacagggggca

SEQ ID NO: 93942 - protein, 159 aa, Zea mays
  misc_feature: Ceres CLONE 1583462
  misc_feature (28)..(154): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHLVPDEATNTLSIIDSGIGMTKSDLVNNLGTIARSGTKEFMEALAAGADVSMIGQVGVGFYSAYLVADRVVVTTSTTMTSSTCGSPKRAGRSL

SEQ ID NO: 93943 - DNA, 847 bp, Zea mays
  misc_feature: Ceres CLONE 1583463
  misc_feature: Encodes the peptide sequence at SEQ ID NO. 93944
aaagctggagctccccgcggtggcggccgctctagaactagtggatcccccgggctgcaggaattcgtctcacccctagaaaaaaccagcaccgaggcaggagcggcgatccatgccacagaaccaccactgctcttgccccagcccgccgcaggagttgccagatctgccccggtcacaggaactccgactccgagccctctccaatggcggttaaggtctacgtcgtgtactattccatgcatggacatgttggcaaactagctgaagagatccagaaaggtgcctcgtctgttgaaggtgttgaagctaaaacatggctggtccgtgaaaccctccctgaggaagtgcttggaaagatgggcgcaccccctaagcctgacgtgccagtcatcacgccgcaagaactcgcagaggccgacggaatcctcttcgggttcccaacgaggttcggaatgatggcagcgcagatgaaggcgttcttcgatgccactggtgggctctggagggagcagagccttgccggcaagcctgccggcgtcttcttctgcactggatcccagggtggtggccacgagacgacagcgttgacagcgatcacccagttgacgcaccacggcatggggttcgtgcctgagggctacatcttcggcgccaagctgttcggcatggaccaggttcagggcggcagccccctacgggggcaagacgttcgccgtcctagggctcaaagggggccaaaggaggtgggacctggagcacaccttgccacaaggggaaagaacttccgcagggcattccccaaaaaaccccaagggggtccggccgggatctaaaacatttttct

SEQ ID NO: 93944 - protein, 209 aa, Zea mays
  misc_feature: Ceres CLONE 1583463
  misc_feature (7)..(138): Pfam Name: Flavodoxin_1 Pfam Description: Flavodoxin
MAVKVYVVYYSMHGHVGKLAEEIQKGASSVEGVEAKTWLVRETLPEEVLGKMGAPPKPDVPVITPQELAEADGILFGFPTRFGMMAAQMKAFFDATGGLWREQSLAGKPAGVFFCTGSQGGGHETTALTAITQLTHHGMGFVPEGYIFGAKLFGMDQVQGGSPLRGQDVRRPRAQRGPKEVGPGAHLATRGKNFRRAFPKKPQGGPAGI

SEQ ID NO: 93945 - DNA, 893 bp, Zea mays
  misc_feature: Ceres CLONE 1583466
  misc_feature: Encodes the peptide sequence at SEQ ID NO. 93946
  misc_feature (646)..(646): n is a, c, t, g, unknown, or other
  misc_feature (893)..(893): n is a, c, t, g, unknown, or other
ctggagctccccgcggtggcggccgctctagaactagtggatcccccgggctgcaggaattcgtctcacccctagaaaaactcaagagtcgagacccaggcagccaggcttccagttccagccccacctcgactctaccctcctcaaaccctacaccacgccccccggcccccggcccccggccttcgcccaacccgatagcgtagcgccggcgcagaaccggaccctgccgtgcggttgtccaccccgctcggcgccgcccgccgccgccgccgccgcctttgatgtctcctacctgcgacctcggcttcctctgcccccggtcgcagaagagctcccaaaaggtcccccgagccaccgcttccggcgcccagggattgggctccccaccgcaccctagatgagcagcggcggcaacaagatgttgttgtttgggtcctttacggaggacgagactgagttgttacatggtcagcccctcaaaagtccaactaaaagtgtcagcaaagaatgtgaacggacggagatccagtttggcaccctgaacttttcagtgctgaatttagagaaaatatctacttcaagtgctgttcttcctgcaaaatcagcaaaaagggaaaccagtgccatcacgaaagagaatgcntgcaataatgaaaagaaagctgcagggttcaggcctttcaaacggtgggaccagttctgggctaaatggatgcccctcctgtttaatgttcctgcctaacaaagggttgaatttgaagaatgtggaagaccagagggccggttggcccccacccagttaaaaccctgggcaaaaacccttgggcaattccaaaacaccgccaaaatggacctttgggaaaaaccccctaaaggagatggggacccan

SEQ ID NO: 93946 - protein, 114 aa, Zea mays
  misc_feature: Ceres CLONE 1583466
  misc_feature: SWISSPROT Homolog: EC 3.1.2.15 Ubiquitin thiolesterase
MSSGGNKMLLFGSFTEDETELLHGQPLKSPTKSVSKECERTEIQFGTLNFSVLNLEKISTSSAVLPAKSAKRETSAITKENACNNEKKAAGFRPFKRWDQFWAKWMPLLFNVPA

SEQ ID NO: 93947 - DNA, 874 bp, Zea mays
  misc_feature: Ceres CLONE 1583470
  misc_feature: Encodes the peptide sequence at SEQ ID NO. 93948
  misc_feature (394)..(394): n is a, c, t, g, unknown, or other
ccgcggtggcggccgctctataactagtggatcccccgggctgcaggaattcgtctcacccctagaaaaaatcttcctcgtctcaggcctccccgccgcgcctttcggttcgggttcagcgaattcagccacgaagcgagcgggcggccggagggttcctggtaacggaactcgctcgctttccagtttcctggtcaggccaggcgacgaccgccggctcggcagttttctattccagcgtcgcggttccgggtcagaaattggttgcaggctcgcagccagccagtaacccggcgagatcgtcttgtgacagcggcaagtccacggcaggtagcgggctgagcgaacaagttgcctggctacttaccagcttgccgtgccatgtgcaactgcngttcttcctgctgatctcaggagctgcaagccggctctcggcgacctttcatgggcgtcatggcggcagaccatcgggagggcgtctgccagtgcatactggtggggctgcacatgaactccgtcgcgcaggacctgctccagtgggcgctccaccagggaggccaggcggggggcgaccagcatcgtctccgtgcagatttatccgcaagtccgacaagacgaacacactggaaactgatcagggacgctggaacgactaccgtgccgggaatacgaaggccctctgcaaccagaaaacaggtgggttctccgtcgtgcccgggtgcaccccggggaagactccaatccaaaaaaggaagccggttgaagggaggccatattttcttgcgccacccatgggatccgggggggcttggggcgcccaataaaaaaaaaaacccccccttccggagggggccgtgccatgcctcgggtccag

SEQ ID NO: 93948 - protein, 143 aa, Zea mays
  misc_feature: Ceres CLONE 1583470
MGVMAADHREGVCQCILVGLHMNSVAQDLLQWALHQGGQAGGDQHRLRADLSASPTRRTHWKLIRDAGTTTVPGIRRPSATRKQVGSPSCPGAPRGRLQSKKGSRLKGGHIFLRHPWDPGGLGAPNKKKNPPFRRGPCHASGP

SEQ ID NO: 93949 - DNA, 1053 bp, Zea mays
  misc_feature: Ceres CLONE 1583471
  misc_feature: SWISSPROT Homolog: EC 1.1.1.22 UDP-glucose 6-dehydrogenase
  misc_feature (1053)..(1053): n is a, c, t, g, unknown, or other
aagctggagctcaccgcggtggcggccgctctagaactagtggatcccccgggctgcaggaattcgtctcacccctagaaaaaactcgagacctaatccaagtcgtcgtctgcagcgagcgtctctcctctccctcgaatcgcgccaaggaagagagagagatcgccgctccccttctcggcgtcggtggtgcgggtgccctccctcctcgagcgagatctgtctggtcacacatctatctgacaacatggtgaagatctgctgtatcggtgctggctatgtcggtggcccagccatggccgtaattggcctcaagtgcccggacgttgagggacgacttcgggggcatctccagggcccgcgtttggggctggaagggggacggcttgccaatctacgagggctggcctggatgatggtggggaagaggtggggggggggggaagtttggttttcggcagttgtggttgagagagggcggtcggggaagggtggaaggttagcgttggtggggggagaaggaggctcgagcaagggggccggagggtgttggggaggtggggcagggggtgcgcgaaggctgcgcctggggctggggggagggcgcatggccggcggttggaggtggcgtggggggccgtgccgaggggttgggatgaggggattggtgttggtgtgtagggagtggggcacgtgttgtgttctcggtgggaggaagaggggcgcgggaggggtcgggtgtgaggagagagatatggtttgaagggttggcagacggtgggagggggtggtcgggaggagtgaggcatgagagcggggggagggggaggcctcgggagagttggcgaatgggagggggaggggagagaggagacccggggtgagaggaggagttggttggcagagtgcgtgagagtgacggaggggcgtcgcgggggggtggggggcgcggggtagtagcccgcggtggagggcagaggtgcagaggggcgtgtcgcagggcgatgttgggaagggagaggctgggcgcagcggtctgggcggtggggcccn

SEQ ID NO: 93950 - DNA, 1160 bp, Zea mays
  misc_feature: Ceres CLONE 1583473
  misc_feature: Encodes the peptide sequence at SEQ ID NO. 93951
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (65)..(65): n is a, c, t, g, unknown, or other
  misc_feature (66)..(66): n is a, c, t, g, unknown, or other
  misc_feature (68)..(68): n is a, c, t, g, unknown, or other
  misc_feature (69)..(69): n is a, c, t, g, unknown, or other
  misc_feature (71)..(71): n is a, c, t, g, unknown, or other
  misc_feature (72)..(72): n is a, c, t, g, unknown, or other
nnnaaaaaaaannnnnnnntttctcaaccctgcttccccccgggctccccccacaaaaaaaaacnncnncnncaaagctggagctccccgcggtggcggccgctctagaacagtggatcccccgggctgcaggaattcgtctcacccctagaaaaaaaaagatctcagagccacacagcgagcgcgagcgagaggcgcgctgttgcggaaatgccgctcccggcgttcctggcggcggcggcgaggctcgcggtcctgctggccgccgccgtgactgcggccaacgcggcctccttcgcgcgataccggcgccgccacctccgccgcatccccaaccccatcgacgagtccgccgaccccgtcgccgacttccacgccctccgccccgcctccgccgaggacgccgcagaagatgacagcttcttctttgggctagcgaccgcgccggcacatgtggaggacaggttggaagacgcttggcttcaggtttgcggtggagcactcctgcgacgacaaggaggccatgcgcgaccctacgacagcaaatgcggtggatggcgtccccctgcaggggaccgggagtgcctcaatttggccttcccccaaggggccgtccaggagggggatgaatgaataggggacggggcaatgccagggattcgagcaagtgtcccgagaaggaatgtgccccatgtgactcgccctacgaacaagccacacccaaactggccgaacggggagaggggtacttatgccagaaaaggagaggacggattggaatggagatgtcgtgtcggatatcaacccgcgcccgcccgcaatattagggtaggatgcagagtcctcgcctagatcccgccgagcgccgagtgccgtctggtgtatgcgcgctctggtagcgcagtttagatccccggcacctctcgcgtcgccgtgttatgacccggtgactaaagcgcctacaccgatctacgatcttatgagagaaagtgagcttaatagatgaacgatgtatcacgaaaaataccatctggtgtaatgacagtagttattcgagtggagggacttcaccagttgacatagtagcgcagttaatcgtagacagtgatctggtgatgcacccaccttatcaacacagataagaacgtccagagcgccgg

SEQ ID NO: 93951 - protein, 140 aa, Zea mays
  misc_feature: Ceres CLONE 1583473
MPLPAFLAAAARLAVLLAAAVTAANAASFARYRRRHLRRIPNPIDESADPVADFHALRPASAEDAAEDDSFFFGLATAPAHVEDRLEDAWLQVCGGALLRRQGGHARPYDSKCGGWRPPAGDRECLNLAFPQGAVQEGDE

SEQ ID NO: 93952 - DNA, 986 bp, Zea mays
  misc_feature: Ceres CLONE 1583475
  misc_feature (733)..(733): n is a, c, t, g, unknown, or other
  misc_feature (803)..(803): n is a, c, t, g, unknown, or other
  misc_feature (941)..(941): n is a, c, t, g, unknown, or other
ggagctccccgcggtggcggccgctctagaactagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcatgaagcagcagcagcgcaacgagctctgctgctcgcgattcccttctccctgctgctcctgccgggtctgctcccctacactgcaaaggcggggggtggcgccgggccaccaaaaaagacgggagcggggcccggcgcagctacccccaaaaagcgtcttgaagcctggcggccggttgccgcccaagaaaaagtccaccatgcaaaggggggacggggaggcgggaaggggggaagagtttgcccatgggggtacacctcttgcaggggaaaggtttatacagaaaacagggacctaggatcttttaagtaggatgtaacacctcgttgagagaagcgtataataaataacgtgtgagaggagtgacacgataatactgatacgccgtcggaccccgaaactggtagagggaggtggcagatatatagncaccatagactgtgcgggtctgtaacaacaccgcctatatgtagcgtctagagaagagagggaaggaganatcctgcacggtaggagagggagcatcccggcatccgtttaactgatggtagttacacactaggttcgagtaccacattgtaccgccggtcgagtggagggtatgttattgggtgtccttgtgtggggtagagactgngaacggagtgggagagagggggggttctgggtctctatgtgacag

SEQ ID NO: 93953 - DNA, 2141 bp, Zea mays
  misc_feature: Ceres CLONE 1583478
  misc_feature: Encodes the peptide sequence at SEQ ID NO. 93954
aaagcccacaactcatggacgacgcgtggccgtggctggcctccctgccgcctcctcttcgtgatgaagacgggcccgacacaccgttgccggcgccatggtctctcccgctcgctgcctccaccgacggcgcttccatcgtgctgcgggctgacacaagtcccgctgcttcttcgtctctggccgacggcgatgacggtaacggtgacggcgagcccgcgctgctcgtcgctttctccgtcgccatcaacggcgcaggcggcgacgcgcgcgcgctgtgggcgtccgaaggcttcgcggcgtcctcgccggtcgcgccgagggtgcagcttctggttcagctcctcaacgaggtactcgcgctctctccgtacgtcccttgcttgggcgcgggggttgacggtctcggcggggacgcgtccgaggccaaggtggacgcggagaccgtctccgccgtcgtcggcgccgctgaagccggtccatctgcgcccgccgcggccttcttctcgctcgctcttcttctgcggctcttctggctgtgtgcaaccgacgccccggcagacgctgggtacctctttttccgagaccttagatcggagatcgagcgcggcctcggcgagtgccggccggcgctcgccgtgttcctgcgctccgtcggcccggacgtcgaggaccggttcatgcgctcgctcgggtacatgctcgccaagtggtgcttgctgcgggacatgcaggctgctgccaggtcggcggccaaactggaagcaccgcgtcgccgtcgcgcgctccccgccgcgtgcctgtcgtacgccaccgaggtgcacggcctctggatcctgaaaggctacgcgcctgtgctcgccatgccgcgcgtcacgggccccgcgtccacgtccatcgccgcgtcgccgcacgagctgcccgaggagccggcgctgcggtacggcctggcgcaccagcagctggaggccgtggcgcagctggagtacgcggcgcgcgtgcgtgacaggaggttcgtaaccgtctccgtgcgcgtcgacaacgtccgggtacgcgtcgcgcggctcgcgttccgtagtaatgacggcggcgggaacgacggggaagaagcagaagaagacgacgacgccggcgtcgacgacatcatggacggcgagagccatttcccgtcccgtgtccgcctctgggtcggcccgcggttcggcgcgtcctatgccaccggcccgagcctcggccgctccacggggaacccagaacgcgacgtcgagatgacgcgcaccgttaagggcgccttctccggcgccaccaaaccagccaacggcggcgtcgtgcccaggatcaaggcgaagatgcgctcgtcggcgcggacgcgtagcaggagctggcgctgggagcaggaggccgagggcagcgccggggtgttcgagggggttctgtacgacccggtcaccgggacggaggtgtccgcgtggcgcccagctggtactggcggcggcggcggcactggaccgacagacccgaggaacggcatgagaaggcggtatggcgggcctgggcgagcgttcagcaagatgcgagggctggtggtggccggcgacgagctgccggaggagatgacgtggagggtggggagggaagcggaagggaggacgctgcgttggcgcttagggctcaaggcttgggtgacctacctgcccaacgaagcaaggagccgccacttcgagacccgctgcatcgagtgggcgcacgaggtggatctgccgcttctggccgtcgacggcgaccagagctaataaggattgatccaatcttcacctcgatctctttatcagcgatgtatgatattagaggctgatagttgtagatttacgttgcacctacttcggttgtagggatcgataggacgatagcacgtgaaacatttctaataattataacacgagaacatccgctgcagtaaaagataaaattttcagcgactaaagtcgttgtaaataaaccataaaccgtgggacataacttatgtccaacgatcaaagcattaaatccgacgatatctgtctctcaatcgtaacgggtcgaaaatatgatcaaagacttatatccgacgatatatatccctctaaaaaaaaaaaaaaaaa

SEQ ID NO: 93954 - protein, 592 aa, Zea mays
  misc_feature: Ceres CLONE 1583478
MDDAWPWLASLPPPLRDEDGPDTPLPAPWSLPLAASTDGASIVLRADTSPAASSSLADGDDGNGDGEPALLVAFSVAINGAGGDARALWASEGFAASSPVAPRVQLLVQLLNEVLALSPYVPCLGAGVDGLGGDASEAKVDAETVSAVVGAAEAGPSAPAAAFFSLALLLRLFWLCATDAPADAGYLFFRDLRSEIERGLGECRPALAVFLRSVGPDVEDRFMRSLGYMLAKWCLLRDMQAAARSAAKLEAPRRRRALPAACLSYATEVHGLWILKGYAPVLAMPRVTGPASTSIAASPHELPEEPALRYGLAHQQLEAVAQLEYAARVRDRRFVTVSVRVDNVRVRVARLAFRSNDGGGNDGEEAEEDDDAGVDDIMDGESHFPSRVRLWVGPRFGASYATGPSLGRSTGNPERDVEMTRTVKGAFSGATKPANGGVVPRIKAKMRSSARTRSRSWRWEQEAEGSAGVFEGVLYDPVTGTEVSAWRPAGTGGGGGTGPTDPRNGMRRRYGGPGRAFSKMRGLVVAGDELPEEMTWRVGREAEGRTLRWRLGLKAWVTYLPNEARSRHFETRCIEWAHEVDLPLLAVDGDQS

SEQ ID NO: 93955 - DNA, 792 bp, Zea mays
  misc_feature: Ceres CLONE 1583479
  misc_feature: Encodes the peptide sequence at SEQ ID NO. 93956
  misc_feature (30)..(30): n is a, c, t, g, unknown, or other
aaagctggagctccccgcggtggcggccgncttagaactagtggatcccccgggctgcttgaattcgtctcacccctagaaaaatcctagctccctcatcctcttcttctcctcctctttcttctcgaaccatcatcatatatatatatagaatcaatatggaaggagcggccgaccataagcggcaggtggacgacaagccgccgtacgccgccgtggacgacaccatgaccaccaccacgaagaagatggtggaggagcagctctcagacgacgccggcggcggcggcgagctgccagagcagaactaccgtggatggaaggccatgccctacgtcatagggaacgagacgtgcgagaagctgggcaccatcggcaccacggccaacctgctggtgtacctcaccaccgtgtacggcatgtcgggcgccagcgccgccaccctgctcagcctctggtcgggcaccgtcaacctggcgccgctcctgggcgccttcctcagcgacacctacatgggccgctacgccaccatcgccttcgcctccatggcctccttcctcggcatgatcgtcctcaccctcaccgccgccgtgccgtcgctccaccctgccgccaacagcggcaccaccggcggcccctcgtccctccagatggccgtgctcctcgcctccttcgcgctgctggccgtcggcgccggcggcatccggccctgcaacctggccttcggcgccgaacagttcgacccgcgcaccccagccggccgccggggcatcaacagcttcttcaacgggc

SEQ ID NO: 93956 - protein, 211 aa, Zea mays
  misc_feature: Ceres CLONE 1583479
MEGAADHKRQVDDKPPYAAVDDTMTTTTKKMVEEQLSDDAGGGGELPEQNYRGWKAMPYVIGNETCEKLGTIGTTANLLVYLTTVYGMSGASAATLLSLWSGTVNLAPLLGAFLSDTYMGRYATIAFASMASFLGMIVLTLTAAVPSLHPAANSGTTGGPSSLQMAVLLASFALLAVGAGGIRPCNLAFGAEQFDPRTPAGRRGINSFFNG

SEQ ID NO: 93957 - DNA, 921 bp, Zea mays
  misc_feature: Ceres CLONE 1583481
  misc_feature: Encodes the peptide sequence at SEQ ID NO. 93958
caaagctggagctccccgcggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggggcacggcaacttcgggcgggtgcacgcggcgcgggacctgcgcacgggccgcagcgtcgcggtcaaggtggtggccaaggacaagctggagcgcgcgggcatggcggagcagatcaagccggagatcgccgtcatgaagatggtgtcccaccccaacatcgtggagctgcacgaggtgatgggcacccgctccaagatctacctcgggctcgagctcgtcggcggcgggggagctcttctcccgcatcccgcgcgccgggggggggtccggggaggacctggccgcgccttttactttcccgggagctcgttcgccccggggtctgaatttttggccacgggcctggcgggggtggtttcccccccaaaaaactgtgaaagcttcaaaaaaaccttgcttctcctccagcgcaaggttagggcgaaacctctccaaaggtgggggcgggaaacttttgtgggggtttcaaaggcgcggctcttccgcgcggggggcaaaagagtcatcccc

SEQ ID NO: 93958 - protein, 194 aa, Zea mays
  misc_feature: Ceres CLONE 1583481
  misc_feature (17)..(185): Pfam Name: Pkinase Pfam Description: Protein kinase domain
  misc_feature: SWISSPROT Homolog: EC 2.7.11.1 Non-specific serine/threonine protein kinase
MEDAMAADGKSVLQGRYELGRVLGHGNFGRVHAARDLRTGRSVAVKVVAKDKLERAGMAEQIKPEIAVMKMVSHPNIVELHEVMGTRSKIYLGLELVGGGGALLPHPARRGGVRGGPGRAFYFPGSSFAPGSEFLATGLAGVVSPPKNCESFKKTLLLLQRKVRAKPLQRWGRETFVGVSKARLFRAGGKRVIP

SEQ ID NO: 93959 - DNA, 1251 bp, Zea mays
  misc_feature: Ceres CLONE 1583482
  misc_feature: Encodes the peptide sequence at SEQ ID NO. 93960
  misc_feature (48)..(48): n is a, c, t, g, unknown, or other
  misc_feature (71)..(71): n is a, c, t, g, unknown, or other
  misc_feature (72)..(72): n is a, c, t, g, unknown, or other
  misc_feature (765)..(765): n is a, c, t, g, unknown, or other
  misc_feature (867)..(867): n is a, c, t, g, unknown, or other
ttttttttgttttttgttttgatatttcggagagaaggaggagaaggnggcagaaacatataaaagagttnncaaaactggagctccccgcggtggcggccgctctagaactagtggatcccccgggctgcaggaattcgtctcacccctagaaaaactcgcctcgtccccaaatccaacccttcgtactcagtttccatcattggcatggcgtccgataccgagggcatcgccgccctcttctcgatgtacaacgacgacgaggaagaggaggatgccgacgagcccagccctccttccccagcgcttcccgccgccgtcacctcctcctcgccgctgtcccctcaagccggggccgaggaccccaacccttctgtggcgcctccgtcaccttcccgtcccgaggaattggccagtctccaaaacctagcgagtcccaccccttccccggcggcgggggtgctttcgccacttcccttgcggcgctctttcatcacccttttggcaggggggtcccccctcccccgttaagggggaaacgtttttttccgccccccgggggaaacctggccggtacccttccgggaaagcggggtggctcgttttgaaaaacgcgggaaacaaacgcggaaatcaaacaagaatacgggctattattttcgcccccctctttacccacagaatatagtagggggggagaaaaatatttatccctcaagtgacgacacaacaagtcactgatacgtagggaagagaaatgaattncatcatcgggcatgaagcatctacccaaggaagtgatacgatataatcgcatctttctggatattaagcagactggtgtgcgaggaatggataagtaccatncactcacccctaattctcaccaacaccttaccacgcatgatgtccacgtgaccggtctgcatcacaatagaaaatatatacggtactgcaagaagagcacagaaagatgtgcttataaatttagtagtgatacctattactttactaacctcataagacacaatatgataatgaggtaatagacaaggagatatatcttaagaaatattccaaagattatagagattgtaacttcatattttaaataatcaccaacgctatattctctctagtcgtagacgtgagagttgaagcgagggcagtgttcgtatacaatatcagtctcacggaacactggtgtgacgggggtaagtccgagatcgattcttgtctaccatatatgta

SEQ ID NO: 93960 - protein, 107 aa, Zea mays
  misc_feature: Ceres CLONE 1583482
MASDTEGIAALFSMYNDDEEEEDADEPSPPSPALPAAVTSSSPLSPQAGAEDPNPSVAPPSPSRPEELASLQNLASPTPSPAAGVLSPLPLRRSFITLLAGGSPLPR

SEQ ID NO: 93961 - DNA, 1049 bp, Zea mays
  misc_feature: Ceres CLONE 1583483
  misc_feature: Encodes the peptide sequence at SEQ ID NO. 93962
  misc_feature (12)..(12): n is a, c, t, g, unknown, or other
  misc_feature (26)..(26): n is a, c, t, g, unknown, or other
  misc_feature (1049)..(1049): n is a, c, t, g, unknown, or other
tttttttttttntttttttcctctcnccttctctcctctctcactttcttttggttttattgcgtttgtttgcagggacggtgagtgggtgggggttgcaaactggagctccccgcggtggcggccgctctagaactagtggatcccccgggctgcaggaattcgtctcacccctagaaaaaagactcggcaggacggcagcacaggtccacgcgggcgcggaggcaacgctatggtggctcgccgcttcttggtccggcatggccccgcagccggaggatcagccgaggcggcggaggagcaacagcacgaggtggagtacgacacggagcacggcctctacgtcctccgcctcctgatcttttccctctccgccgtcccgcccgacctccagaagatcgtggtggaggcggatgggtcggtggtggacgacagcgccgacctggaagccgtctctgagcgcctgcgcctccttgctatcggcgaggagggggaggaccacagggcagcgggcagggcgcaggagaagtccccacgaggaattcgcacggatgcttcacgcggaaggaagaggcacttctccctaccacgggtaccatattcaaaacgatggtgcgagatgtggttttaggacaaaagaggttagagcctgtacatgccacccagggttccggatggtatagaaaaaattcaggtggggaatcccggagggcggacaccaaaaggaacaggttgtccccaattattggcggaaccggggaagggaaacatacggccattttagtatttaccccttgggcccatggggagagggggaattttccaattcccctgccccaaaagattgataagaaggaaggccttgccccctttcccgagcctggcaagttgggctttttattttgggtgtgaaaaggcaatttcctctttcggaatggaggtgttatatgttctttccacccccttggggaacaagcctatgtggcgccctcccgaagaaacatttcactatgtgtgtgaggaaaccgggggccaccccccccgctttn

SEQ ID NO: 93962 - protein, 132 aa, Zea mays
  misc_feature: Ceres CLONE 1583483
  misc_feature: SWISSPROT Homolog: EC 3.5.1.52 Peptide-N(4)-(N-acetyl-beta-glucosaminyl)asparagine amidase
MVARRFLVRHGPAAGGSAEAAEEQQHEVEYDTEHGLYVLRLLIFSLSAVPPDLQKIVVEADGSVVDDSADLEAVSERLRLLAIGEEGEDHRAAGRAQEKSPRGIRTDASRGRKRHFSLPRVPYSKRWCEMWF

SEQ ID NO: 93963 - DNA, 2605 bp, Zea mays
  misc_feature: Ceres CLONE 1583485
  misc_feature: Encodes the peptide sequence at SEQ ID NO. 93964
agttccgctccaattgcttctgctgtgtccttttcctcccagcgagcaccttaccttacctctctctcctcgttgttgtgttgttgattgatcctggaaacctcagctccacaagctcccaaaaagcaacaacctttacatcgttgttcattgggagacaggagcgagcgagagagagagctcgcgacaaggttttgcccgcaccatatcgtcctctccccgcaagttccaaaagccaggtccagggactaaatagagcaaaggaagcctttcatcatcgtcgtcatacactaatcgaacgggagaatcggagggagggacatacatcacgtttttgtgctcctccgagtccgtccttctccaagatcccccattttccttctcgtttccaacctcctcctccttcctgaccgaccgatggcgatggtgtgacgccgccgcccgtccccgacaccgactgcgacctcagcatttccacaccgtctcggtctgggtctggtcttcgtctccgcctgcgccttcgttttgatccttaagctgagcttcccttcccttccccgaacgccacctccgcatgtcctaccatggcgctggcttcaatgtgatacgcggaggtgcggtcggtcggtcgtgaggaataggaagagggtaggagaggagaagaagagccagcgccggcgggaggggagatggcgggaggcgagggggagatgcggtcgctggcgctcacgcccacgtggtccgtcgccaccgtgctcaccctcctcgtcgcaggctcgctcctcatcgagcgctccatccaccgcctcagcaattggccgaagaaaactcatcggaatccactttacaaagcaatggagaagatgaaagaagaaatgatgctgcttgggttcatatctctgcttctggctgcgacgtcaagaatcatttcggggatctgcatcgactccaagtactacaacagcagattctccccgtgcaccaaagaagaggtccaagaatcgataaatgcagagcatgccattgctcacgcgcgcaagcatctactggaggtcatcctgcaccattcaccgaggagaaatctgaaaactagttaccataaccatgaaggctgccgtgagggatatgagtcatttgtttcgcatgaaggtttggagcagctgcaccggtttatatttgtaatggctgtgactcatgtgacttatagctgcctgacgatgttactagcaatactcaagatccataaatggagaaaatgggaggatgaagcattcagggataatcatgaatcattttctcagatcgcatatgagtcagcaactagaaggcaaccagcacttaccaaatcctattcattccgctcttggagccaaaataatgtggtcatgtggcttgtttgctttattgcgcaatttggtcagtctgttgttcgagcagactatcttatcctccgcaagggttttataatgacccacaatcttccgccaacatatgatttccacaattacatgatacgctcaatggaagaggagtttgagaagattgtcggagtgagtggactgttgtggggcttcgttgttgcttttatgttatttaatgtagacggatccaacctgtacttttggatagcaattcttcctgtaactcttgttcttctggtgggtgcaaagctgcagcatgtgattgcgactctaacagcagagggcgcaaagatgagcacctacgggccaaggatacagccaagggatgatctcttttggttcaagaaaccagagtttctcctttggttgatacacttcgttctctttcagaatgccttcgagttggcttcgttcttctggttctggtggcaatttggttatgattcatgcttcatcaaaaaccaccttttggtatattgccgccttatactggggtttgctggacagttcctgtgcagttacagtacattacctgtatatgctctggtcactcagatggggtccaagtacaaggctgcgctgatcccgcggaggatcagggagaccatacatgggtggggaaaggcgacgaggaagaagcgccggcgccgccgcggcgacgactcgacggtccgcacggagacgagcacggtgtgctcgctcacggacgacgacgaagacttcgaagacgaccaccatcaccaccaccacggaccgtcgtacgagaccccgagagccgggggccgcccgccgtacctgaagatcgagacgcatcgtcagtcgggcagcgggcacgacggccccaggcccgacggcaccccgtgcttccacaccagcggcagcgggcacgccatgctcctgcggcaggcctccgtctccgcgccgtcgtcgccgtcgtaccgcggaggcaataacgtgacaaggtctgcgtccatgcccgggatcgccgacgcgcgtgagccatgaggagcccacagcccacttgatgcgcgcccgtgcatgccattgctagtgcagacgtactgaggactgagctgctagtgtagcaccggatttgaaggtatatcgatatatatacacacgaaaaggtttggggtgaaaaaaaaaaaaaaaaaaaaaaaaaaaaaaaaaaaaaaaaaaaaaaa

SEQ ID NO: 93964 - protein, 578 aa, Zea mays
  misc_feature: Ceres CLONE 1583485
  misc_feature (6)..(483): Pfam Name: Mlo Pfam Description: Mlo family
MAGGEGEMRSLALTPTWSVATVLTLLVAGSLLIERSIHRLSNWPKKTHRNPLYKAMEKMKEEMMLLGFISLLLAATSRIISGICIDSKYYNSRFSPCTKEEVQESINAEHAIAHARKHLLEVILHHSPRRNLKTSYHNHEGCREGYESFVSHEGLEQLHRFIFVMAVTHVTYSCLTMLLAILKIHKWRKWEDEAFRDNHESFSQIAYESATRRQPALTKSYSFRSWSQNNVVMWLVCFIAQFGQSVVRADYLILRKGFIMTHNLPPTYDFHNYMIRSMEEEFEKIVGVSGLLWGFVVAFMLFNVDGSNLYFWIAILPVTLVLLVGAKLQHVIATLTAEGAKMSTYGPRIQPRDDLFWFKKPEFLLWLIHFVLFQNAFELASFFWFWWQFGYDSCFIKNHLLVYCRLILGFAGQFLCSYSTLPVYALVTQMGSKYKAALIPRRIRETIHGWGKATRKKRRRRRGDDSTVRTETSTVCSLTDDDEDFEDDHHHHHHGPSYETPRAGGRPPYLKIETHRQSGSGHDGPRPDGTPCFHTSGSGHAMLLRQASVSAPSSPSYRGGNNVTRSASMPGIADAREP

SEQ ID NO: 93965 - DNA, 847 bp, Zea mays
  misc_feature: Ceres CLONE 1583489
  misc_feature: Encodes the peptide sequence at SEQ ID NO. 93966
  misc_feature (781)..(781): n is a, c, t, g, unknown, or other
ctccccgcggtggcggccgctctagaactagtggatcccccgggctgcaggaattcgtctcacccctagaaaaagtctccctcccgccgtcccgccgccaccgcagcaccgctactgccggagtctctcgccaccgtcgttgctctcccgccttcaccgtgccaactcccctccttgcctcccccgcgcttcagtcgctccactccccatcgctttcgcctggtcagaattccagatccaggtgtcctttgacccagaccgcgcctgcctttccctccgctcggattcttcgccgtcttcgttcctactgggcaccgccggggtggagcggagatcggatccgccaggagctgattccttctctcgtagtctagtttgatgcggattcattcgctgaccggcatagcatgatcctgcggtgattgcggtcgcggatagcttgtgcaagctgttggcttgggagttatctttctaatctggcctaaagaaatcctgaggcggtagcgtcacatggatgcaagtacggaggttactgatgttattactgcagtgggcattgacaatgggccaacggggaagttgccgccccgtgatagtgtagaggggcacgcagaagaacacgacgtgctggctgatggaacgcattcgggtgagagcgaggtgatcaacccgtctgaagaagtgaaaaaggaagccacctcgcaatccccagacataaaagccccaagtttcctgaagggggttcaaagcccatttcacccgaaggggtggtaactaaatnctccgcgaacagaacccctccgggggcgggggaaaaaagaattgtaaagcccaggaaaaaatctta

SEQ ID NO: 93966 - protein, 87 aa, Zea mays
  misc_feature: Ceres CLONE 1583489
MDASTEVTDVITAVGIDNGPTGKLPPRDSVEGHAEEHDVLADGTHSGESEVINPSEEVKKEATSQSPDIKAPSFLKGVQSPFHPKGW

SEQ ID NO: 93967 - DNA, 760 bp, Zea mays
  misc_feature: Ceres CLONE 1583493
  misc_feature: Encodes the peptide sequence at SEQ ID NO. 93968
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
ctggagctccccgcggtggcggccgctctagaactagtggatcccccgggctgcaggaattcgtctcacccctagaaaaaagcaagctcatcagcattcgaccgctccagctagctgcagtgtgtagagccataccaaagcctgcttgtgttgtgttgtgttctcttctgctcctcgctcgcacgaataatcagttcaaaccaatggacgggaagaaggtgcaggagagggcggcatggggagccagcgacggcggcggcaacctggtgcaggacgccgtcgactacaggggctgccgggcggacaagtccaccacgcgcctggggggtgtggcggcnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 93968 - protein, 45 aa, Zea mays
  misc_feature: Ceres CLONE 1583493
MDGKKVQERAAWGASDGGGNLVQDAVDYRGCRADKSTTRLGGVAA

SEQ ID NO: 93969 - DNA, 847 bp, Zea mays
  misc_feature: Ceres CLONE 1583496
aaagctggagctccccgcggtggcggccgctctagaactagtggatcccccgggctgcaggaattcgtctcacccctagaaaaaaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcctcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctggcctccatcgcgactggcgtcctcatctggctcatcccgccccccgccggcgtgccccgcaacgcgtggcagctcctagccatcttcctctccaccatcgtcggcatcatcacccagccgctgcccctcggcgcggtcgccctcctcggcctcggcgccgccgtgctcagccgcacgctcactttcgccgcgggccttctcggccttcggcgacccgatccacctgggctcatcggcgctcgcctttcttccttggcgaaggggggttcatccaaggaccggggccttcgggttccccgcggtcgccagaaaaaccttttgttcggcccaccctttcgggggtccttccctccccctccggggccgtca

SEQ ID NO: 93970 - DNA, 808 bp, Zea mays
  misc_feature: Ceres CLONE 1583502
  misc_feature: Encodes the peptide sequence at SEQ ID NO. 93971
tggagctcaccgcggtggcggccgctctagaactagtggatcccccgggctgcaggaattcgtctcacccctagaaaaagcatttccggatcccctcctctcgcactccccattcccctccgccgccgtctcacgcgcccgcgacccacccggactcccgcttcgatctcgccccgattcccccgctcgcgcccccaacccgattcgtccctctcacgcgcgcgcgggtgggaagacagcgatggcttggggcgggggcctctctccccgccgcgggtgacctctcctcgcgcggggagccctcccgcgtgcccacgcggaggatcccgtcgcggctggtgcactaccacctcctctccattcgccactcccccgtgctctctcgcgcgtcccctcgaccatagatagggtttgctcccttccttcctcgccgcccgatttgatctcgtcccttccgggctccggctaggctgctccgtctctcctcctccgccatgttctcgcacggcgctgattccgcccacgacgccgggaccgttggcgtcagcagcggcgtcggggccaccgtccccgcccgcttcgtctggccctacggtgggaagaggggtctcgtctcaggctccctcaccaggtgggtcgggaacattttcccaattctcccggtcaaaggctcccccccggtttttcgggcttttttgccacccgggccccccggggattcctggagtccaaatttcttttgttgaagggggaaggggggtccttgatgggggcccaacccccctttattcggggggaggggtggggg

SEQ ID NO: 93971 - protein, 83 aa, Zea mays
  misc_feature: Ceres CLONE 1583502
MFSHGADSAHDAGTVGVSSGVGATVPARFVWPYGGKRGLVSGSLTRWVGNIFPILPVKGSPPVFRAFLPPGPPGDSWSPNFFC

SEQ ID NO: 93972 - DNA, 1143 bp, Zea mays
  misc_feature: Ceres CLONE 1583504
  misc_feature (12)..(12): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
gtggttgggttnctcccttttatatctaatttataaacaccggcagacgggggggggttnnnnccgcttttttttatactggagctccccgcggtggcggccgctctagaactagtggatcccccgggctgctgtgaattcgtctcacccctagaaaaagtcccctccaccaaaaccgaggacgacgtcgtctctcctccaccggtggctcggcgctctccctccaccagcggcggtccacagacgctcggcgagctccaccggcgggcgctggcggctggtcagatccgctcggcagtcatccacctggcacatcgggtagctacggcctccgttggcagtgccaccaccgcccggccctcccccagggccccccggtgatccggaacgttcccgcttgctcgggctagaaaacgggtcccgccccgccggagaccaagcccccaacgtcctcctggagggccaggcttaaaggtcccccccccccccgtggggattccgaccaccaaaacctccctaaagggcctaactttgtcggggctcccgcttttaccaaaaacgtctcctaaatcgggggggcccaaacgttcaccggagtaacaaagaaaaaaccccccggccccccccaaaactgttgagacgaaggggaaaggcccccctggtttcccgatttcccaaaaccccaaggtttttgtccaaacccgcccccccctgggggggggagaggggagaattccccaatttcctcccttttgttaaaagtggggcgctttttccgccccgcggttcccctattccccaattttggaagataccaaatattttctgccccatatctggtggcggggggaaaaccttccaccctcctgggggggtaaaaaaaaactcggggggtattgtgcgcccccgtggagaggcccgaagaggcacacaccccccaaatacctcttggagggggggtggggtgccccctttttacatcacgcgcgcgtgagggtaaaaatttcccctctacggggggaaaaacaggggggtggacacgccaacaccttgattgacccattacaaacaagggggtttggtggaaaacacccaccccccccccgttgtttgtccacagcaaccccgttttccaaagaaatg

SEQ ID NO: 93973 - DNA, 811 bp, Zea mays
  misc_feature: Ceres CLONE 1583509
  misc_feature: Encodes the peptide sequence at SEQ ID NO. 93974
  misc_feature (644)..(644): n is a, c, t, g, unknown, or other
ctcaccgcggtggcggccgctctagaactagtggatcccccgggctgcaggaattcgtctcacccctagaaaaaacccaaaactccgctctcatcccacccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggcgtagatttccggcggccatggggggcgccgtgatggtcgccatcgcggcctctatcggcaacttgctgcagggctgggacaatgcgacaattgctggagccgtcctgtacataaagaaggaattcaacctgcagagcgagcctctgatcgagggcctcatcgtcgccatgtccctcattggggcaacagtcatcacgacgttctctggggcagcggccgactgcgttggtaggaggcccatgctggtcgcctcggctgtcctctacttcgtcagtgggctggtgatgctctgggcgccaagtgtggacatcttgctcctcgcaagctcantgatggggtcggtatcggtttggcggcaaaacttgtcctctctacatcttcgaaactgggcccgacagcaatcgtgggctggtgaacacgttgccacagtttagtggggccaggagggaagttcccctcctactgcaaggggggttggggaagtccccccatgcccc

SEQ ID NO: 93974 - protein, 138 aa, Zea mays
  misc_feature: Ceres CLONE 1583509
  misc_feature (105)..(105): Xaa is any aa, unknown, or other
MGGAVMVAIAASIGNLLQGWDNATIAGAVLYIKKEFNLQSEPLIEGLIVAMSLIGATVITTFSGAAADCVGRRPMLVASAVLYFVSGLVMLWAPSVDILLLASSXMGSVSVWRQNLSSLHLRNWARQQSWAGEHVATV

SEQ ID NO: 93975 - DNA, 833 bp, Zea mays
  misc_feature: Ceres CLONE 1583511
  misc_feature: Encodes the peptide sequence at SEQ ID NO. 93976
  misc_feature (668)..(668): n is a, c, t, g, unknown, or other
ggagctccccgcggtggcggccgctctagaactagtggatcccccgggctgcaggaattcgtctcacccctagaaaaaaaaaaacaaaatcagctacccaccaccgtccgtcagcggcggcggggagagcatggcggccatcgtggcggcgcgagcgtcggccccaggcagggcggccgtcagcaccatcgccgcgttccacagccacgcgtccccttcccgcgcgctcccgctcgcctcctcctccatcggcggcgccaggcggtaccaccacgcccccgcgtgctgcttcgccaccaagcccaccgcgccggccgctgccgagctcgtcgaccaggacttcgccacggccacgcaggaggccgccaagccacgccggaaacgccggtctcggaaggcgaagaagtccgccaccgccgcccaggaggaggatgggacggacgacaagccggtggcggcggcagaggacaaggcgaaaaggaagaaagaggcggccggggccgaggacagcgcccggggcattggtgggccggcctcgacgacgtgatcgtcaaccccgtgggtctgggtcggcggtcgcggcaggtgttcgacaaggtgtggcgcaagttctcgcggctgggccagatttcgagcgcctcgcccccgcgctggcggaaggagagcangccgtggctatccgtggaggacctatgtgcgagttcactgtggccaggggcgcaggacaccaccgtcctcgtcggcgggggccaccagccggatcgggcgcatcgtcgtggcgcaagcttattgcctcccgggaaacatggccagggttttagtaagaaaaaccc

SEQ ID NO: 93976 - protein, 138 aa, Zea mays
  misc_feature: Ceres CLONE 1583511
MAAIVAARASAPGRAAVSTIAAFHSHASPSRALPLASSSIGGARRYHHAPACCFATKPTAPAAAELVDQDFATATQEAAKPRRKRRSRKAKKSATAAQEEDGTDDKPVAAAEDKAKRKKEAAGAEDSARGIGGPASTT

SEQ ID NO: 93977 - DNA, 839 bp, Zea mays
  misc_feature: Ceres CLONE 1583513
  misc_feature: Translation starting site: 425
caaagctggagctccccgcggtggcggccgctctagaactagtggatcccccgggctgcaggaattcgtctcacccctagaaaaataattcctcctaggtcgagactgctagtctcctctctctctctctatctctgtctctagctgcggcgactcaactggatcctcgtgtcacctccctgctgctgctgacgctgctgccggcaagatcaaatcgttcaaaagggtttttctttttctttatgggcgatttcgtgctcaaattgacatcttctaaccagtccaatgcacttgtcgtacccgtgtacaagaccctggatttcggcgaattctaaatggatcatgtgttttaggtgattggtgctttcgacgtcataagtgccttttgttcaattgctggacccccccacggagtgctgtcgacatgggatctccaagaggaaggatgtcatttcaccttcgtgcctttctgatgatctgcctcatggctcagctgggagcttccaatgttgtactcatggcgaacaacactaccctgtcgttcgacgacgtcgaggcagttcttactccagcagtgaaaggttcaggtataaatggtgtacatgtatgctgtggaacctatggatggctgcagtccattgaagacaaatgcgataggaggctctgtctcacgctttgctttggttataagaggcgggtgccatttggatgaaaaatgtagaaaagctcagaaggctggaattcaaggggggcgggagtatttgatactgaaagacaacggggtccccgggttccaatggatgggagaggctgcactggggggccacaggatagggcga

SEQ ID NO: 93978 - DNA, 804 bp, Zea mays
  misc_feature: Ceres CLONE 1583514
  misc_feature: Encodes the peptide sequence at SEQ ID NO. 93979
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (50)..(50): n is a, c, t, g, unknown, or other
  misc_feature (57)..(57): n is a, c, t, g, unknown, or other
  misc_feature (59)..(59): n is a, c, t, g, unknown, or other
  misc_feature (80)..(80): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (804)..(804): n is a, c, t, g, unknown, or other
nnaaaannnnnnntttttttttcatatcatataaaacaatagaaaaaaanacccttntntacgaggacccacctgtggtntttttnnnnnngccaaagcggaactcacgcggtggcggccgctctagaacagtggatccccgggctgcaggaattcgtctcacccctagaaaagggcgctgcagtagcgcagcgcagccacgccgcggcaacagcaacaccgcaccatggcgcttcttcttcatccccgcctcccgtcccatcctttccgcgcggcagcccaccaccaccacgccatctcggacgcctcttgcttccttacctccacggccccggaaaggagcgccgcatgctgctcgcggcggtcacgtgcccgcgcagcccagggtcaagggaaccccgcttccccaaacgcagggggcccttgggctttcggcccgccggcccaaaagggcccccttaaaccaaaaaggaaaggggggccccaaaaagttaattttttaaaaacccaaccccccccgggggggtcaaaaccccttttcccccccccccccgggggggcaaaaaaaaggggggggggggaaaaaagggggggccccccccggggggcccttcccccccaaagggcccccccccccgggggggggccccccccctctccccccgggaaaaaaaaccccccccccacaaaaaaccccccccccccccgggaaaaaggggttttttaaaaaaaacccccggggggggggccaaaaaaaaaaaaaaaaaaaaacgccccccaaaaaaaggggggggttttttctcn

SEQ ID NO: 93979 - protein, 166 aa, Zea mays
  misc_feature: Ceres CLONE 1583514
MALLLHPRLPSHPFRAAAHHHHAISDASCFLTSTAPERSAACCSRRSRARAAQGQGNPASPNAGGPWAFGPPAQKGPLKPKRKGGPQKVNFLKTQPPPGGSKPLFPPPPGGAKKRGGGEKRGGPPRGALPPQRAPPPGGGPPPSPPGKKNPPPTKNPPPPREKGVF

SEQ ID NO: 93980 - DNA, 870 bp, Zea mays
  misc_feature: Ceres CLONE 1583516
  misc_feature: Encodes the peptide sequence at SEQ ID NO. 93981
gagctccccgcggtggcggccgctctagaactagtggatcccccgggctgcaggaattcgtctcacccctagaaaaaattcctaggtcagacggacgcgcatccccgcacgcacgttcccgtgctctcgcagctcgcttctccagaggcgactagggtttgaaggctaccgagagggtgctactgggccaactcctccgaccgcccgcaggcgaaggagctctccgccttcccgccctcgtgtcatctttcccatcgcgacccgcgaggccacgagcccacgagctccagctcttgttattcggaagggttctggattaggtagccaagcgactggcgcagcggcagagcccggcggacacgctcccccctgtcgcccattctcttcctccccgagcggcacccccgcgtgttgccgcttgtagcatcagggagaaaaatacagaggaaggacatgagggatccatttgatgcaccggttgatctcattaatgtggaccataatggtggctatcaactatccaggactggtgcggtttctgctggggaccatggtttacaaaatgggtggaccccaaatccttgctccaaactccgacactgtagtcaggcatcaactccagggtgcatccttgcacaaagacttagctctttgagatcctaatactcgtatcatggattccgaagaccagggacttttactttggatcccaatccccaggaggacgagattcttgttgctttcccaagaaaattggctgaagcgtcttcttcagggagccttgagttttgtctgagtgaaaaaaccaaatttctgaaaaaggaagggttccacaaaacttttagggaatgggtttgttgaaccaaaaat

SEQ ID NO: 93981 - protein, 69 aa, Zea mays
  misc_feature: Ceres CLONE 1583516
MRDPFDAPVDLINVDHNGGYQLSRTGAVSAGDHGLQNGWTPNPCSKLRHCSQASTPGCILAQRLSSLRS

SEQ ID NO: 93982 - DNA, 953 bp, Zea mays
  misc_feature: Ceres CLONE 1583518
  misc_feature: Encodes the peptide sequence at SEQ ID NO. 93983
ggttttttttttttttttgtagtggttgctaactataattatataattttataaaaagaataatttggtttttgttaaaactggagctccccgcggtggcggccgctctagaactagtggatcccccgggctgcaggaattcgtctcacccctagaaaaaaaaaaaggaaaaggtcgggaaaaatccgaaatggccgctagtggcctcggtctctccacctccttcctccccggccacgacaccctcctccggcgccggcgccggcggccggcgggccacgccgccgcgtcgttccggccggtgacggcggagctcggcggcgtcgcgacggagctgggccgccagctggtggaggcggtgggcgtggggctcccctgcaccgtcatgcagtgcggcgacgtcatctaccgcagcacgctcccccggaacgacgggctcaccatcacggcccccggcgtcgcgctcgcgctcgctaccgtgtcgtacctctggtccacgcccggcgtcgcgccggggttcttcgacatgttcgtcctcgccttcgccgaacgcctcttccgcccttccttccgcaaggatgacttggtatttgggaagaagcttggggagggcgccattcggggtcgttgtgtaagggcttcactggcgaaaccccgaaagcggccaaataagcaaaggggatttgggtccgtgaaagaaagccaaccaaaggtatgggggcaagtgggaaaattttgggatgaaatgaaacgtggtcaaggagggcaatgccgcctagtaagcctgtgccggaattttatttttatggggttttttggccgagaaccaaagacaaaaaaaggtaaaagggaagccctgaaaaaaatattgggcctttatttttgggcggttttttgaaagggtggaaagaatccccacttttttggaatcctcccatggccaaaaacaaaat

SEQ ID NO: 93983 - protein, 235 aa, Zea mays
  misc_feature: Ceres CLONE 1583518
  misc_feature: SWISSPROT Homolog: EC 2.7.11.1 Non-specific serine/threonine protein kinase
MAASGLGLSTSFLPGHDTLLRRRRRRPAGHAAASFRPVTAELGGVATELGRQLVEAVGVGLPCTVMQCGDVIYRSTLPRNDGLTITAPGVALALATVSYLWSTPGVAPGFFDMFVLAFAERLFRPSFRKDDLVFGKKLGEGAIRGRCVRASLAKPRKRPNKQRGFGSVKESQPKVWGQVGKFWDEMKRGQGGQCRLVSLCRNFIFMGFFGREPKTKKGKREALKKILGLYFWAVF

SEQ ID NO: 93984 - DNA, 936 bp, Zea mays
  misc_feature: Ceres CLONE 1583520
aaagctggagctcaccgcggtggcggccgctctagactagtggatcccccgggctgcaggaattcgtctcacccctagaaaaactcggccggtttttaataccgcctcgtcgcccgtcgacattccgttcgccttcctcgcccccatctctttctcgccgtgccactcccacctcttttcgctgataagcacgccgctactccccactccatccatccatccacccgccgcttttctctctgctttggagagggagccgcacgcagtggtttggtgccgctggtccgccagggtcctgggcgctgtgctcattccaccggtcggcggtgggcttttcaggcttcttcgacggtgtcgagagtggaagaaatgtcgacgacggagtgcgcggacttcggggaggagttttggctgccggaagactttttgggacgaccacttcttctcccaagaagagaaggccggccgtggcagccccgaaccagaacgaacaaggaggacagccctggctggggctcttgggggcgccctcgcgggcccccctcagcgaacgggggggaaaagcaccaaggcctccccgccggccaaaggggggagggtgaacacgggttgggtcctccacaaatgccgaaacaccgggggcggggactgcccctaagtttgcgtgggcagggaaaagccccccggtgggaagagggggcgtccaaaaggggaacctatcgacgcgccccgtgcagtcggcacccttggatgagaaggaagggcccggccggagccacgggtgggagtccgggcgtccgaacaaaaggtgggtcacggaataaggggtgtagctaacatagtggctggggcggggctgaataagcgggtgagcgggtagaaaaagcgcgcggccaagtgggttcttcagctcctgcccaccaacccagagtgccc

SEQ ID NO: 93985 - DNA, 1019 bp, Zea mays
  misc_feature: Ceres CLONE 1583521
caccgcggtggcggccgctctagaactagtggatcccccgggctgcaggaattcgtctcacccctagaaaaaagcctctcgccatttttactcgtcggctggtccggccccagcgattcggtttggtgcgcctcgtggtccacgtgcgcgggctttgtgctctctcttccctctgtgtgtgtgtgtgtcagttcatcgggtaggttggtggcggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctgtcgcgggaacccgtgggggcgccgcctctgcgcgggggtggggccgcgggtcccggccgcccgggggcgttttccccccacccccgtcccccggggggggggccaaaacccgggggtttccttttgtcccggaaattctttgaaaaaggggtttggccctcccccctttttccccagagaccacatttgcccgggttaaaaggggctttccctcggggggtggcccccttcggggggggggcaaagattcccccccccgataaatgggggggggtttccaaaaactttccccccccgcgagagggtcctatgggggccctctgtgggggaaaaaaaaaagagcgtgaaaagggtgggggggaaaaaaaaaaataaaaaaaacacctttcttttttttttgggggggctgaaaaaatacaacccaccattaatgggggggggggggggaaaaataccggaaaagatgagaggattttttggaaacaccatttttaattagagcgtggaggagagacacacccccgaggggggggtcgcaccacccacaaaattaaggtggggggtggcgccctccctctttggggggaagggagacgcttatattaaaaacattaatctcgaaaaaatgagaggacacctcacacacaacg

SEQ ID NO: 93986 - DNA, 836 bp, Zea mays
  misc_feature: Ceres CLONE 1583522
ctccccgcggtggcggccgctctagaactagtggatcccccgggctgcaggaattcgtctcacccctagaaaaaaaggcttgcgtgttctcaccccttgcgttctcttctgttctctctctctcacacaaggtctcaccctccctgtatccctctgaccctctcggcggcgactgggcgacagccgctgtctcactacgcctggtgcccaggtatctctgccggcgacgagcacctgccaggggtatgggaatggagggtcgttgggtgctgaagcagcaccagcagagatcaaagtatctgatgatgtgaatctattccaagagaaggaaagcaaagcaactgctaaagaacgtgaggaagcagctgtttttggttcagagacaactaccaatgtcactgatctggcacctccaacggatgtgaaaagatgagtggccctgaacctaacaaacttatgccttctacttcatcaaaggccgctcattttgaagatccctaaactggagggaaaaactcgaggcagctgacaaaggatttccagaagaagatccaaagctcgttcctaaactttatcaaggcagtaagagcccaagatggagagcgccccccgtttttttcgcggaactgaagccctttgagcgccggagacaagcaatttttatggaagttggggattgagaagaataaagggaaatgggaccctcctcccgaaacaaccttggggcaattttcctggagggaaaacaatgcccttgaaagcccccgaattggcagggtttttgctcctttcttttcgaaaaaccttgaccctaacgattcaaaaaggccgaaatg

SEQ ID NO: 93987 - DNA, 901 bp, Zea mays
  misc_feature: Ceres CLONE 1583523
  misc_feature: Encodes the peptide sequence at SEQ ID NO. 93988
  misc_feature (416)..(416): n is a, c, t, g, unknown, or other
  misc_feature (422)..(422): n is a, c, t, g, unknown, or other
  misc_feature (901)..(901): n is a, c, t, g, unknown, or other
ctggagctccccgcggtggcggccgctctagaactagtggatcccccgggctgcaggaattcgtctcacccctagaaaaaaccccagctcactcgtgccgtgcactcgacccgtcccccctccctccactcgatccacccgccaagacctcccattgccgccgccgagccagccagggggggagaagagaggccagccgcgtcgcggcgggcggaggaggaggacgagcgggagagccgagccgagccggccgggcaggatgttcgggcgggacccctggggcgggccgctggagatctccaacgccgactcggcgacggacgacgaccggagccgcgacctggaccgggcggcgctgatgcggcagctggacgagacgcagcagagctggctcctggccggggccggcgaccagnccggcnagaaagaagaagcggtacgtcgaccctcggctgcgtcgtcgtcgaccgtaaggtcttcatggtggaccgtcggcaccatcctcgggctcgggggtcttcatcggctttcgtcatcatgatcggtaaagcttcgtcccgaaaaaggggccccccggcggcggcggcccggaaaaataaaacgcaagggccctggccaaagggggcctcatggttttttaaaggcgcaaagggatcccgggcccccttgcccaaaaaaacaagggccttaaacttggaaggggcacacccccggcctgaaaggggggggctcttccaaaaaaaaaccttccccccggaaaccttggtggggagggtttctcccaaccgggggggaaccccccccaggttcaacctcccccccgtgggggggggcccaaaaacaatgtgcttcacggggggggggtgtactaaaaaagagggcccaaatttagggaggcccn

SEQ ID NO: 93988 - protein, 93 aa, Zea mays
  misc_feature: Ceres CLONE 1583523
  misc_feature: SWISSPROT Homolog: EC 3.2.1.4 Cellulase
  misc_feature (53)..(53): Xaa is any aa, unknown, or other
  misc_feature (55)..(55): Xaa is any aa, unknown, or other
MFGRDPWGGPLEISNADSATDDDRSRDLDRAALMRQLDETQQSWLLAGAGDQXGXKEEAVRRPSAASSSTVRSSWWTVGTILGLGGLHRLSSS

SEQ ID NO: 93989 - DNA, 1188 bp, Zea mays
  misc_feature: Ceres CLONE 1583524
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (18)..(18): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (1188)..(1188): n is a, c, t, g, unknown, or other
aaaataaaannnaaaaanattcggatttactctccccccccttataccatttttgtaggggttnnnnncaaaactggaactccccgcggtggcggccgctctagaactagtggatcccccgggctgcaggaattcgtctcacccctagaaaaaacctagctccctcatccacttcttctcctcctctttcttctcgaaccatcctcatatatatatataaaatcaatatggaatgagcggccgaccataagcggcaggtggactacaagccgccatacaccgccctggactacaccattgaccaccacccccgacaagatggtgtcatgagcagctctcaaacgacgccaccggtaaccggcgagctgacatagcagatctaccttgcatggaaggtcatgccctacgtcatagggaacgacacccgcgagatgctgggcaccatcggctccacggccaacctgctgggtgtccctcatcgcccagtacggtatgtcgggcgtccaacaacgtcaccctggctcagccttctgtcgtcgtctcccttagcaccttggcgcctttcccataagccccctttcctaatttgcccaccttctctggggggcggttatagacgacccgtcgtcacttcagtccaccaatggggccctccattttctcgcggctattgataccagtcacttcgcccctctaaaactatctcttccataagccccgatctaccatccgagcctcatggccgggcctccataccgcagcgcgtgttgcctgacacaaccgcattaaccccactttctcggtgacgcaatatcctcccaataggagagccccaatgggcacccttctcaccactacttcaccctcttttcacgacatcagatactgaacatcccaatctcacaccatcttaccgctcacgagaacactaaaccggggcctcccatatctctaatacccagcgcttccctttcttgtgggccgctttggttatcaccattagattaccagacccccccgaggggcgcactcctcggatcctcactggtggtaatatcttggttggcgacatcatacctcaacgacttctacactttcactactcttcacagctatattatacgattttacactttgttttcagctctttctttgcccccaccttgatctattgcgcgtttccccctn

SEQ ID NO: 93990 - DNA, 1166 bp, Zea mays
  misc_feature: Ceres CLONE 1583528
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (50)..(50): n is a, c, t, g, unknown, or other
  misc_feature (53)..(53): n is a, c, t, g, unknown, or other
  misc_feature (55)..(55): n is a, c, t, g, unknown, or other
  misc_feature (1034)..(1034): n is a, c, t, g, unknown, or other
tttttttttttcntnnntgttgtgttttgccgcttattggtttgctttgnggngngcccggctatatacaaactggactcacgcggtggcggccgctctagactagtggtcccccgggctgcaggattcgtctcacccctagaaaaagctctgctctccttgcatagggtttatcttctcccctcctctgcccccatctcgcttctcgcacacggcagccggattccgaagcgcgccccctcggccccagccaaaagcatcgcagtttctaatcgtttggagagcacacaagaatgtcgtttcgtgcagctctctgggtgctggaagtcgctgcaatgggccttccccgaaacaaagagccctagtcttttcgggcaaccaagcgctatcgggtctgctctgtcgaggcccctcgaacccgtaaccctggggctgttaaagggttccaacttttttttccccccccaaaaaaaaaaaccctttacctgaaaaacctcttggggaaaaaaataggggtccttttttaaaaaattttgttgtcccccccaaaaagaaaaaaaaaccccctgggggggggggaacttttttgttccctcaaattatacaggggggcccagaacttttatatccccccctcgtgcgagaggggggagaggattttttcttttcctccctcttcttggggggcccaccccataaggaggggaatactctttgggtggtgggggaaaaccgaaagaaataaaacaatcgtctatggtgtccgatacttaatatgaaaggacggagtgggggggagcaccaatcaaataagatatagattatgtctatattctctacacccaaaaaaaccaaacctcggtttggtgagaggataatgaatatcccccccccaacaagaaagatattatattggatcgcccacgatcacaaaacccctccactattattttttctctcgcctccgaaggtgtgagacggagtggcgcaatggtcgcctatatcgttaggttaacaatctgtatctatctacntgagacgaaagaagcaaaatggataagatgaaatatagaagtacgttagcgagcaaccgtttatacattatatttcagtctcccgtaagataaaaaaaaatagagcgtatagtaatgagtaggacgataaag

SEQ ID NO: 93991 - DNA, 720 bp, Zea mays
  misc_feature: Ceres CLONE 1583529
  misc_feature: Encodes the peptide sequence at SEQ ID NO. 93992
aaagctggagctccccgcggtggcggccgctctagaactagtggatcccccgggctgcaggaattcgtctcacccctagaaaaaactggattccatctgagcgccgccactccctgacatcgagaccggatgcacgaccccgggccggcgatacgctctgcacccctttctttgtgctgcgagccccaatctctcgcatccctgtcaaccatggctgcgtcagcaagcggaggcacggtgctcgcgctgtccctgaacgagcaggacatacagatgatgctcgtgggcccaacgtccaccttcgggcaccaaagaaacgggacaattttccccacaaagggagggggggaaatggtccctttataagggaggttaaaacccccccgaaacgggtaaattgggggggttttaccctccccccggggaagccccccatttgccctttttttttaggggggttttccttcccccccccaagttgggaaaaaaaatccccccctgtgtttataaaaatattttttctcggaaaaacagggggggataaaattggggaggggggaaaagacccctctcggcggggggccccctcctaaataggtttttccccccccgaaaggggcgcgcccgaaaaaaaaaaataagacccccccccccggtgggggggggggggggaaaaaaacaaagggcggggtttttgtcttgggggggagaaaaaatttc

SEQ ID NO: 93992 - protein, 51 aa, Zea mays
  misc_feature: Ceres CLONE 1583529
MAASASGGTVLALSLNEQDIQMMLVGPTSTFGHQRNGTIFPTKGGGEMVPL

SEQ ID NO: 93993 - DNA, 797 bp, Zea mays
  misc_feature: Ceres CLONE 1583530
  misc_feature: Encodes the peptide sequence at SEQ ID NO. 93994
ggagctccccgcggtggcggccgctctagaactagtggatcccccgggctgcaggaattcgtctcacccctagaaaaaccctcctctctcctcttcttcttcgtcgtggtgttggtgtggggcatctcgcaccccacccatccctgtcctcccgctcgccggtgcgcgcgcttttctagggtttccgctgccccagccgccaatcccgctcacctctcgtcaccggcgatggcgtcggcgtcggtgtcggccccggtggcaggggcaggggccgggggcgggaaggacgaggagctcgccgatctggtgcggcgcctcatggacgccctcgctcgctacgctgatcgcctgcccttcgaccttgatcgccaggttcgcgctcggatctgtgatctccacctgcggtctgttgacgcctttttgaccagtccatgcctcgttgcgtgggatttgttgggtccggccgcccaaagacgccgccttgtttgggaaaggctttattctgagtactattgtctaggtagtgttgtgctgttctcgggtaaaattctaggttcccaatcatcgtcgatatagtaatgtttttttttgttgttgtcgcggatgcttgggcttcgaatgtataagtcgattagggtttaaggttctttgccaaattgtaaacttatacatcaaaatcacaggatacgaagggtttgggggaaatatatgggaagcaaagaacacaacaaaaattcagatgttatatgcttccgtaaaccctaaatcctaaccatatgtgtgtatatatataggga

SEQ ID NO: 93994 - protein, 115 aa, Zea mays
  misc_feature: Ceres CLONE 1583530
MASASVSAPVAGAGAGGGKDEELADLVRRLMDALARYADRLPFDLDRQVRARICDLHLRSVDAFLTSPCLVAWDLLGPAAQRRRLVWERLYSEYYCLGSVVLFSGKILGSQSSSI

SEQ ID NO: 93995 - DNA, 844 bp, Zea mays
  misc_feature: Ceres CLONE 1583532
ggagctccccgcggtggcggccgctctagaactagtggatcccccgggctgcaggaattcgtctcacccctagaaaaagtatcggatatgttctttctctttctctcgctggccgcgcgggtgctccgcgtgcgctctgtgtcgttccctctcttgtgaggagtgaggaccactggggcgactgccgctgccgccgccgccctacgccatatgctctggtagggggcaatcgctagctcttcttcgtgcccttcggcggcgaggagcattcaccagttgctgatgcgaggattacataagttatacagtctcgcttgatgcggaagcaacacaatcactctaaagagtttggatcagttcatttcagatcatgggttcgcggtttccatcccatcatctaagcaatggcttgtatgtctctggccgacctgagcaagctatagagaaggccccagtcatttgctcctcggctatgccatacactggtggggacataaagaaatctggagaacttggaaagatgtgtgatctccatataaaatctggtccattgggtaatccgccttcaaggaatacttcctttggtggtgctgccgccaactctggaccagtttccaatgctgtctgtcgctccaactactctggttgtatttcgtctgcaggtcctggcactggaggatcttctaggacaaaatgtaactctggacactctcgagcagcatggagcaccaacaaagaggctatctggcccccaatctttctgagtaaacccgatgggcccgtcagaactctggcccctctacatcctggtacttctacaactgggctaattacatcaggtgct

SEQ ID NO: 93996 - DNA, 913 bp, Zea mays
  misc_feature: Ceres CLONE 1583534
  misc_feature: Encodes the peptide sequence at SEQ ID NO. 93997
catagctggagctccccgcggtggcggccgctctagaactagtggatcccccgggctgcaggaattcgtctcacccctagaaaaaagaggtcgccggtcgccaccaccaatggggccacccgccatggggttccaagccctcacggtcacgccactccccttctcactccacagctcgagccgccgcgtccgcgtgcttgaagttgcggccgaccagactcctccgcccggccccccttcggagccagcgaacagccctagccgcctccttcgcgagctctcgcagcggaagaaggccgcatcccctaagaagaagcatccgccgcgtcgctgcatcctgaaaccacctctcgatgacgagggccttacccggcggttcctcagcagcccgcagctgtcgctcaacgcgctaccgctgctctcttcctgcctcccctccgcgccgctctccaccgacgacaggacctggatggacgagtacctcctcgaggccaagctggcgctcgggtacacgctcgcgccctcagagacgctcggcgaatgcgatgactgccccgcgcgtcatttagatgtgctgttctacctcgcgttccagcatctggatccctctagcgagcgcacgcagatgcggcacgtacggaacagccactcgcaggctctggttccctgggccagaaacatcaaggagctcgcggttccggggagtacttccttgcagagggtacccccaagggagtcagcgtggggacaaataagggaagcggggtggttcggccccaaaatttggggaaaaaaaaaggggttgccctcccattgggccccaaaggggtgggcaagaccttggacaccaatttttggggccttgtgccacccattgaaatgaatttgcgcgaaaaaggatccggaattacca

SEQ ID NO: 93997 - protein, 257 aa, Zea mays
  misc_feature: Ceres CLONE 1583534
MGPPAMGFQALTVTPLPFSLHSSSRRVRVLEVAADQTPPPGPPSEPANSPSRLLRELSQRKKAASPKKKHPPRRCILKPPLDDEGLTRRFLSSPQLSLNALPLLSSCLPSAPLSTDDRTWMDEYLLEAKLALGYTLAPSETLGECDDCPARHLDVLFYLAFQHLDPSSERTQMRHVRNSHSQALVPWARNIKELAVPGSTSLQRVPPRESAWGQIREAGWFGPKIWGKKKGLPSHWAPKGWARPWTPIFGALCHPLK

SEQ ID NO: 93998 - DNA, 961 bp, Zea mays
  misc_feature: Ceres CLONE 1583536
  misc_feature: Encodes the peptide sequence at SEQ ID NO. 93999
  misc_feature (1)..(1): n is a, c, t, g, unknown, or other
  misc_feature (34)..(34): n is a, c, t, g, unknown, or other
  misc_feature (38)..(38): n is a, c, t, g, unknown, or other
  misc_feature (70)..(70): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (76)..(76): n is a, c, t, g, unknown, or other
  misc_feature (481)..(481): n is a, c, t, g, unknown, or other
nttttttttttttgtgtgtgtggttaaccccgcntgtncggggggaggtggtgttcccttttttgtgttntnnngntaaaactggagctccccgcggtggcggccgctctagaatagtggatcccccgggctgcaggaattcgtctcacccctagaaaaaatcggcattcggccgtccccagtccaccggaaataattgccttgatcagcaacgatggcgggagatccggccgccggggtcggcggcaacgcccaccccgcgtcggggagcaagagctcccgctcgtcgacgcggcaccgtcagttccgcgaccgagccaaggtccgagtcgacgacctacaagagatgttctgcggcctccaatccgctcgcaaggagagccgctccgccgacgccgctgtcctcgaggagcaggtccaccagatgctccgcgagtggcgtgccgagctcagcgtcccatccccggcttcctctctccanaactcgcaggggaacaaccgggaggcttcggatccaccgtcggatacgctgcgactgctgcagctggcggtgcccgaggaggaggacgatgccagcagtaagctcctggtgcccccttctcgtcagacccacgagcacgggcaggacagcaggatggccaatactgatcagcagtgtgaagctatagatggggggcactgcttccctgcgcagcaactctctaggttcagggaagtggaatggagaattggtggagaaagtgtctttctggtggctaatggcaatgttccaaatcatccgggatgttacttataacagacctatggaactttaataattggaaggatttttcctgtggtggggggaatgggttaacaaaaaattaaataatttccccggggtttcccaaatagaaaaattccaagtttccaaataaattcccggcccttgggggaatttggggccccagcgtttgtggga

SEQ ID NO: 93999 - protein, 193 aa, Zea mays
  misc_feature: Ceres CLONE 1583536
  misc_feature (89)..(89): Xaa is any aa, unknown, or other
MAGDPAAGVGGNAHPASGSKSSRSSTRHRQFRDRAKVRVDDLQEMFCGLQSARKESRSADAAVLEEQVHQMLREWRAELSVPSPASSLXNSQGNNREASDPPSDTLRLLQLAVPEEEDDASSKLLVPPSRQTHEHGQDSRMANTDQQCEAIDGGHCFPAQQLSRFREVEWRIGGESVFLVANGNVPNHPGCYL

SEQ ID NO: 94000 - DNA, 1217 bp, Zea mays
  misc_feature: Ceres CLONE 1583537
  misc_feature: Encodes the peptide sequence at SEQ ID NO. 94001
  misc_feature (1)..(1): n is a, c, t, g, unknown, or other
  misc_feature (13)..(13): n is a, c, t, g, unknown, or other
nggtgaaagtttngggtgggtggggtgtggtgagctaccaaactaactctaatcgccgcgccccccctcaatattaaaagctggagctccccgcggtggcggccgctctagactagtggatcccccgggctgcaggaattcgtctcaccccctagaaaaaaccgaggcgacgacgcaagcagctcagcgcgccgccgctgccccgtcccgtcccgtcccgcgccacgccggcgcctcccaccccgtgcgcgccggatcctcgttccacgcgccgcggcgccgcccctggaccggtcgagaggagcggagatccatccatccggccgtcggtcggtgtcgtcgtctgtcgttggctgtaatgaaaagctgggcctgctagagccaggagttatcgttgcaaatctgcgtctccgctatgggttcaggcaacttgatcgtgaagaaggtggtaaagcacagctcttttgatctggacgttcagctcgataagagttggatggaggacgtttcctgccccgaactgcctttgattacccatcacaatgcagtcgctactagagatgcaccatcttaatgaagaaaaggctggcagggccgggttgttttgttgaaaccagaaccaataccccggatcacaaacttgccctttggagaaggatattaacagatcccgtagtaatggaaaacgggaccttttcccccaagggcccgaaaagaggttttccacatcttttattgtaccgaagttggccccctcccgtgggttcggtactgtggtgcctctcctatagtggaccttaaattgaggggttgccgcacattccctaagaaagaccgaggaacacaaacccctggcaccgcacaatatcgagttgccccctctccgtggagcgtaaagcgtgaagtctggaatgtgttttaacatttcgctaccgggggacaatgtctgccctcatcccaggtcacaggggtaccgtcccatactacatgatacatcggttgtccgcgccacgggtgtgaggagaagagcgcggtagtatgtcgtgatgcgtcaggactgtgcatttagaataaggaatatgtcatatgatccacgctacatagtcacaaacaaacacgtctatcatacaccgacgacgaaagacgcagtagatggatgaatatgacatatacagcggtaggagcgggaatgtttaggtggtggatcgtggtagcgc

SEQ ID NO: 94001 - protein, 52 aa, Zea mays
  misc_feature: Ceres CLONE 1583537
MGSGNLIVKKVVKHSSFDLDVQLDKSWMEDVSCPELPLITHHNAVATRDAPS

SEQ ID NO: 94002 - DNA, 1000 bp, Zea mays
  misc_feature: Ceres CLONE 1583538
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (53)..(53): n is a, c, t, g, unknown, or other
  misc_feature (72)..(72): n is a, c, t, g, unknown, or other
  misc_feature (73)..(73): n is a, c, t, g, unknown, or other
  misc_feature (1000)..(1000): n is a, c, t, g, unknown, or other
nnnngggtttgggtttgtgtacatttctattttacttgtggggcggaattatnagactgtcggggggccttnnctcatatgctggactccccgcggtggcggccgctctagaactagtggatcccccgggctgcaggaattcgtctcacccctagaaaaacccttcactccccgaagtccccactccccactcccccaaagctctctctctacctccctccctccccctcttccaaggcttctcctttccgccatggcctcctgctagtgtcagctcccgtcgcaacgcctcccagatcccggacgcagcgtgccgcaccccgcgacggccggctcgcaacatgggagggtgtcacgcgaagccgctcacccacgacgcggaccgctcgccgccgcacgcagcgccggcgaccccgcccccgggctccgccacgcccgccaccccccgccccgggaacaaccactgggcggtgtcccccccccccacgttctccacgccgagcccgagccccgcgcaccacctcttcagcggctccgcggcatcggccgcgcaagtcccccgctccgccgggctccgcgcccaccaccccggccagacggctcctgaggctgcccttcccgccgccttcccccctccaagcacatccgggccgaggctcgccaggtccccacgagaccgcccgcgggccgtcctaatccccaacggaaaggcaacctgccaaaggggaaaggggcgccccgccagccagactggaaggcatggggccctaccaaccaaggggttctgggggttccaactaagggaggtgtggcgggccttaacttatgaactttgcggggcatcgaagaatccgaaaaaaggggggcaacctttccgggttaaaaacatgccgcccggtcccattgatttaaacaaaagggcacccccccgccaaaggtgggaaagatccacctagggccccgtataagggtttcgttctccccctatagggcgaaaatn

SEQ ID NO: 94003 - DNA, 937 bp, Zea mays
  misc_feature: Ceres CLONE 1583543
  misc_feature: Encodes the peptide sequence at SEQ ID NO. 94004
  misc_feature (880)..(880): n is a, c, t, g, unknown, or other
ctggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgggctttgatgccaagcgtctcatcggcaggaggttcagtggatgccgtctgtccagaagtgatatcaaggttggtggccctttcaaaggtcatttcttgggccctgggtgagaagccaatggattgtttgtcccagccccaaggggggagggagaagacaatttttggcagcctgaaaggagatcccccccctatggggtcctttatcaaagatggcggggaagaattgccttgaaagcctttacccctgcggggggccccggattccaaaaaatggctgggtgggggcaccaaggccccctggccctaacttttgagatggacgtcccccaagagggcggggggcccccgcaatgggaagtgctcgggggggcgaatttgccctgcggccctttaatgaggggggcggcaattgcgctgcaaccggagcgccacacagggttgtgaacgacatttacgccctagggggggcgtgggagacaagggaaggtgcgtccccggggggggntgtggaaaaaagaaatatgtgccctgccttgtgttgttaatctcggttgaggaggag

SEQ ID NO: 94004 - protein, 71 aa, Zea mays
  misc_feature: Ceres CLONE 1583543
MAGKGDGPAIGIDLGTTYSCVGVWQHDRVEIIANDQGNRTTPSYVAFTDSERLIGDAAKNQVAMNPINTGL

SEQ ID NO: 94005 - DNA, 839 bp, Zea mays
  misc_feature: Ceres CLONE 1583544
aaagctggagctccccgcggtggcggccgctctagaactcgtggatcccccgggctgcaagaattcgtctgacccctagaaaaacttcccaaaccctagcatctcaaatccgccggtcgccatggcaacgttacggcgctgggcagacctgccggaaaatctcctctgccgcatcggagaccggctcgacctcaagtggtacaccagcgcgcggggcgtctgcacagcgaggcgctgcgcgctcccgccgccgacacccgcgctcctcgtggtcgctgactacactcgctgttgcccctacactgcctcccgtccccacgcggaggtcattcgagctcaccgacgtcgtatcgggaagccgctgcattggctccagcacacggctggatcgcgctctacgtcatcctcttcaacggggagaccgtcttcgtgctccgcaaccgcatcggcacggtggagatcctcctcccgccgctgatctatgagagccgctgggtttccaaggtcgtcttcaccccgagaccagcctaagatgactacactgccgcggcaatctgcgatatcgacaggatcgcgtacatcaacgccagtgccaggacgtgggccgtcatggacctcgtccgcctcacctgcggggaccagctcaccgacctcgtatacaccggataatgtaaggtctattgcctaactcagtgcagggacgtgcatgtgctccgatcttcctgagcgccggagccggaagcctgcccacgctgatgaagcaagatcctcgtgagccagagttgtctgttctccagtcatcacaacctaatgagcacactattacagtctcgaccacg

SEQ ID NO: 94006 - DNA, 875 bp, Zea mays
  misc_feature: Ceres CLONE 1583545
  misc_feature: Encodes the peptide sequence at SEQ ID NO. 94007
aaagctggagctccccgcggtggcggccgctctagaactagtggatcccccgggctgcaggaattcgtctcacccctagaaaaaattccaaatcctcctctgcaattttctcatggcagctgacgtttccatcccaactcgatccgcgtcaaccgcccgctaattcctcctagttctagtcccctctctcctgcgccgactcatctttttcctcgtgtcactcccctgctgctgctgctgccgggaagatcaaatcccgtcaaaagctctcggcctgatactcggcattagtaccttctgttcgattgcaggctccaaaggatcagagttctgtcaagatggcatgcccaagaggaaggacaccatttcccctttgtttctttctgatgatttgcctcatggctcagctgggagcttccaatgttgtactcatggcgaacaacactaccttgtcgttggatgatgtcgaggcaacttttactccagcagtggaaggttcaggtgtaagtggcgttctttatgctgtggaacctaaagatgcatgcagtccattgagagcgaaagcgattcaaggctctgtctcaccttttgcgttgattataagaggcgggtgccaatttgatgacaaaattagaaatgcacagaatgctgggatcaaagctggctgtaggtatttattaatgaagaatattgacatccttgttttccatgggctggaaggctcgcttggtggccaggatatatggcaggggttctcctcctaaggcatccggggggaggaagctgaagaaaaattttccgggccaaaactgatggcaaagtttttgggataatacccaacatttgggaaaacctcggccttggggccaaccagg

SEQ ID NO: 94007 - protein, 141 aa, Zea mays
  misc_feature: Ceres CLONE 1583545
MACPRGRTPFPLCFFLMICLMAQLGASNVVLMANNTTLSLDDVEATFTPAVEGSGVSGVLYAVEPKDACSPLRAKAIQGSVSPFALIIRGGCQFDDKIRNAQNAGIKAGCRYLLMKNIDILVFHGLEGSLGGQDIWQGFSS

SEQ ID NO: 94008 - DNA, 803 bp, Zea mays
  misc_feature: Ceres CLONE 1583547
  misc_feature: Translation starting site: 150
  misc_feature: SWISSPROT Homolog: EC 3.3.2.10 Soluble epoxide hydrolase
  misc_feature: SWISSPROT Homolog: EC 3.1.1.10 Tropinesterase
  misc_feature (416)..(416): n is a, c, t, g, unknown, or other
ctggagctccccgcggtggcggccgctctagaactagtggatcccccgggctgcaggaattcgtctcacccctagaaaaagtacgccggccgtaagtgagccgagagcccccgatataccagctagctagataaccagccagcgcgagcatggtaggcggctggcggcggcggtccggcaccggacggtggaggcgaacggcatctcgatgcacgtggcggagtccggccccgacggcggcgacggcgcgcccgcggtggtgttcctgcacggcttcccggagctctggtactcgtggcgccaccagatggcgcacctggccgcgcggggctaccgctgcgtggcgccggacctccgcggctacggcggcaccgccgcgccgcccgacgtcgcgtcctactccgccttccacgtcngtcggcgacgtcgtcgccctgctcgacgcgatcggcatccacaacaaggtgttcgtggtgggtcacgactggggcgccatcatcgcgtggtacctctgcctgttccggccggaccgggtggcggcgcttgtcaacaccagcgtcgccttcatgcgccacatcttcgtccgcgccgccgccgccgccgtcacgcccatcgactacttccaccgcacctacgggcccacctactacatctgccgcttccagaaacacaatttgtcgtcgggcgggcggcctccggcgacgaccgatcgatcgggcactgcacggcgcaacaacccgtgggggttgtcgtcgttgaaacccacaggggccaggttggggcacctactggccccgagggga

SEQ ID NO: 94009 - DNA, 801 bp, Zea mays
  misc_feature: Ceres CLONE 1583549
  misc_feature: Translation starting site: 135
  misc_feature: SWISSPROT Homolog: EC 3.2.1.39 Glucan endo-1,3-beta-D-glucosidase
  misc_feature (795)..(795): n is a, c, t, g, unknown, or other
ctccccgcggtggcggccgctctagaactagtggatcccccgggctgcaggaattcgtctcacccctagaaaaagccccacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaagtgaagctgtacgacgccgaccccaccgtgctgcgcgccctcgcgaacaccggcatcaaggtggtggtggcgctgcgcaacgagcaagtcgcggcggctgagtcgcgcgcgtcctacgcgctgctgtgggtgcgccagaacgtggcggcgtgaccacccggccacgcagattcagggcatcgccgtgggcaacgaggtgttcgcgtcgggcaataacgtgacggcgcagctgggtcccgggcatgggccacgtgcacgccgcgcttgccaagctcggcctcgacagggccgtctaggtgtcgtctgccatcgcgctcagggcgctcgcgtcgtcctacccgtcctccgtcggcgcggtcccggtagtactcgcgcagggcgtcatgaagcccatgctcgactcctggagcagaacgggtcgtacctcatggtgaacgcgtacccgttcttcgcttactcgggcaagcgggagacatctccctcgactcgncctgtc

SEQ ID NO: 94010 - DNA, 989 bp, Zea mays
  misc_feature: Ceres CLONE 1583550
  misc_feature (301)..(301): n is a, c, t, g, unknown, or other
  misc_feature (302)..(302): n is a, c, t, g, unknown, or other
  misc_feature (306)..(306): n is a, c, t, g, unknown, or other
  misc_feature (345)..(345): n is a, c, t, g, unknown, or other
  misc_feature (408)..(408): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
ctaagctggagctcaccgcggtggcggccgctctagactagtggatcccccgggctgcaggaattcgtctcacccctagaaaaaacgagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaagctgcctgcgcggcgcgatccggtgtccaccgctgccccgccggaggaggaggaggaggaggaaggggggctggtttttnntttntttggtttttgtttgggggggggtggggggggtgtgggntgtggggggggggggggggggggtgtgggtgggggggggggggggtgtgggggggggggtgtngnnnnntggggggggtgggtggggggtggggggtgtgggggtgggggtttgtgtggtggtgggggggagggggggggtggggtgttcggggggggtggggtgtgggggggtgggggggggtgggtgtgtgtgtggggtggggggtggggtttgtgggggtgttggtggggtgggtgggggtgggttgggtttggtccgtggtgggtgtatttgggggggtgatgtatggggggggggggtgggcgggggtgggggggggggggtgaaaaaaatagtaattcatgtgtatagtagagacagatgcggagacaatccattgtgcgctggcggtgaatgaacatatatttgacggaacagcagagcgcgatgaggggcggcgtagatgagaggaagggaattggcatcggcggccggcgtggagtgtgggtgcaacgagggaccccggggagatagacgaggtaagcagcgaggagaagggggagtgtttaggagggcaccaccggggtacagatggggcgggtggggacatacggacaggttcggataacttaatagagagactacaataagatgaacacgcc

SEQ ID NO: 94011 - DNA, 837 bp, Zea mays
  misc_feature: Ceres CLONE 1583552
  misc_feature: Encodes the peptide sequence at SEQ ID NO. 94012
tggagctccccgcggtggcggccgctctagaactagtggatcccccgggctgcatgaattcgtctcacccctagaaaaagggaaataccctaggctctcgccagtctccggtgcgggtcagcaccgaccgaacccgtgaaaaattcgttctcctttcgatccgttgggcggggggctcggccggatccgaccggaggggcgccgccgatccatccggtcgcagcagcgtctgatttggtgcgaattttggcgagataccccgctcctagctccgctgtttccaggataacaaagatggcgtcgccgcggggcgggttcgatgagcaagatcgccggacggagaagggcaccgaaggtgttcatcggcgggctgccgcggtcggccacggaaagcacgctccgagagatattttcttcatgccgagagattattgacgcgcgcataatgaaagatcagagtggtcactcaaagggatatggttttgtgcggatagcaaagagggattatgctaatactgccaaaaggcaaaagaatggtattgaggttcaaggaaagaggcttgtggttgagctttcaatggatcaagatacagttttctttggaaatctttgcacagagtggactttagaagaatttgaagaattgattcacaacgcattcaaaagatgtgtttccgatgaccgtggcatggcgtcaaatcttggttcttccaacagaagaatatcaatcgacgctttcgatttgagagatttcatctcatgcagctgcagcacctgtaatccgccatcggttcaaggacaggatttccggccttggggatattcggcaccccgcga

SEQ ID NO: 94012 - protein, 172 aa, Zea mays
  misc_feature: Ceres CLONE 1583552
  misc_feature (13)..(83): Pfam Name: RRM_1 Pfam Description: RNA recognition motif. (a.k.a. RRM, RBD, or RNP domain)
MSKIAGRRRAPKVFIGGLPRSATESTLREIFSSCREIIDARIMKDQSGHSKGYGFVRIAKRDYANTAKRQKNGIEVQGKRLVVELSMDQDTVFFGNLCTEWTLEEFEELIHNAFKRCVSDDRGMASNLGSSNRRISIDAFDLRDFISCSCSTCNPPSVQGQDFRPWGYSAPR

SEQ ID NO: 94013 - DNA, 819 bp, Zea mays
  misc_feature: Ceres CLONE 1583560
  misc_feature: Encodes the peptide sequence at SEQ ID NO. 94014
aaagctggagctccccgcggtggcggccgctctagaactagtggatcccccgggctgcaggaattcgtctcacccctagaaaaaacccacccccacaaagaagccgccccccgagttgacggccatggcgtcagcggcgaacaccatgccaggcaagtctgttgtcctcctctccctcgtcacgcttctcgtcgtcctcatctccgccgcggagagctacgacggccggtatgccgtctcgcactcggccatggcgcgccgctcccgcctggggacccggcacgcgcatcaccgccggacaacggtgccgcaccggtacgtgctcgcggagaagagcagcgcgcccggcggcggcggccccaagaacaacagttcgccggcgaaggccaacgccagctcgcccccccccgcgcctccggccgccgagcagactggccggcaccaccgcagccacaagaaccgggtgcgcaactggatcatcggcttcgtggtggggtccctcgccggcgtcatctccgggatggtgctgtcggtgctgttcaggctggcgctcaactgcatccgcgggcggtaccggacgcggtctggcgtgatgatcttcaccccgaagctgatcaggcggccggagcacctcgcgttcctggagaaggaggacgggctggcgtcgctggccgtgatcgggcgcggcgggtggcggggaggtgtacaaagcgcagctgcccgttgtagccgggaggggggaacaacccccccttcatcgcccatcaagaaagtccaaaaaacaccggggggggacgccgcccagcaaacaacctggag

SEQ ID NO: 94014 - protein, 231 aa, Zea mays
  misc_feature: Ceres CLONE 1583560
MASAANTMPGKSVVLLSLVTLLVVLISAAESYDGRYAVSHSAMARRSRLGTRHAHHRRTTVPHRYVLAEKSSAPGGGGPKNNSSPAKANASSPPPAPPAAEQTGRHHRSHKNRVRNWIIGFVVGSLAGVISGMVLSVLFRLALNCIRGRYRTRSGVMIFTPKLIRRPEHLAFLEKEDGLASLAVIGRGGWRGGVQSAAARCSREGGTTPPSSPIKKVQKTPGGDAAQQTTW

SEQ ID NO: 94015 - DNA, 855 bp, Zea mays
  misc_feature: Ceres CLONE 1583561
  misc_feature: Encodes the peptide sequence at SEQ ID NO. 94016
ctggagctccccgcggtggcggccgctctagaactagtggatcccccgggctgcaggaattcgtctcacccctagaaaaaactggtcctcactcccacaccaaccaaccaacctcctctgcctgccgcttctcctgctgcgggcggtcacggctgcaagtactagaggaggacatccgcttccattactgcgcctgcggaggatcggaggaaccagtagcggaggcttctattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcaactttgttgattccgcatccggcaagaccttcccaactctggaccctcgtacaggagaggtgattgctcatgtggctgacggtgacgcagaggacactaaccgtgcagtagctgcagctcacaaggctttttgatgaagggccatgggccgaagatgactgcctatgagaggtcccgtatccctactgcggttttgctgatttgatagagaagcacaatggacgagcctggcctgctttggagacatggggacaaccgggaagccatatgaggcaagcaccccagattgtaagtacccatggtggcccggtcttatgcggtaactaatgctggtaggggcggataagatccctggggctcattgtgcccg

SEQ ID NO: 94016 - protein, 119 aa, Zea mays
  misc_feature: Ceres CLONE 1583561
  misc_feature: SWISSPROT Homolog: EC 1.2.1.3 Aldehyde dehydrogenase (NAD(+))
MARRAASSLVSRCLLARAPAGAPPAAPSALRRTVPADGMHRLLPGVLQRFSTAAAVEEPITPSVHVNYTKLLINGNFVDSASGKTFPTLDPRTGEVIAHVADGDAEDTNRAVAAAHKAF

SEQ ID NO: 94017 - DNA, 976 bp, Zea mays
  misc_feature: Ceres CLONE 1583566
  misc_feature: Encodes the peptide sequence at SEQ ID NO. 94018
tccccgcggtggcggccgctctagaactagtggatcccccgggctgcaggaattcgtctcacccctagaaaaaaaaagcatctccctcccattccactccagtccaccaccgctcccattccccagccgccgtcggcccgtcgccatggccgccgccgcccactccctcctgcacacaccggaggcccacaggaccgccacccgctcgcccttctctcctcccgcgcccactcccttcctccatctccgccctcaccgcctccccctccgcctccgctccacctccccgaccgcctccgacctcaccgccttccccccgaacccgaacgggatcttcgcgtccgaccggcccatcgacgtggacgccgccacggaggccgagctgcggggagaacgggttccggagtacgcgccgcaccaagctcgtctgcaccgtggggccccgccaacctcgcgccccgggaccagcttgaaggcgcttcgccgtcggcgggaatgaaactttgcccgggcttaaacatggtgcccagggcggaaagggaagggggcaccaggggccccccatctcgcgccccgtgagggagaccctccaaacggaggaaaaaagggggtttcgcccggatgcccgctattatgagtagggacccccgaaggggggccgcggaagatcccccccttggggggggaaccttcgggggggggcgcgcttcctctgcggtataaggggggagaggtgggggagaaaacttgggcgaccccctcccgggtaaaaaaaccctttgaaaagtgggccccccccccaaaaggaatttttttatggtggggacactttaggggggttttttctcaaaaaaatttaaaaaatttggggaaataaccccccctgtggagagggggaaaaaaacgccccttttcgtggggtttttaaaaaaaaaaagcacccaagttttattggcgccgtttaaaaaacaacgtg

SEQ ID NO: 94018 - protein, 117 aa, Zea mays
  misc_feature: Ceres CLONE 1583566
MAAAAHSLLHTPEAHRTATRSPFSPPAPTPFLHLRPHRLPLRLRSTSPTASDLTAFPPNPNGIFASDRPIDVDAATEAELRGERVPEYAPHQARLHRGAPPTSRPGTSLKALRRRRE

SEQ ID NO: 94019 - DNA, 832 bp, Zea mays
  misc_feature: Ceres CLONE 1583568
  misc_feature: Encodes the peptide sequence at SEQ ID NO. 94020
caccgcggtggcggccgctctagaactagtggatcccccgggctgcaggaattcgtctcacccctagaaaaaggactcgcccctccctcctctcgtctcccaggtcatggcaaagctggagcacccgtgaaaatagcaagtgggagataaacaggaagagctagggtgaatactaactacaagtagcagtagaaggaagagagtcagtctgcccgtgactgcgagtgaatttgttgggtgtggtgtttgttgagatcacgatgatgggaggcgggctgttggtggatcagagcgtggtgttccctggcgtccacaacttcgtggatctcctgcagcagaacggcgacaagaacctgggcttcgggtctctgatgccgcagacgtcctctggcgaccagtgcgtgatgggggagggcgatctcgtggacccgcctccggatagcttcccggacgccggggaggacgacagcgacgatgacgtcgaggacatcgaggagctggagcgccgcatgtggcgcgaccgtatgaagctgaagcggctcagggaactgcagcagacccgcggcaaggactcgttggctagcggtgcgggactggctgatggctcgtccaagccaaggcagtcgcaggagcaggcccggcgcaagaagatgtcgcgcgcgcaggacggcatcttcaagtacatgctcaaaatgatggaggtgtggcgcgcgcaggggtttgttgtatgggatcatttccggaaaagggcaaaccagtgaggtgggccctccaacaaccttcggtgcgtggggggaaaagaaaaaggtcccttttcgaccgcaaaggaact

SEQ ID NO: 94020 - protein, 166 aa, Zea mays
  misc_feature: Ceres CLONE 1583568
MMGGGLLVDQSVVFPGVHNFVDLLQQNGDKNLGFGSLMPQTSSGDQCVMGEGDLVDPPPDSFPDAGEDDSDDDVEDIEELERRMWRDRMKLKRLRELQQTRGKDSLASGAGLADGSSKPRQSQEQARRKKMSRAQDGIFKYMLKMMEVWRAQGFVVWDHFRKRANQ

SEQ ID NO: 94021 - DNA, 786 bp, Zea mays
  misc_feature: Ceres CLONE 1583569
  misc_feature (697)..(697): n is a, c, t, g, unknown, or other
ctccccgcggtggcggccgctctagaactagtggatcccccgggctgcaggaattcgtctcacccctagaaaaaaggaaggagctataaagacaagccaaacgagggcatcccttcttcagccgcacgcttcttgttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccnaatggctgtctttctgctgctgatgcttcccggtctcagctatcgggtttgagggctatgagaagcgccttgagatcacattctctgaa

SEQ ID NO: 94022 - DNA, 887 bp, Zea mays
  misc_feature: Ceres CLONE 1583574
  misc_feature: Encodes the peptide sequence at SEQ ID NO. 94023
caaagctggagctccccgcggtggcggccgctctagaactagtggatcccccgggctgcaggaattcgtctcacccctagaaaaaaacacccaatggcatcacgaatgtggaacctcaaagccctggtcacctcactactctgcatctcggcgttgtcgtcgtcgccatggccatgcacggcagccggtcagctgggcggcaagcccctggtcaccgccgtcaccaaggacgcgtccacctccctctacacggcgccgctcaaggacggccacccgctcgtcctcgacctcactagcccggtcatctcgctggccacgtgcgcctcctcctccaagaacaacaacggcacgctcaccgtcacgctatccgccaacgccaccgacggccagaacccgctgttcccggtctccttctcggcggtggccacgtgcgcgccgtcgtccaagctgcccgccggcgccggcgccgtcggcgtcgcggggctcgcgccctcctccagcagccagcagtcgctcccggcgcaggtggcgcgcacgcagaaggtcgccgacaaggtcgcgctgtgcctgcccagcgacggcaggtccacgtcgggcgacagcgtcggcgtggccatcttcggcggcggcccgctgttcttcgtcccgccggaccgcggcgacttcaccacgatgctggccggcacggcgccgctccacgccggagccggagccggtgcccccgggtactacgtctcctccacggcatcgccgtggagcaggcccgcgtgggcggccccgccggggcgctcgtcgtggcgctgagctcacgggtcccgtaacggcggctcccgcccgacgtgtacgctccgttcgtcaaggcgttcgacgcggcggccggcgggccc

SEQ ID NO: 94023 - protein, 232 aa, Zea mays
  misc_feature: Ceres CLONE 1583574
MWNLKALVTSLLCISALSSSPWPCTAAGQLGGKPLVTAVTKDASTSLYTAPLKDGHPLVLDLTSPVISLATCASSSKNNNGTLTVTLSANATDGQNPLFPVSFSAVATCAPSSKLPAGAGAVGVAGLAPSSSSQQSLPAQVARTQKVADKVALCLPSDGRSTSGDSVGVAIFGGGPLFFVPPDRGDFTTMLAGTAPLHAGAGAGAPGYYVSSTASPWSRPAWAAPPGRSSWR

SEQ ID NO: 94024 - DNA, 879 bp, Zea mays
  misc_feature: Ceres CLONE 1583577
  misc_feature: Translation starting site: 227
  misc_feature (372)..(372): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (511)..(511): n is a, c, t, g, unknown, or other
  misc_feature (527)..(527): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (804)..(804): n is a, c, t, g, unknown, or other
  misc_feature (807)..(807): n is a, c, t, g, unknown, or other
  misc_feature (809)..(809): n is a, c, t, g, unknown, or other
  misc_feature (811)..(811): n is a, c, t, g, unknown, or other
  misc_feature (816)..(816): n is a, c, t, g, unknown, or other
  misc_feature (819)..(819): n is a, c, t, g, unknown, or other
  misc_feature (820)..(820): n is a, c, t, g, unknown, or other
  misc_feature (829)..(829): n is a, c, t, g, unknown, or other
  misc_feature (831)..(831): n is a, c, t, g, unknown, or other
  misc_feature (839)..(839): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
ctggagctccccgcggtggcggccgctctagaactagtggatcccccgggctgcaggaattcgtctcacccctagaaaaaatcgcatccatccaccacgcaccccaccaacccatacccataccagaggctctctgattttacttctcagcggtagatcggctgagcgagcgagcgagcgaggcacacggagctagctaaacagagcacacggatagaaaagcaagatgtcggacggcacggcgacctgcatcgacatcatcctcgccattatcctgccgcccgctcggggtcttcttcaagtcggctgccagggttgaagttctggatctgccttatcctcacctgcttcggctacctccccggcatcatncttacgccgtctgggcccatcaccaagtaagccgggccggttgcgtttagcatgcaatgcgcgcggcaggggtgattctcgtggcgggggggacgcnnngtgtgcgcgtggtccttggagatgtgatttcctttccttncccttggttttagtgnctgctgcctccctggctgggtggtaaagtacctgggtggtatcccagtcccttttttaattttccccttgaattaagttttgcctccggctgaagaaaattcagggacccccgtggcccctggtagttgggctgcttcagcctcccatgtacctttgtaacaacccgttccctcccctggcaggctggctgccccccttcctctcctttttgttttacccttgggatttgatgggattgggttaaaattccgttgggttaaaaannntnnnnnnaantanananaaaanaannaaaaaatananattaaaantttaaattttaaaannnnttccccccccccgcccccccac

SEQ ID NO: 94025 - DNA, 906 bp, Zea mays
  misc_feature: Ceres CLONE 1583579
  misc_feature: Encodes the peptide sequence at SEQ ID NO. 94026
aaagctggagctccccgcggtggcggccgctctagaactagtggatcccccgggctgcaggaattcgtctcacccctagaaaaacacgttcactccgtatctctcgtgcctttttcctttcctggttgcgacgagccgacgactgggcggacgccgctgccgccctacgccaggtcttcgtcggccccttcgacgagcacacacaagattcagtcgggaatgttgaatgcatagtgtaatttctgcgcaaaaagatggcatcagacgagttcatcagccttgacgcaccttgtgaggctgatgcgaaagatgaagggggagacgttcaggttaaagctcctgatgtgagtgggatggagcctctggtatcggatctccaaccagaagggaaagcgggtgctgtgggtagtaatcccaagacatctgctgggaacctggatcttgaagaggggcaagtggaagatatggacctcgcggatgatgacgtagtggttggaaaggatcagctattagatgcttccattcagcccgagatcagtgttggcagctgtgcagactgtgattggttttgaggtcaagctggaccagggggacgggactgcaaaaggaaataatttatgagtcaaacagccttttctttttgaagaaaatcccttcagggggggtttaaaaaaacccggtgttggaataaaagggaaccttctgtttcaggtccatctgaaggtggacttgggcgagggaaagccaaactaaaaggtttatgcgatgggatgtcaacaaatggtctggagggggctaggcgtaaaagaggtttcacctttattggagagaaacctttgtggcaactgaccccttacaaagatggcgggaaaaaaacctgttattaacccctgcggtaccactgga

SEQ ID NO: 94026 - protein, 105 aa, Zea mays
  misc_feature: Ceres CLONE 1583579
MASDEFISLDAPCEADAKDEGGDVQVKAPDVSGMEPLVSDLQPEGKAGAVGSNPKTSAGNLDLEEGQVEDMDLADDDVVVGKDQLLDASIQPEISVGSCADCDWF

SEQ ID NO: 94027 - DNA, 817 bp, Zea mays
  misc_feature: Ceres CLONE 1583584
  misc_feature: Encodes the peptide sequence at SEQ ID NO. 94028
  misc_feature (705)..(705): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (780)..(780): n is a, c, t, g, unknown, or other
  misc_feature (781)..(781): n is a, c, t, g, unknown, or other
ctggagctccccgcggtggcggccgctctagaactagtggatcccccgggctgcaggaattcgtctcacccctagaaaaagcccgccacgccttcctccggacgccagtctgcgagcgccgagcgcagccaggtgtcgccagcccgcccgcccgcccgcctccggcaaatgtgacttgcagacgaaggtcgctgcagtggcccgtgctcgatggtggcaaggtgcgcgcacgccgacgccggcgggttccgcatctggccgatcttctccgccgcctcgctgcggaggaaggtgctagaggttctcgcgtgcggcggcggtggcggtgacggaggcggttcctgccgtggacggacggcgtaccggtcgccacagcggattccgaggccgagaccgcggtcggacaggctcgcggagctgctcagggccgagcagccgtccgagtgcagcgacgaggctgaggccgaggccgaggcggcggccaggaaggtggaggcgttggaggagctgaagggcgtggtgggggcgctccgggacggcgggggcgacggctgcatgtcccgcgtcgaggcggccatggccgtgcggagcaaggccaaggacgacgccggcgccagggagatgctcgcgatgctcggcgccatcccgccgctcgtcgcgatgctggacgaaggcggcgacgtgggggggaggatgtcacgaccngcagcgctgtacgcgctgctcaaacttggggatcggcaatgacacgtgagttgtctgcttccgttnnnnnnnaannaaaatattggggagagggggggggaatttggtttta

SEQ ID NO: 94028 - protein, 178 aa, Zea mays
  misc_feature: Ceres CLONE 1583584
MVARCAHADAGGFRIWPIFSAASLRRKVLEVLACGGGGGDGGGSCRGRTAYRSPQRIPRPRPRSDRLAELLRAEQPSECSDEAEAEAEAAARKVEALEELKGVVGALRDGGGDGCMSRVEAAMAVRSKAKDDAGAREMLAMLGAIPPLVAMLDEGGDVGGRMSRPAALYALLKLGDRQ

SEQ ID NO: 94029 - DNA, 1036 bp, Zea mays
  misc_feature: Ceres CLONE 1583592
ctagctggagctcaccgcggtggcgccgctctagactagtggatcccccgggctgcaggaattcgtctcacccctagaaaaatcagccgagtggttgtgccgtggaagctttcgtttaccgttcccatcccccgtcgtctctcctctccttcccactctcccacccgtcctccattgctcccttcctctctctcgcggagtcgctgcgatctaaccaccgagcacgagcgtcctactcgccgcggaccttgctcatggccgcggggtcgatccgggtcaccatggaggtgggcgccgacggcgtcgcgctcatcaccatcgggaacccggccggtaaggcgctccaacccatcatcatcgaagggccttagggacaaggtacccgtagggctttgggcgggggtccacccccagggggatgcgtggctcactcggtgcttggggggcaaaggtccggtgcgagggatttgggaggatgcggagggttgggagcgggggggtgggaaccagaaggtgggggaggggttcacctcgttgagggctgggcggctgtggccgggtgatggcggtgcatgggccagcgcctgagggtcgggggtgggggggtgggagagaaccgtagtggggggggggggagtggggaggggtgggaggaggcgcgtactcttgtgagcgtctagtggtaccagccatagggtgggacaacaaaaacgaagggcgcatcgttttcctctcccacttttgtgggctcggcgggcgatgggggcggtcggggccgcggggggtgtggcggagaaggatattgaggatacgggggggctgggtcgtggggtgggagtatagggagttagggagtggccagaagggagcagaacgcgacgaacagcagagtcagaacgcgggaaagggacggaagagaaggggaggcacccgagagaggaggcgtcgaagtggagtggagattatgtgaggggggagggggaggcggggaggtggaggtgaggtggatgggagggcgctgggcgcaagatcggaa

SEQ ID NO: 94030 - DNA, 937 bp, Zea mays
  misc_feature: Ceres CLONE 1583594
  misc_feature: Encodes the peptide sequence at SEQ ID NO. 94031
caagctggagctccccgcggtggcggccgctctagaactagtggatcccccgggctgcaggaattcgtctcacccctagaaaagacaacctcgtgttcattcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccagctttgtgcttcgcctcaggggaagcatgcagatcttttgtaaaaacccctgaccgggaagaactatcacccctcaagggggaagccctctgaaacccattggacaaacggcaagggccaaaaatccaggaaaaggggagggggttccccccccagaccagaggagggggtcccccctttggcgggggaaaaaaactttgagggaaaggggggcccccctttggccgaaaataaaaaaatttcccgaaagggggggaagccccccccccccttggtgggggtgcgccccccccggggggggggggttccgaaaatttttttggggaaaagacccccggacccggcggaaaaaaaatataccccccctccgggggggggggagggttttttagaagaacacctctggagatagagcgtttggggggccaaaaaaatctcccagaaaagagagggggggggttttttccccccaccaaaaaaaaggggggggtgtgcgttctttttgttgtggggaaaaacacaccttcttgtgagaggaggggggcgccccccggggtggggggaaaaaaa

SEQ ID NO: 94031 - protein, 81 aa, Zea mays
  misc_feature: Ceres CLONE 1583594
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLQLCASPQGKHADLL

SEQ ID NO: 94032 - DNA, 886 bp, Zea mays
  misc_feature: Ceres CLONE 1583595
  misc_feature: Encodes the peptide sequence at SEQ ID NO. 94033
  misc_feature (1)..(1): n is a, c, t, g, unknown, or other
naaagctggagctccccgcggtggcggccgctctagaactagtggatcccccgggctgcaggaattcgtctcacccctagaaaaagtcgcattccgcaacacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatggctatgattgatgagcctctttatccaattgctgtactgattgacgagctcaagaatgaagacatccagttgcgtctaaactccattagaagactttcaacaattgcacgggctcttggagaagaaagaaccaggaaggagctgattccttttcttagtgaaaacaacgatgatgaagacgaggtgcttcttgcaatggctgaggaattgggtgtgttcattccgtatgttggtggtgtagaacatgctcatgttttgctcccacctttggagacattgtgtacagtggaggaaacttgtgtccgtgataaagcagttgaatctctgtgccgtattggtgcacaaatgaagggaaactgacattgtcgactggttcattccagtagtaaagaggctagcagctggagagtggtttacagctcgcgtatcggcctgggggtcgtttcacataggcctatccaagtgcgtcggacccattgaaaacagaattgaggactatctatgggtcaggtatgtcagggatgacatggccttggggtccgaagagcacccacccttcaaatctttggaaagttttgcagcctaccagttgtaaccgaaatcctttttggagaaccgaaaattaatgttccattatt

SEQ ID NO: 94033 - protein, 120 aa, Zea mays
  misc_feature: Ceres CLONE 1583595
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKGN

SEQ ID NO: 94034 - DNA, 811 bp, Zea mays
  misc_feature: Ceres CLONE 1583600
  misc_feature: Encodes the peptide sequence at SEQ ID NO. 94035
  misc_feature (581)..(581): n is a, c, t, g, unknown, or other
  misc_feature (714)..(714): n is a, c, t, g, unknown, or other
  misc_feature (811)..(811): n is a, c, t, g, unknown, or other
ctccccgcggtggcggccgctctagaactagtggatcccccgggctgcaggaattcgtctcacccctagaaaaaactcctctcctctctccccgaaccaaaccaaacccctcccactccaactcctcgattctcagagtgctgtacaagtgtctcgccctaccgcggccgtcaaaaatccgatctttccgccgtttccggaggccacacggctgcaagactgaccaatcccccgcggatcgagccgcagacgccagcagttcctgctcgcggaccgcaggcggggcccggacggagcatggggtcccgatccgccggcgcggcgctgcggctgtggctgctggcgctcctgctgggctgctgccaggggaggttcgtggtggagaagaacagcctcaaggtgacggcgcccgacggcctcaagggcacctacgagtgcgccattggcaacttcggggtgccccagtacggcggcaccatggtcggcttcgtcgcctaccccaaggccaacaggaaggcctgcaagagcttcgacgacttcgacatctcctacaaggccaagccggggggcgttccccaccnttcctgctcgtcgacagggggagattgttacttcgcaaagaaggcatggaatgcacagaaagcaggagcagcggcaatcctttgttgctgatgacaaagacgaacctctaattacaatggacaaccctgaggnagggtggcaacacgggattatttagagaacatcactatttccttcgggcgttataacccaagagctttgggggacaggctcaagaaagcaatcgacn

SEQ ID NO: 94035 - protein, 124 aa, Zea mays
  misc_feature: Ceres CLONE 1583600
  misc_feature (95)..(95): Xaa is any aa, unknown, or other
MGSRSAGAALRLWLLALLLGCCQGRFVVEKNSLKVTAPDGLKGTYECAIGNFGVPQYGGTMVGFVAYPKANRKACKSFDDFDISYKAKPGGVPHXSCSSTGGDCYFAKKAWNAQKAGAAAILCC

SEQ ID NO: 94036 - DNA, 840 bp, Zea mays
  misc_feature: Ceres CLONE 1583602
  misc_feature (778)..(778): n is a, c, t, g, unknown, or other
aaagctggagctccccgcggtggcggccgctctagaactagtggatcccccgggctgcaggaattcgtctcacccctagaaaaagcgctctggtttatctcttcgcgtcggtgttgcttttcaagcgcctcgcctgtccctgtcttgccctttgcgccttcgtcaccgcgacgcgcttgcgttttccaatccttccttgtcttatactccgtttcgactttgagctgggtcgatttcttcttcggctgatctgttccgctgctgctgggcttccttgttctcgcagatctccatcgggcgttccgctttcgtgcgacgcggggagcgggcctgtgttcggtggcggggttattgagtttgccgtttattttttttcctgcaattcatccagttatcgtgtgcaattcgtctagtcatcgtgtcgatcttgtttcgtctcgcctcctcagcgtgtgggttgcaggattggatccgatctggtgtggggagttcgtcatgttcgcctggactcggaggcaggtcagtattctgtcagatccaacggttcattggttgtcacttggacatggattcggtggtttcaggcccaatctcccggtggggtaccaccagaaattgtcacttggacatggatttgaagatttcaggcttaatcgtctcccggtgcggtagcatcagaaaccgataatgcagttatagcctgcacacctggtggatttggagaaccttcggtccgttcttatgttaacggctgatctcgcttctgggtctttggttngttgtcctccttaaactcagatgcatgaagggtcttgctgggtatggagagatcttgaaaaa

SEQ ID NO: 94037 - DNA, 815 bp, Zea mays
  misc_feature: Ceres CLONE 1583605
  misc_feature: Encodes the peptide sequence at SEQ ID NO. 94038
ggagctccccgcggtggcggccgctctagaactagtggatcccccgggctgcaggaattcgtctcacccctagaaaaaataagctcatctccggtggctactgctgctccgccttcagcttgcactgcgagtcctgggtgcactcccagtttctacgacacgagagaagacaactgtcttcaacctcaagtcatacctgccgtctaacacacacaaggggctggaggacctgaggaagatacgacctgcaggcgctgcgcggcgacgggcactgcgagcgcaaggatgttcgagcgcgtctactactacaacctgtactacaacctgagcgacccggacaataacccggcccacatgcggcccttgctaggcggcaacaagcagtacccatacacgcgccgctgcctgacttgtctgtctatgaccaacaaggacccccagacggaaatgcgcaagggccacaactacctgccccgcgacaagcagttctcgggaggtgaaacatctcacagtactgggacaccatgtctgatctccagactgcacgcgctgctgtcggcgctccgcccgctgctcatacaataagaaggatctgctcttcccgaacttcgacgccatcgacgaactctacagcgactgcatctcgctgcgggcgcataccgggttcgacgccatccgcacagtatcttctgcgcatggacaagctggtggacgacatcaccgaccatgtcatccgcttcaaagtgtctcgagatgatagatcaggaccgagttctcgtgattgcacgacgaagatgtcgcgcagctagatgata

SEQ ID NO: 94038 - protein, 99 aa, Zea mays
  misc_feature: Ceres CLONE 1583605
  misc_feature: SWISSPROT Homolog: EC 1.13.11.12 Lipoxygenase
MFERVYYYNLYYNLSDPDNNPAHMRPLLGGNKQYPYTRRCLTCLSMTNKDPQTEMRKGHNYLPRDKQFSGGETSHSTGTPCLISRLHALLSALRPLLIQ

SEQ ID NO: 94039 - DNA, 1110 bp, Zea mays
  misc_feature: Ceres CLONE 1583606
  misc_feature: Encodes the peptide sequence at SEQ ID NO. 94040
  misc_feature (1022)..(1022): n is a, c, t, g, unknown, or other
  misc_feature (1048)..(1048): n is a, c, t, g, unknown, or other
  misc_feature (1056)..(1056): n is a, c, t, g, unknown, or other
cagagctggagctccccgcggtggcggccgctctagaactagtggatcccccgggctgcaggaattcgtctcacccctagaaaaaagccgccaaccccccaaacaaaaccctaggccaccattctgaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagaacgcctttgacccgggcttcggaggcggcctttagggccgggctccaaaacctccccgccgccggcgggggtcccccttcgggcccccaacaaaagaaaatttggctttggagagaatttggggaaccccaaaggggggcaaaggaggggaggttcccctttgcccccgccccattttagcgcttggtgagaccccctggggagaaaaaggggggggggcgcccccttggattatccgggagagaggggttggtgcaagaagaaagaaaggaagccctcgcggcggtggggggggggaaacacgcccgacctggggcgcgccctggtttttgcccgcgctccgggggggagggaattctccccatagattgtggcggcgcggtgtttttgtagaagattattatctgtgtttgggggtgggagaaaaaacatctaatagggtggcgcggtgtgtataaagagaagaggacgcactttttagagagaaagaaacacgttcgtcgacaaaaatacatgtggggggtgggcgaggactctcctttgtaagaaagaataaaaaactaggttgtcggtcctgttaagagggtgttgaggtgcgggggggagaaaaataagaggaggttgtcgtggtcggtagcgaatcgatcacgcagggggcgggaaagcagagcgaggataaatgtatgtgtggtagggtgtgaatatattcantcctccgcggcgagacggtaagtgtnggtgggangggtgtgccgcgcccgcgctggagagggaggtgagcagcccgcagtaagaagag

SEQ ID NO: 94040 - protein, 62 aa, Zea mays
  misc_feature: Ceres CLONE 1583606
MATIPTTDSGLVLSSSALLRRTRRAASSVTARLPAVARRRPQLLVRASAKENAFDPGFGGGL

SEQ ID NO: 94041 - DNA, 863 bp, Zea mays
  misc_feature: Ceres CLONE 1583610
  misc_feature: Encodes the peptide sequence at SEQ ID NO. 94042
ctggagctccccgcggtggcggccgctctagaactagtggatcccccgggctgcaggaattcgtctcacccctagaaaaagttcgccttcctcgcccccatctctttctcgccgtgccactcccacctcttttcgctgataagcacgccgctactccccactccatccatccacccgccgcttttctctcttctttggagaagagccgcacgcagtggttgctgccgctggtccgccagggtcccgggcgctgtgctcattccaccggtcggcggtgcactttcaggcttcttcgacggcgtcgagagtggaggaaatgtcgaccacggagtgcgcggacctcggggaggagttctggctgccggaggactttttggacgacgacttcttctccgaggaggagaaggcggccgtggcggcccggagcgagagcgacgaggaggacagcctggcgggtctctcgcgccgcctcgcgggcctcctcggcgacgggggagagcgcaaggcttccgcggccaaggcggaggtgacgggtgggtcgccgcagtcgacgctgtgcgggctgcccaagtcggggcaagagagccccagcggcggggcgtccaagggcacctcgacgccgtcgttcgcccctggagaagaggcccgcacaacccgtggggatctggtccaacaaggcggggcggaacaggtttgggcggatggcgcgaccgcataaagcgagggcgggtgccaggccgcccaacggtttttccaccggaccgggaaggggggatctggggcccacctacacaatgaggggccccgcgagcgagcgcgcacagaatgtggaccctcccccccccctggtgggcaaaagagga

SEQ ID NO: 94042 - protein, 133 aa, Zea mays
  misc_feature: Ceres CLONE 1583610
MSTTECADLGEEFWLPEDFLDDDFFSEEEKAAVAARSESDEEDSLAGLSRRLAGLLGDGGERKASAAKAEVTGGSPQSTLCGLPKSGQESPSGGASKGTSTPSFAPGEEARTTRGDLVQQGGAEQVWADGATA

SEQ ID NO: 94043 - DNA, 779 bp, Zea mays
  misc_feature: Ceres CLONE 1583612
  misc_feature: Encodes the peptide sequence at SEQ ID NO. 94044
  misc_feature (583)..(583): n is a, c, t, g, unknown, or other
  misc_feature (631)..(631): n is a, c, t, g, unknown, or other
  misc_feature (632)..(632): n is a, c, t, g, unknown, or other
  misc_feature (642)..(642): n is a, c, t, g, unknown, or other
  misc_feature (650)..(650): n is a, c, t, g, unknown, or other
  misc_feature (653)..(653): n is a, c, t, g, unknown, or other
ctggagctccccgcggtggcggccgctctagaactagtggatcccccgggctgcaggaattcgtctcacccctagaaaaacagtcccagatgggtctcttctcgtggtggaggggagggcgacgcggcggcgccccgccggaccagcaagcctcggcggttgcgggggtcgtggggaccgacgtggcagcttctggcacccacggggcggtggaggtgcggcggcagcggcaggctgcggacgcgacggtgttcgaattcgggtccgcggcggagtctggcgccgctgtgacgctcgccggctactgccccgtatctgatgagctcgagccgtgccgctgggagcttgtcccggccgctgttgatggcgcgccgcagttccgcatcgtgttctgagcgtgagacatctcggatggtaccgaatttcataggtataaagatgtggtgtttgggggtgtactggtaaccaagcattcagctaaaataaaacttgtgatgtggttgatgagcttctgattagatatggatggtcatatatgctcactttgtctggatggattcttttatgattacagatgaactanttgcacacacacacaagacacaacacaactcgtaggcagcgagcgtcnntctctcttcntcctccangcnacgggccaaggaaagcagagaaaaatccgcgcttctcttctttccgtcggggggggcgggtgaaccgccctcctcgagcaaaaatctcctgaaacccctcggaaattgggccccgaaactttccca

SEQ ID NO: 94044 - protein, 101 aa, Zea mays
  misc_feature: Ceres CLONE 1583612
MGLFSWWRGGRRGGAPPDQQASAVAGVVGTDVAASGTHGAVEVRRQRQAADATVFEFGSAAESGAAVTLAGYCPVSDELEPCRWELVPAAVDGAPQFRIVF

SEQ ID NO: 94045 - DNA, 1054 bp, Zea mays
  misc_feature: Ceres CLONE 1583613
aaagctggagctccccgcggtggcggccgctctagaactagtggatcccccgggctgcaggaattcgtctcacccctagaaaaaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaaggggggcaagaagtctagcaggagtcgttccatgatgtacccccactgctcttggctacagcatttagggacgtttcgacctgtccggaagcggcgaaaaaagttccagtcttgctggctttctccccacttggggcaaggaaggccatccgggattattcccttttggggcttccctcgcttcctaggtaggttttaggaaatttccttttttttggagcccgttcagattcttttatccaaattcccccctggggctcgggtggcctgtttccttgaaaaaatttaaacatgttttgcgcccaggttcttgtggctccccttgggcaggatccttccccgttcctgcccatattgttccaggagggtgttgtgtgttttctggaaacatcaccctttgagaacccaaaggggcgggggtttcattttgccgggctaggggtgtggggttgactcccccggggtttacgaggttatttgtgtggtttttcggaggggcctttagtaggaagagtccccctcttcggaattacctaattgtttcgtgtgagaggaggcttgtgctctttgtgtgtgggacgccccccgttggtgaacaggtgcgattggggagtggggcatcgattcaaatggtgagtgccgatatgttgtcgcccttggatctccgggaactttagggacgggggccttcgctcaa

SEQ ID NO: 94046 - DNA, 835 bp, Zea mays
  misc_feature: Ceres CLONE 1583614
  misc_feature: Encodes the peptide sequence at SEQ ID NO. 94047
  misc_feature (655)..(655): n is a, c, t, g, unknown, or other
  misc_feature (790)..(790): n is a, c, t, g, unknown, or other
  misc_feature (800)..(800): n is a, c, t, g, unknown, or other
  misc_feature (815)..(815): n is a, c, t, g, unknown, or other
ctccccgcggtggcggccgctctagaactagtggatcccccgggctgcaggaattcgtctcacccctagaaaaaaaaaactcccacgtgctgctccacttgcgccgccacgttatacctctgggctgtagccatggggacgtcggggtccaagggcatcgacggcgtcggcgcagtttctggcgtcggcgctggcgcggcgggccttggcggcgtcggcgccggcggggacgggggcgagggcgccgccgcggaggcgtggcatggcggggcgcagctgtacgtgtcgctcaagatggagaacgcgttgatcagcggcgacctcgtcccgcacgtgtatggctccgagcccatcatcggcacctgggacccctcccgcgccctcgccatggaaagggagctcgcgtccatgtgggtgctcagcttcgtcgtgccgccggaccatgaaacactggacttcaagttcttgctgaagcccaaagacgctgaaaccccgtgcatcatcgaggaaggacccacacggctcctcaccggaggcatgctagagggtgatgtgagggttgcactgttcaagctcaatggagatgatgaggtgctccgagtttggggtggtcaacaaggcggaccttgtatcaccgcttgaacttgctgcaagnctggagggtgtacaaggagaactttcagccttccaaaagttcgggggatccctgatatcagtatcaatgtcacacccactaatggagcctgaagaaggatcagcggctacttttggacttgacttggaaacattnatgttgtccngtccccgccaactgncacaccaaatggatatgctg

SEQ ID NO: 94047 - protein, 169 aa, Zea mays
  misc_feature: Ceres CLONE 1583614
MGTSGSKGIDGVGAVSGVGAGAAGLGGVGAGGDGGEGAAAEAWHGGAQLYVSLKMENALISGDLVPHVYGSEPIIGTWDPSRALAMERELASMWVLSFVVPPDHETLDFKFLLKPKDAETPCIIEEGPTRLLTGGMLEGDVRVALFKLNGDDEVLRVWGGQQGGPCITA

SEQ ID NO: 94048 - DNA, 1253 bp, Zea mays
  misc_feature: Ceres CLONE 1583616
  misc_feature: Encodes the peptide sequence at SEQ ID NO. 94049
  misc_feature (38)..(38): n is a, c, t, g, unknown, or other
  misc_feature (41)..(41): n is a, c, t, g, unknown, or other
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (73)..(73): n is a, c, t, g, unknown, or other
  misc_feature (280)..(280): n is a, c, t, g, unknown, or other
  misc_feature (281)..(281): n is a, c, t, g, unknown, or other
  misc_feature (520)..(520): n is a, c, t, g, unknown, or other
  misc_feature (521)..(521): n is a, c, t, g, unknown, or other
  misc_feature (729)..(729): n is a, c, t, g, unknown, or other
  misc_feature (825)..(825): n is a, c, t, g, unknown, or other
  misc_feature (920)..(920): n is a, c, t, g, unknown, or other
  misc_feature (923)..(923): n is a, c, t, g, unknown, or other
  misc_feature (948)..(948): n is a, c, t, g, unknown, or other
  misc_feature (1037)..(1037): n is a, c, t, g, unknown, or other
  misc_feature (1038)..(1038): n is a, c, t, g, unknown, or other
  misc_feature (1039)..(1039): n is a, c, t, g, unknown, or other
  misc_feature (1040)..(1040): n is a, c, t, g, unknown, or other
  misc_feature (1163)..(1163): n is a, c, t, g, unknown, or other
  misc_feature (1221)..(1221): n is a, c, t, g, unknown, or other
taatcgttaaagattaatgcccgccacccccactcctnccnaaaaaaagctncnnnnggccccccctaatttntcaaaactggagctcaccgcggtggcggccgctctagaactagtggatcccccgggctgcaggaattcgtctcacccctagaaaaagtacccgatctccaaatcgccccccttcccaaaccctcttcttccccctcacgtgctcgacccagatcgagggctcgatccgtcggccatggcgctggagtgggtggttctgggctactcnncaggcgcggaggcgatcatgctgctgctgctgacgctgccggggctcgacagcctgcgccggggcatgatctccgtggtgcggagcgcgctgaaacccatgatgtcggtagtgaccttctgcctcttcctgctcatggacatctactggaaatacgagacgcgccccacctgcgacgacgagcacgcctgctcccccttcgagcacttccgccaccacaaatccctcatgaagcctccnnctgaacactgctcctcattcatcacccgcgcctgcctccctctcctggaatcctcatttatccgccaacccagcctccgccgtcgaaggtttagaggcggaatgcgggcaagcggccttcaaaacaacggcattaagaaaaagcgggcggaaggaacctggttgcgaaaaactggccagacccacttggctggggtgggtggcatttntgttcccctatcccctccctttgcccttagcaccgccgggcagggggggcccgccgtagccgcgcgaggagaggaaaaaatggcgccgggggtacncccttcgaaacactgtgctcggtctccgcaaattacctccgccgcgcgcagaacaggagaaaaataatatttggaaaggggcgcgccgggggcanagngggagaagagcggctggcgggtgtncacttttctgcgccgagatatacgcacctttgtttccgtgcggtgcgtttgcggcgttttttttccttaagatcgctgggcggggcgtnnnnccctcgctcttttgtgctggcgggagaaagcaaaagaaaaaaaaaccaagtcgcctccaaaataatcatggtattcacctccacaacacccgcgatgagaaactaacataacatggtgtagtncagacaacattttatatgtggattctactccttctcccggttgatataggacagaggngaatctccggcgcccccagcccacccccgccc

SEQ ID NO: 94049 - protein, 214 aa, Zea mays
  misc_feature: Ceres CLONE 1583616
  misc_feature (12)..(12): Xaa is any aa, unknown, or other
  misc_feature (92)..(92): Xaa is any aa, unknown, or other
  misc_feature (161)..(161): Xaa is any aa, unknown, or other
  misc_feature (193)..(193): Xaa is any aa, unknown, or other
MALEWVVLGYSXGAEAIMLLLLTLPGLDSLRRGMISVVRSALKPMMSVVTFCLFLLMDIYWKYETRPTCDDEHACSPFEHFRHHKSLMKPPXEHCSSFITRACLPLLESSFIRQPSLRRRRFRGGMRASGLQNNGIKKKRAEGTWLRKTGQTHLAGVGGIXVPLSPPFALSTAGQGGPAVAARGEEKMAPGVXPSKHCARSPQITSAARRTGEK

SEQ ID NO: 94050 - DNA, 855 bp, Zea mays
  misc_feature: Ceres CLONE 1583617
  misc_feature: Encodes the peptide sequence at SEQ ID NO. 94051
ctggagctccccgcggtggcggccgctctagaactagtggatcccccgggctgcaggaattcgtctcacccctagaaaaaacctctctcaaaactttccccatccgcatgtactgcaccccctctcccaagcctatccacgcagccgccagccctgctcgggtggtgcgcatacatgaaccatccgtcctcttcttcgtcctccgcccagccgccgccagccccggcggtggcggtcgaggccacctccctcgcgcctggcttccgcttccaccccaccgatgaggagctcgtctcctactacctcaagcgcaatgtcatcagccgcccgctcaacgttgatgccatctcccatgtggacctttacaagctccagccctgcgacctgcgcgcccactcccacatctgctccatcgactcccagtggtatttcttcaaccgcctcgaccgcaagcacgcctaccgcgcccgcaccaaccgcgccacgtctggagggtactggaagaccacctggaatgacatggaggtgcgccatgggcccagacttgtcgggatgatgtcgactctcatcttccacgagggacgcgcccccacaggcgaacgcaccatctgtgtcatgcacgaataccgctctcgagggcgatgacgccgcagggataccgcaggactcatatagtagtgtgccgtatcttccataaagctcggacaggtccgtcaaaatggctcacacgatcggaacgcctctccttgaccgagaattggagggaggatgacccacccgaatggttggcttaccattgaatggttttgctgcttgcttacccctgaggtcccccctgggtctgtggatgaccca

SEQ ID NO: 94051 - protein, 156 aa, Zea mays
  misc_feature: Ceres CLONE 1583617
  misc_feature (26)..(154): Pfam Name: NAM Pfam Description: No apical meristem (NAM) protein
MNHPSSSSSSAQPPPAPAVAVEATSLAPGFRFHPTDEELVSYYLKRNVISRPLNVDAISHVDLYKLQPCDLRAHSHICSIDSQWYFFNRLDRKHAYRARTNRATSGGYWKTTWNDMEVRHGPRLVGMMSTLIFHEGRAPTGERTICVMHEYRSRGR

SEQ ID NO: 94052 - DNA, 844 bp, Zea mays
  misc_feature: Ceres CLONE 1583620
  misc_feature: Translation starting site: 228
  misc_feature: SWISSPROT Homolog: EC 1.6.2.4 NADPH--hemoprotein reductase
ctccccgcggtggcggccgctctagaactagtggatcccccgggctgcaggaattcgtctcacccctagaaaaaaggatcggccccattgccgtctctagcaccactagtagcgaagccactggttgttggtaggtgcacgcaccccaccccctcctgccgtcctcgatctcgtctcctcctccctacccaatccctcgcggtgggcgagggtggaagcgagtgacgatggcggcgctggaggcggcgagggagtgggcgggctccgtcataccgccggagctcgccgccgccgcggggggagacccactcgccgcgctggcggccaccgccgcggccctcgtcgcggggctgcttattatcgctgtctggttccgatccggaggcgggacgccgtccaagccggtcgccacgccggtacggccaccgccggtcaaggtggacgccgacgccgacgttgatgacggccggaagcgcgtcaccatcttcttcggcacacagactggcaccgccgaggggttcgcaaagtccatggcggaggaggcgagggcgcggtacgagaaggccgtgttcaaagtggtggatctggatgactatgctcaggaggacgaggaatacgaggagaagctgaagaaggaaactgtggtgctgttcttcctagcaacatatgggggatggggagccaactgataatgcagcacgattctacaaatggtttactgagggaaaagagaaggcagtttgggttgaaggatcttaaataatgggtattttttgggccttggaaacaggcaatacgaacatttttaaatagggttgcaaaaggtggtagaatgagctagtat

SEQ ID NO: 94053 - DNA, 895 bp, Zea mays
  misc_feature: Ceres CLONE 1583621
  misc_feature: Encodes the peptide sequence at SEQ ID NO. 94054
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
ctccccgcggtggcggccgctctagaactagtggatcccccgggctgcaggaattcgtctcacccctagaaaaaatctttggaattcatttatttcttgcaggggtggcttgttttggctttggtgcatttcatgtaacgggtttatatggccctgggatatgggtgtccgatccttacggactcactggaaaagtacaagctgtaaatcctgcgtggggtgcagaaggttttgatcctttcgttccgggaggaatagcttcgcatcatattgctgcgggtactttgggcatattagcgggcctattccatctaagtgtccgtccgcctcaacgtctatacaaagggttacgtatgggcaatattgaaactgtactttccagtagtatcgctgctgatttttttgctgctttcgtacttgccggagctatgtggtatggatcagcaactaccccaatcgaattatttgggcctactcgttatcagtgggatcagggatactttccgcaagaaatatatcgaagagttagcgatgggttagccgaacatcttagtttatcagaagcttggtctaaaattcccagagcattagccttatatgattatattggtaataatccgggcaaggggaggagtattcctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 94054 - protein, 214 aa, Zea mays
  misc_feature: Ceres CLONE 1583621
  misc_feature (1)..(233): Pfam Name: PSII Pfam Description: Photosystem II protein
PRGGGRSRTSGSPGLQEFVSPLEKIFGIHLFLAGVACFGFGAFHVTGLYGPGIWVSDPYGLTGKVQAVNPAWGAEGFDPFVPGGIASHHIAAGTLGILAGLFHLSVRPPQRLYKGLRMGNIETVLSSSIAADFFAAFVLAGAMWYGSATTPIELFGPTRYQWDQGYFPQEIYRRVSDGLAEHLSLSEAWSKIPRALALYDYIGNNPGKGRSIPG

SEQ ID NO: 94055 - DNA, 810 bp, Zea mays
  misc_feature: Ceres CLONE 1583622
  misc_feature: Encodes the peptide sequence at SEQ ID NO. 94056
aagctggagctccccgcggtggcggccgctctagaactagtggatcccccgggctgcaggaattcgtctcacccctgattacttcaatgactcacgagggaggaacgcaggtgatgctgggatgattgccgacatttttgcggtttgtatcctcatcgaggtatcagctgcttctctcacctacgcccctcccacgaaggccaccaccggcacggacaccactgtccccacctcttctctctcgatgcccatccttaccatgtctccctcctctccattgaagaaagtatctttgaggtctctggcacactgggctacactctgcttgttcgtgaggattttgacctttcacggcccaccttctctccctctcatccttatacgactacctccaaggatatcactgccgatggcatggatctccataggctcaagactgcatgtcatatgctcaagaccactctgacgtcgagtgcccagacctccattgagattgactctctgcaggagcatctcgacttctactcctgcatctgccctctcaaattcgacgatctcagcgactacctggtaatcaagagattggatcctgttgagaattcactcagagatctcaagatggaccacaatccatccatgagcctcatgcttactcgtggctccactatgatactcagcgtgcaccatctagcacctaacttctgctgaggttatgcgctgcgcaagatcatcacccccgatgaggctgatcatcgatggtgatgctgtgctcgctgccatcctgatcgtaaacggcactcaaaagataca

SEQ ID NO: 94056 - protein, 97 aa, Zea mays
  misc_feature: Ceres CLONE 1583622
MDLHRLKTACHMLKTTLTSSAQTSIEIDSLQEHLDFYSCICPLKFDDLSDYLVIKRLDPVENSLRDLKMDHNPSMSLMLTRGSTMILSVHHLAPNFC

SEQ ID NO: 94057 - DNA, 1141 bp, Zea mays
  misc_feature: Ceres CLONE 1583624
  misc_feature: Encodes the peptide sequence at SEQ ID NO. 94058
  misc_feature (65)..(65): n is a, c, t, g, unknown, or other
  misc_feature (66)..(66): n is a, c, t, g, unknown, or other
  misc_feature (1141)..(1141): n is a, c, t, g, unknown, or other
tgggtaaaagccagttggtcttggtagtgcgtctggctttgtgggtggggggccccccggggggnnacatactggactccccgcggtggcggccgctctataactagtggatcccccgggctgcaggaattcgtctcacccctagaaaaaatcaagtgggcttgtggttctgtatatcaccattaatgtatttaagttgtattactgtgatgactggaagggtctttttgagtctatcaggtggctatagccttgggggctcgtccatggctctctttggaagagtatgtggaggcatctacacaaaggctgctgaccttgatgctgatcttgttggaaaggtcgagaggaacattactgaggatgatcctatgaacccagctgtgatcgccgataatgtccgtgacaatgttggtgactttactggaatgggatctgatctcgttgaggaatatacagagtcttcctgtgctaaccttgttgttgcctcaatttcatcttgaagaatcaacgaagatttcactgtcgatgtgctacccactccctcgtttactgctatctggttatcattgttcatgcttgtatcaccacccctgttttgactaataggatttctttcgacagtcaacggcttttaaagaaaaacattgaagaacttgcatgtgtataacaaagatatgcttcactggatgggggccaaccgggtcccttggaattaaactcggtgggggttaattgggctttccttaaactcaaaaactggggtttttggggcgcccctttttcacaaggcctttaaaggattttatcccagtcactctccaaaacttctttggaggtaaactcttcaacaaagggggattggttctttcccaaaaactcgggggggcccttggttttccccttccgttgtgggtttaccaaaatttagggcacccttgtggggccttctggtggcttgaaaattttattgggggtattgttgtgttccaccgaaaaatttctctggccacctaaagtgcgagatttcctttgtccggcgacccttgggtgacgaaagcaaacatttgtcccaaaaaaatttctttgccagaaaaaatgggaatttcattgtgcaccacaaaagggaagagaatttttn

SEQ ID NO: 94058 - protein, 105 aa, Zea mays
  misc_feature: Ceres CLONE 1583624
  misc_feature: SWISSPROT Homolog: EC 3.6.1.1 Inorganic diphosphatase
MYLSCITVMTGRVFLSLSGGYSLGGSSMALFGRVCGGIYTKAADLDADLVGKVERNITEDDPMNPAVIADNVRDNVGDFTGMGSDLVEEYTESSCANLVVASISS

SEQ ID NO: 94059 - DNA, 818 bp, Zea mays
  misc_feature: Ceres CLONE 1583625
  misc_feature: Encodes the peptide sequence at SEQ ID NO. 94060
caaagctggagctccccgcggtggcggccgctctagaactagtggatcccccgggctgcaggaattcgtctcacccctagaaaaaatcagaccgccagcagtcgccagcccagcgaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcaaccgtcggcgtacgtgcgggcgacaccgtcgctcctcggcgagcagggagaagacaccgagtgggtgacggtgaagttcggctggaaagaaccgtccgaggacgactggatcggcgtcgttctctccgtctgaattcaactcgtcggctacatgtccgaacccgtggccagacaaaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggttgatcgcggtgtcggagcccatatcgttcaagaaccccaacgcgcccgtgattccgcgcctggcgcagggcacgtcccactacgagatgacggtgacgtggaccagcggctacgccatcaatgaggcgtacccgatcgtggagtggggcgccctggttgccggcggcggagcccagtacacagggcgcgggcccgcc

SEQ ID NO: 94060 - protein, 87 aa, Zea mays
  misc_feature: Ceres CLONE 1583625
MAVALLAALVASAAMLAGTASASPAEGIQPLSKIAVHRATVEMQPSAYVRATPSLLGEQGEDTEWVTVKFGWKEPSEDDWIGVVLSV

SEQ ID NO: 94061 - DNA, 1072 bp, Zea mays
  misc_feature: Ceres CLONE 1583627
  misc_feature (1045)..(1045): n is a, c, t, g, unknown, or other
caagctggagctccccgcggtggcggccgctctagaatagtggatcccccgggctgcaggaattcgtctcacccctagaaaaaatctttggaatcatttatttcctgcaggggtggcttgttttggctttggtgcatttcatgtaacgggtttatatggccctgggatatgggtgtccgatccttacggactcactggaaaagtaccagctgtaaatcctgcctgaggggccgaaagatttgatacttttcttcccgggaggagaagcttcccactcaattggtgcggggtactttgggcaatttaacggggcctattccatctaagggtcccttccgcctgaggactttttcagaagggccccccccgggccaccacggggggggggggtggttgtgcccccccccaaaaaaatttttttaagagctttttttgcttatcgcggggaaatattgggggttgggttgtgtggacccacccccactcaaaatattgttttttgaccctccctctttttaattgggcgcgggggggtggggtttcctttgtggtcaaccgtaagtagtgtgtggtgagagagacaccaacagggggtaggggggggtgcaaatattctctcctaatggtgtgaatataccaccataacatctgtcgtgttgtcgcgaaatctctcttcccatgaagaaagaaaagcactccgctatttgctggggaacatacagacgctgtaggaatagaataacagcctccacgttttcctaaagggcgggagaagatttgttagtccgcgcggggtgtccctagaggtattaattaaaattttgtgtgatacgcccatggagtcagatagggagatgacctggtgataagtttgtgtggaagttaggacgagtgacaccgttcattgttgtgtgtgtatggtgtgaggccagcgcgttgggtggtgtcccctgaaattgcgcagggaagaagcgatgattagccggtcgtatgattcgaagaggttgtgggcccccaccctgcgtgtataatatagagaggtggntaggttttatgtgtgcgcggtgatatg

SEQ ID NO: 94062 - DNA, 772 bp, Zea mays
  misc_feature: Ceres CLONE 1583630
  misc_feature: Encodes the peptide sequence at SEQ ID NO. 94063
  misc_feature (423)..(423): n is a, c, t, g, unknown, or other
  misc_feature (486)..(486): n is a, c, t, g, unknown, or other
  misc_feature (586)..(586): n is a, c, t, g, unknown, or other
ctcaccgcggtggcggccgctctagaactagtggatcccccgggctgcaggaattcgtctcaccccagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtnggtggtggttgaacaataataagcgaggccgagctggctgccatacataggtattgtgtggtngtgtgtgagagagagagaaacagagttcttcagtttgctatctctctctgcatgtttggcgtcagtctttgtgctcatgtacgtacgtgtgtctacctgncatgtggttgatccgattgcatctgctgtaaccatatattaattggtccacgatgatatgatttgatactaaaaaaaaaaaaaaaaaaaaaaaccaaaaaaagctccccaacgaagtgcgagcgacccacgtccacacgacacgaaacacccccaccaacagcaggcgcaccacgcacccagggaa

SEQ ID NO: 94063 - protein, 76 aa, Zea mays; identical to SEQ ID NO: 8464
  misc_feature: Ceres CLONE 1583630
  misc_feature (1)..(76): Pfam Name: Metallothio_2 Pfam Description: Metallothionein

SEQ ID NO: 94064 - DNA, 804 bp, Zea mays
  misc_feature: Ceres CLONE 1583632
  misc_feature: Translation starting site: 158
  misc_feature: SWISSPROT Homolog: EC 1.4.1.2 Glutamate dehydrogenase
  misc_feature (619)..(619): n is a, c, t, g, unknown, or other
  misc_feature (646)..(646): n is a, c, t, g, unknown, or other
  misc_feature (760)..(760): n is a, c, t, g, unknown, or other
tccccgcggtggcggccgctctagaactagtggatcccccgggctgcaggaattcgtctcacccctagaaaaactctcggaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttncatgactcacagaggcaggccacaaangatgctggggtgattgctgggcctaatgtgctgcgtatcatcaacaaggcaacagctgcagctatcgcctatgggtctgacagaaagctaccagtgtcggtgagaagaaatgtntcatctttgatcttggaagtgggacctttgatgtctccctcccc

SEQ ID NO: 94065 - DNA, 776 bp, Zea mays
  misc_feature: Ceres CLONE 1583637
  misc_feature: Encodes the peptide sequence at SEQ ID NO. 94066
ctctcctcggtggcggccgctctagaactagtggatcccccgggctgcaggaattcgtctcacccctagaaaaagcgccacacacacagtacgtacaagcctctcatcagcaatggagtccaccaagctctccgcgctgctggtgctcgccatgctcgcgctctcctcgtccccgctcgctctcgcgtgggagaaggcggaaccggagtgccactcgtgcgagtccggctcgccaccctcgaccggcggcgtccccctgcctcccgtcagcataccgtcagtcccgctgccccctgtcagcataccgtcggtccccctgccccctgtcagcataccgtcagtgcccctgccgccggtgaccctccctcccattccgatcgttgggggaagcccgagcccgacgaagaagggacaccggaaggcgtgcccaccgcctccgtctcccccgacgccgacacccacgcccacgccgtcctcggacaagtgccccatcgacgcgctcaagctcggcgcctgcgtggacgttctcgggaacgaggtgcacgtcggcgacgccaacgtccagtgctgcccgctcgtgaagggcatcgccgggctctccgcggcggggtgcctttgcaccgccatccagggccaaggtgctcgacatctcccgtctacgtgcccatcgcggctcgagggggttcgtcaaactgggggctggcgccctgcccgcccagggcttcaaattgcaccttggaaccaattctcatccccatttcccattttcccattta

SEQ ID NO: 94066 - protein, 221 aa, Zea mays
  misc_feature: Ceres CLONE 1583637
  misc_feature (125)..(187): Pfam Name: Tryp_alpha_amyl Pfam Description: Protease inhibitor/seed storage/LTP family
MESTKLSALLVLAMLALSSSPLALAWEKAEPECHSCESGSPPSTGGVPLPPVSIPSVPLPPVSIPSVPLPPVSIPSVPLPPVTLPPIPIVGGSPSPTKKGHRKACPPPPSPPTPTPTPTPSSDKCPIDALKLGACVDVLGNEVHVGDANVQCCPLVKGIAGLSAAGCLCTAIQGQGARHLPSTCPSRLEGVRQTGGWRPARPGLQIAPWNQFSSPFPIFPF

SEQ ID NO: 94067 - DNA, 801 bp, Zea mays
  misc_feature: Ceres CLONE 1583638
  misc_feature: Translation starting site: 133
ctggagctccccgcggtggcggccgctctagaactagtggatcccccgggctgcaggaattcgtctcacccctagaaaaaaaaaaacaaaatcagctacccaccaccgtccgtcagcggcggcggggagagcatggcggccatcgtggcggcgcgagcgtcggccccaggcagggcggccgtcagcaccatcgccgcgttccacagccacgcgtccccttcccgcgcgctcccgctcgcctcctcctccatcggcggcgccaggcggtaccaccacgcccccgcgtgctgcttcgccaccaagcccaccgcgccggccgctgccgagctcgtcgaccaggacttcgccacggccacgcaggaggccgccaagccacgccggaaacgccggtctcggaaggcgaagaagtccgccaccgccgccaaggaggaggatgggacggacgacaagccggtggcggcggcagaggacgaggcgaaaaggaagaaggaggcggccggcgccgaggacagcgcccgggcattggtggccggcctcgacgacgtgatcgtcaaccccgtgggtctgggtcggcggtcgcggcaggtgttcgacgaggtgtggcgcaagttctcgcggctgggccagatttcgagcgcctcgtccaccgcgctggcggaggaggagcaggccgtgcttatccgtggaggacctatgtgcgagttcactgtgccaggggcgcaggacaccaccgatcctcgtcgtcggtgccaccagccgcatcggccgcatcgtcgtgcgcaagctcatgctccgcggatt

SEQ ID NO: 94068 - DNA, 942 bp, Zea mays
  misc_feature: Ceres CLONE 1583640
  misc_feature: Encodes the peptide sequence at SEQ ID NO. 94069
ctggagctcaccgcggtggcggccgctctagaactagtggatcccccgggctgcaggaattcgtctcacccctagaaaaaccccccgccacgacccctgcagccctcacacaagagacgcagctgcgagtccgccagccttatcctcctgcgcgtctccggctccaacccgcaagcgcggtatggcttctacattgggagacacttctactgtagggcttatggctgctccaacggggaagaatgtgcgccttcagaggagggtgaactccagagtaagagcagctaatgagctgtacttcaactaggatggctcagctttcaagaagctcctgactggagtcaataagcttgcagacctagtcggagccacactcggaccaaaaggaatgaatgttggtttggacagcaagtatgggtctcctaagaatggtaacgatgcgtgttacagctgcccaaaaaagttgagcttggatgaacctgtgggagaaaatttggttggtaaattggacaggctagacatcaggtaagaagcaatgtatctttgctgggagaatgggagaaacaccccttggggggccccttagtccaaggggcatgattcgcctgaagggatggtaaagaggctgggggcaagcctggcgggcaaagacctggtttataaaatcaaccccaagaagagacccaagaaaaaagaagcaaaaaaccaccttgtgttggaaggaaaccaatcagaaaagttgttggtagagtaagggacagaaataaaatttggtgagcctgtacagtaaagtattggccaactagagtataatggcggggcccaacaagcctctccgaagaattgcgtgagtaatgtgtttatgtggagaaggcgccaatataatttggaggtggggcggattccggataagggcgggatgtgggttctcccccctacgga

SEQ ID NO: 94069 - protein, 41 aa, Zea mays
  misc_feature: Ceres CLONE 1583640
MASTLGDTSTVGLMAAPTGKNVRLQRRVNSRVRAANELYFN

SEQ ID NO: 94070 - DNA, 1097 bp, Zea mays
  misc_feature: Ceres CLONE 1583642
  misc_feature: Encodes the peptide sequence at SEQ ID NO. 94071
ccaagctggagctcaccgcggtggcggccgctctagaactagtggatcccccgggctgcaggaattcgtctcacccctagaaaaaaagggtggttttggtcagagtgttgggcgcctgtgccaaattccgctgcccggcggcgaatttactcctctcagcctctacttctcgggttcgagctcaacccggcgggccactgctgcgacaaaggactagcaaggtttcattgcgctcaattgctatgtctaccacacaagcctcagaagcagctgctgacaaaggattgcctctggcagtggacgctaccatgattgatgagtatgcctcccagtcaaagttgctgcaagaatttgttaaaatccccactattggcaagggctgggaatctgccattttcctaaggggacccccccccaacccgtcttatgaaagaacaaggtggggtgttccctatctaagggtgcgttcaccaagtggtcgggcacatttgtgttttggtggtgctcggctgtccgaggtgtctccaaggtagcgcctatatatcgcgccgatatttttttttgccctgctgtgggagtacttaatactgtctgggttactgtcctcattgctgagcgaaataaaccgagtggatatgacaaatgttaaacgccagccgcggccccgataatcgcatatgttgagccgcgttcccgatctgtagcggtaccagcgtaagtgatgagtgggtgtagaaaatcctagcacatagaatgattctcatattaagttagttcataggagagaagaatggtccttgagaaggtgactatgcggtgggtgctgttgtactggtcactgaacagcacaaaggatgtgatgtggtagggcgaccgctggcgatgtatgggacaggcctgttatattcggcttactagcggttacatgcgcgacggcagccgacctattatgctctgtgatggtgagagccagtctgcccggcaccgctcattccgtattatattaggtctgggatatatattatttatatgacgcggcagtcggacgtcaaggatgacggatttaggccgcgagaggggagtgagttgattggacg

SEQ ID NO: 94071 - protein, 96 aa, Zea mays
  misc_feature: Ceres CLONE 1583642
MSTTQASEAAADKGLPLAVDATMIDEYASQSKLLQEFVKIPTIGKGWESAIFLRGPPPNPSYERTRWGVPYLRVRSPSGRAHLCFGGARLSEVSPR

SEQ ID NO: 94072 - DNA, 1127 bp, Zea mays
  misc_feature: Ceres CLONE 1583645
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (30)..(30): n is a, c, t, g, unknown, or other
  misc_feature (53)..(53): n is a, c, t, g, unknown, or other
nnnnnnnccccnnnnnnnnntacgcactcntctcttccccctccttattttcncccccaataagtaatttttaaagctggagctccccgcggtggcggccgctctagaactagtggatcccccgggctgcaggaattcgtctcacccctagaaaaaggactcgcccctccctcctctcgtctcccaggtcatggcaaagctggagcacccgtgaaaatagcaagtgggagataaacaggaagagctagggtgaatactaactacaagtagcagtagaaggaagagagtcagtctgcccgtgactgcgagtgaatttgttgggtgtggtgtttgttgagatcacgatgatgggaggcgggctgttggtggatcagagcgtggtgttccctggcgtccacaacttcgtggatctcctgcagcagaacggcgacaagaacctgggcttcgggtctctgatgccgcagacgtcctctggcgaccagtgcgtgatgggggagggcgatctcgtggacccgccttccggatagcttcccggacgccgggggaggacgacagcggacgatgacgtccgaggacatcaaaggaacctggaagcgcccgccatgtgggcgcggacccgtatgaaagctgaaagccggtctcaagggaaactggcccaccataaccccgccgggcaaaggaacttcggttggggcctaagccgggtgcccggggaaatttgggcttaaaatgggccttccgttccacaaagaccccaaggggcacagctctccccagggggagagcaaggggccccccggtggctccaaaaataaactaatgtgttctcccctccgcccgccctacggaaacgcgcacaatccctctccaaaggtaacctttggctctccaaaaaaaatgaaatggcagaggggtgttgccccccctccccaccaggcgggcttattttctggtttagtggcaaatcacattctccccgcaataaaagggtccacacaccacataaaaaaagggaatccccttccaataaaaatctcctctttgtcccggtgcgcggaaaagaaaagaaaggtccccttcttttcaatccttttaggggaacagggcgcccctattagggcgtagaa

SEQ ID NO: 94073 - DNA, 782 bp, Zea mays
  misc_feature: Ceres CLONE 1583648
  misc_feature: Encodes the peptide sequence at SEQ ID NO. 94074
  misc_feature (258)..(258): n is a, c, t, g, unknown, or other
  misc_feature (265)..(265): n is a, c, t, g, unknown, or other
  misc_feature (355)..(355): n is a, c, t, g, unknown, or other
  misc_feature (356)..(356): n is a, c, t, g, unknown, or other
ctccccgcggtggcggccgctctagaactagtggatcccccgggctgcaggaattcgtctcacccctagaaaaaaccccgcccacagccgcgacaaactcttcctcagacccacgccacgtacgatgcctctctccccttcccctccgcccaacgccgccgccgccgccgccctacccctcctcctgctgctcgtctgcgccagcagcattgccgcgcagccgctggcgtcgtcgcaggccaaggcgctccctcgggntgcgcgnctgctgttctacccgccgggcgctcgagccgcttgcgccggggggccggaccccctggggggttggccgcccggggccgggcccttttgnnaaatccccttttccaagggggggggccaagtgtaaaggggggctctttctccttccctcggggggaaaacccccaacccccgaaaacgggggtctggggggcccccccttttttcggggaaaattttttccttccaggggggggtttttttccccaaccttttacaaaagttttcccggggggtttttgggggcccctttttttttttttttggggccccccgggggcggggggggggggccccccctccgggggggggaaaaaaaaattcccggggggtttttgggggggtggttttaaaaaaaaaaaaaaaaacacggggtggcaaaaaaaaatattttttttggggggggggcccccccaccaaaaaggggagggccccccccggggttttttttttttttttggtgggggggggagggggcg

SEQ ID NO: 94074 - protein, 88 aa, Zea mays
  misc_feature: Ceres CLONE 1583648
  misc_feature (45)..(45): Xaa is any aa, unknown, or other
  misc_feature (77)..(77): Xaa is any aa, unknown, or other
  misc_feature (78)..(78): Xaa is any aa, unknown, or other
MPLSPSPPPNAAAAAALPLLLLLVCASSIAAQPLASSQAKALPRXARLLFYPPGARAACAGGPDPLGGWPPGAGPFXXIPFSKGGGQV

SEQ ID NO: 94075 - DNA, 812 bp, Zea mays
  misc_feature: Ceres CLONE 1583651
  misc_feature: Encodes the peptide sequence at SEQ ID NO. 94076
tccccgcggtggcggccgctctagaactagtggatcccccgggctgcaggaattcgtctcacccctagaaaaagacgcgtttgcaatacaactgggcgtgctcccgtccacccacctcacgaccgatcggaaatcccatctcccctgcccacccagagagagagaaaaaaaatcacaccaaatcccctccccccgatccatccatcccctcccgccgccgccgcgcgccgctgcctagatccgccttccctcccccgctccccgccgccatggcgtcctcccgcacctcctgggccgacgtcgccgacgccgagcccgccccgcctcccccggtcgccgcccccgccgccgcatccaacggccccgcgcgttcctcctacgttccgccccacctccgcaaccgcccaccagccgccgccgccgccgcgcccgcctccgccgccccgccgccgcgctccaccgccggcctcctcacccgcaccggcggcggcagcagcttcggtgcgggcggcggcggaggattcggcgggggccgctcccgcggcggtgcccggtgggaccgcgagccggacccgttggcggactccgacgcctacggcgaggtcccgttcgactagcaccagaacacggggatcagcttcgacgcgtaccaggacatccccggtcgagatgtccgggccgggatatccccgccccccgtgtccaacctttcgccgaacattgaacctcgggcgacgcgcttcaacgaaaaaaattccggccggggtgcaagataaggtccggctcccaaacccccggtgccagcgcgcccg

SEQ ID NO: 94076 - protein, 115 aa, Zea mays
  misc_feature: Ceres CLONE 1583651
MASSRTSWADVADAEPAPPPPVAAPAAASNGPARSSYVPPHLRNRPPAAAAAAPASAAPPPRSTAGLLTRTGGGSSFGAGGGGGFGGGRSRGGARWDREPDPLADSDAYGEVPFD

SEQ ID NO: 94077 - DNA, 836 bp, Zea mays
  misc_feature: Ceres CLONE 1583653
  misc_feature: Encodes the peptide sequence at SEQ ID NO. 94078
aaagctggagctccccgcggtggcggccgctctagaactagtggatcccccgggctgcaggaattcgtctcacccctagaaaaagacagcatcactgccgtgtagtgtagctagagcccgtgcactggtccggattcgcagagcaaaacggaaatgatcacggtggcagcaccggaggcgcagccgcaggtggcggcggcggcggcggttgcggcgccggaggagaccgtgttccggtcgaagctgccggacatcgacatccccacccacctgccgctccacgactactgcttctcgagggcggcggaggcggcgggcgcgccgtgcctcatcgcggcggccacggggaggacctacacgtacgccgagacgcgcctcctgtgccgcaaggccgcggcgtgcctccacgggctcggcgtcgcccagggcgaccgcgtcatggtcctgctccagaactccgtcgagttcgtgctcgccttcttcggcgcgtccttcctcggcgccgtcaccacggccgccaacccgttctgcacgccgcaggagatccacaagcaattcagcgcctccggcgcggaagtcgtcgtcacccactccgcctacgtcgccaagctccggcacgacgccttcccgaagatcggcgtggacggcaatgccctcaccgtcctcaccatcgacggcgacgcggccgacaccccggaaagctgccctgcgttctgggagctgctcacggtcggcgaacgcgacgccctcccggagtggtcatctccccgggacgaccccgtggcgctgccgttctcgtcggccaccacggggcttccccaagggcgtcttgctgt

SEQ ID NO: 94078 - protein, 227 aa, Zea mays
  misc_feature: Ceres CLONE 1583653
  misc_feature: SWISSPROT Homolog: EC 6.2.1.12 4-coumarate--CoA ligase
MITVAAPEAQPQVAAAAAVAAPEETVFRSKLPDIDIPTHLPLHDYCFSRAAEAAGAPCLIAAATGRTYTYAETRLLCRKAAACLHGLGVAQGDRVMVLLQNSVEFVLAFFGASFLGAVTTAANPFCTPQEIHKQFSASGAEVVVTHSAYVAKLRHDAFPKIGVDGNALTVLTIDGDAADTPESCPAFWELLTVGERDALPEWSSPRDDPVALPFSSATTGLPQGRLA

SEQ ID NO: 94079 - DNA, 845 bp, Zea mays
  misc_feature: Ceres CLONE 1583659
  misc_feature: Encodes the peptide sequence at SEQ ID NO. 94080
  misc_feature (697)..(697): n is a, c, t, g, unknown, or other
  misc_feature (708)..(708): n is a, c, t, g, unknown, or other
  misc_feature (769)..(769): n is a, c, t, g, unknown, or other
  misc_feature (770)..(770): n is a, c, t, g, unknown, or other
ggagctccccgcggtggcggccgctctagaactagtggatcccccgggctgcaggaattcgtctcacccctagaaaaataattctcgcgccccgccttcttcctccagcagccccgctcgttcttccggcctcgcgttccgtctccgaagccgcaggcagccatggaaatcaacgaggaggcaatggcggcgcataagcgcgccttcctcgacttcctcgaccaagacgtcgggaagggggtttacatgcaggccgtccgcgacatggtccagaacaagcgccaccgcctcatcatcggcatggacgacctccgcaatcacaatctcgatctcgcccgcagggtgatccggacccccggggagtatatgcagccggcgtcggacgcggtgtcggaggtggcgaggaacctggatcccaagtttttgaaggaaggggagcgcgtgatggtgggcttctcgggtccgttcgggttccacagggtcacgcctagggatctcatgtcctccttcatcggcaccatggtctgcgttgagggcatcgtcaccaaatgctcgttggttaggccaaaagttgttaagagtgtccacttctgccctgtgactggggactttctttcgcgtgaatacagggacatcacttcttttgtaggcttgcctactggctcggtttatccaacaagggatgaacatggtaacnttgtggttacngagtatggaatgtgtgaatacaaggatcaccagacattgtccatgcaagaagtgcctgaannaatctgcactggacagctcccagaaactgtcgatgttattggaaaaagaggatccttgtagattggtgcaaaccc

SEQ ID NO: 94080 - protein, 222 aa, Zea mays
  misc_feature: Ceres CLONE 1583659
  misc_feature (179)..(179): Xaa is any aa, unknown, or other
  misc_feature (203)..(203): Xaa is any aa, unknown, or other
MEINEEAMAAHKRAFLDFLDQDVGKGVYMQAVRDMVQNKRHRLIIGMDDLRNHNLDLARRVIRTPGEYMQPASDAVSEVARNLDPKFLKEGERVMVGFSGPFGFHRVTPRDLMSSFIGTMVCVEGIVTKCSLVRPKVVKSVHFCPVTGDFLSREYRDITSFVGLPTGSVYPTRDEHGNXVVTEYGMCEYKDHQTLSMQEVPEXICTGQLPETVDVIGKRGSL

SEQ ID NO: 94081 - DNA, 1119 bp, Zea mays
  misc_feature: Ceres CLONE 1583661
  misc_feature: Encodes the peptide sequence at SEQ ID NO. 94082
caagctggagctcaccgcggtggcggccgctctcgaactagtggatcccccgggcgtgcattgtattcgtctcacccctagaaaaaacgaccgcgttggctgcttcatcatctcgattccttatcgaaagcccgcgcacgcactgtcggtcgtcccgagcaggacctcgatcggccgagatggcgacgccgaacgggcttgcgcggatcgagacgaccgggaagaagaagcaggacaacggcgtgtggtacgacgacggctcggcgccggtgcgcgcgcagaccatcgacgagctgcactcgctgcagcggaagcggtcggcgccctgcacgcccaagcggtcggcgcccaccacgcccatcaagggcggcgcccactcggcctgcgccgtcgcgatctccgaggaggagcgccacacatcagcagaggaggtccgtctgtggccacgagggcgccctctgacccagcgataaccgggcccaaaagggggttaagggatgagcgcgagcgaggcgaatgggaggacgtcgctctcttccggggcggcgcaccaccgccggcactaaaggcctcgatcggggtcgggagccgggcagcccctggtggtggcccctcttagtcaggacgaggacttcaacagaaacgtacctatccacttcataaatataccctcctaccagggtgacgccagccagacagtaaacattcactggcgcccgcgggttctaaatgagcctaggaggacgaagaacaaggatcaggatctaattgcacaatgttatatcgtagagactgcgcggggacgtagcatgtatgatacgatgaatgtcacaggcaccgtgccagtgtggttttaagcgcacagcctagacgtgccgaggtggcgtccgaggaggagaggcgggggcggagttggtggcgcggcgcggcaagaacgaccacgtggatgttcctcggtgaggggaggagtgatgtgtgttgggtgtgacgcgggtcgtcccggtggtgggtgtgttggctgtggtggttgtgtgctactctctttagttatgcatggttctttagctcgcagagggacggtctttaccgtggtggcgttgtgtgtaggggagtgtgtgg

SEQ ID NO: 94082 - protein, 97 aa, Zea mays
  misc_feature: Ceres CLONE 1583661
  misc_feature: SWISSPROT Homolog: EC 4.1.1.49 Phosphoenolpyruvate carboxykinase (ATP)
MATPNGLARIETTGKKKQDNGVWYDDGSAPVRAQTIDELHSLQRKRSAPCTPKRSAPTTPIKGGAHSACAVAISEEERHTSAEEVRLWPRGRPLTQR

SEQ ID NO: 94083 - DNA, 881 bp, Zea mays
  misc_feature: Ceres CLONE 1583663
  misc_feature: Encodes the peptide sequence at SEQ ID NO. 94084
  misc_feature (881)..(881): n is a, c, t, g, unknown, or other
ccccgcggtggcggccgctctagaactagtggatcccccgggctgcaggaattcgtctcacccctagaaaaaatccaaacagctttcaaggagaagcgtacagtccctgctatacagctctcgtcggggtcttctcccccttcggcccttcccccctccctgcgcgccatggaggcccaggagatcgccgctgcagcgcgccacttctgcgccatggttcgaatcgtcggtccggaccccaaggccgtgaagatgcgccgccacgcctttcattttcaccattcggggtcgaccacgctctcggcgtctgctctgctcctgccgcggggcgctttatcggagccgccgctacttctcgaccatatctgctcggcccacgggcacgccgcaggagacgtcgcgctcccggcttgcttccctctgccgagccgttcctggtcgcggagcagcgcaataactccccgcgaaggagcttccccccgaggctgggttcccggagaccgccccttggatgtggtttgttggaggatgaaggtggggggaaaccctcaagaaggggaaggtctgggacccccccccgggggggtttcccagctccgacttgctgtggcctggggttgataggcccccaccacggtggggggtttcctgccctttttccccttattgggaaacccgggaggaattcgctgtgtgccactaaagggcccacacgtggggaattgtgaggcgcggggccctcttgggcccatgactctaaatccggaaaagagggtgtgtgaaaaagggaccgcccaagtgtttgccccttccgaccctgtaacaaggggaagagatgtggactcccttttggggagccgccgtcgaacccgccggtaggn

SEQ ID NO: 94084 - protein, 150 aa, Zea mays
  misc_feature: Ceres CLONE 1583663
MEAQEIAAAARHFCAMVRIVGPDPKAVKMRRHAFHFHHSGSTTLSASALLLPRGALSEPPLLLDHICSAHGHAAGDVALPACFPLPSRSWSRSSAITPREGASPRGWVPGDRPLDVVCWRMKVGGNPQEGEGLGPPPGGVSQLRLAVAWG

SEQ ID NO: 94085 - DNA, 975 bp, Zea mays
  misc_feature: Ceres CLONE 1583665
  misc_feature: Translation starting site: 194
caaagctggagctccccgcggtggcggccgctctagaactagtggatcccccgggctgcaggaattcgtctcacccctagaaaaactctctgctaacgccgctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagaaagatcctccgcatcctcaaggcccatggggttggcccccgagatcccggaggatctctacttcctcattaaaaaggccgtggcgattacgaaagcatcttgggaaaggaacagggaaggaccagggactcccaaattcagactccattcttggttgaaagcaccgaatccacccgcccttgccccgctaactacgaagccggagcacaggaaagctccccacacccaaccttgggaagggaccgaagttcaaacccacgggcgaaagccacctcccggggtgggcccaaaaagctgaaattcccccctctgaataggacttgggggccttttagacaccctttaagaaagccttggtttccctagaataataaaaaatttagtttataatctctcggtttaaggtgccgaggatgaccgggataaaaaaagggacaaacaggaaaccttcaacgcggttgatacaaaagaatatgactttggggaagaaaattcctatagaaccactatattttggatgaatacaacgcggacatgacataataagaaagaaccagtagtaatgtaaccctact

SEQ ID NO: 94086 - DNA, 1063 bp, Zea mays
  misc_feature: Ceres CLONE 1583669
  misc_feature: Encodes the peptide sequence at SEQ ID NO. 94087
  misc_feature (15)..(15): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (313)..(313): n is a, c, t, g, unknown, or other
ttgttttcggtcttnttcttaaattcatctactaacacagcacgccgcgaatgctttnnnnnnnnnnnnnnnnnnnnaaaaagctggtgactccccgcggtggcggccgctctagaactagtggatcccccgggctgcaggaattcgtctcacccctagaaaactctctttccagccacctcactcttcactagcctctgctcctctgaaatggcggcggcgacttcctcttccacctacctcgccatcggccgcaaaaccctaagccccgccccctccgtagccacagccgccacctccgtctccttccccngcacgcagcacccatgcctcgtcgcccgctccgcggaacgccgccgcgccgtggctgcgaaggtctcgtccccgtcggtcatcgggcacgccattgcgtcgctcgaactggaaaacttcgtcctcagaaaggaaaaagggtcccctggcccggcctgaagaagatattggagggcgggggggaaaagagaattcttttccccccccgtgttcccgggggggccctccagggggaatccaaacacaatctcggggggaaattccggccggggggggcccccaagggggggcccctcccccccaaaaccctccaaaaaattttgagagaagaacccccccccttggtgttgggggggacaaaaaaccccacaaaaaatagttggggtgggaaaataaaaaaaaggagggcgcccccccccccgaaaaaagaaggcggcacaaaaaaaacctttttgtggaaaaaaaaaaacccccccacacatacaggcgggagagttttcccccccccacaaaaaaaaaagggggggggcgccccccgccggggggtaatatttttatttggggaagaaaatatttttttctacaaaaaaacagggggttctcttttttttttttcccccgcccagagaataaacgatataccccccccccgccccggcggctggtatacccccctcaaaaaaaatatttttctttccccccccgttaaataaacaacacaaatattttttctctgtgtggggtgcccccc

SEQ ID NO: 94087 - protein, 86 aa, Zea mays
  misc_feature: Ceres CLONE 1583669
  misc_feature (35)..(35): Xaa is any aa, unknown, or other
MAAATSSSTYLAIGRKTLSPAPSVATAATSVSFPXTQHPCLVARSAERRRAVAAKVSSPSVIGHAIASLELENFVLRKEKGSPGPA

SEQ ID NO: 94088 - DNA, 885 bp, Zea mays
  misc_feature: Ceres CLONE 1583673
  misc_feature: Encodes the peptide sequence at SEQ ID NO. 94089
  misc_feature (312)..(312): n is a, c, t, g, unknown, or other
aagctggagctcaccgcggtggcggccgctctagaactagtggatcccccgggctgcaggaattcgtctcacccctagaaaaagcgggctgacgggatctctgtcctcccgacacgacgaacctctaggaaggcgcctaagacgaggaggaagcgggggctatggaggcgtcttcctgggacgccgttcgcaagcaggcaaggaggttggaagctcagttagatgaccaaatgattgcataccgtaaattggtttctatgaaatcagacggttcagaggacaacattgagtcttgatatagaaagatcactngaagcagttaccagcaagtgaatttcgcaaaatgcaaaacttgggggttatcatccagggaggggttccttaaaagtttcctttttccccaaaaaccctccgggaactccgggtcccatttttgggggggaaaattttttttggccaaagaaaccccctttactctctccaggggagaaatatttttttttttttttgggggggtctttttttccagaaaaaaaaaaaaaaagagttttttttttcttcaggagagggggggggggggggtagtaaaaaacgcgcgccctcacccgccggcgcgcccggctggcttaaataaatgcggttttttatgattccgcccctccccctctctttttgtggtgaaaatattcttttgtggaggaggggaaaaaataatatttttttttttttgtcccaaccccaagtagaggacatcataacaacaggacttgtcttttttttggattgtatttttttttacagagaagagagaggggaaacatcccacccctcttctgaagaaaacaatcctcatcccttcgcgggtaataatttagaaacagtata

SEQ ID NO: 94089 - protein, 44 aa, Zea mays
  misc_feature: Ceres CLONE 1583673
MEASSWDAVRKQARRLEAQLDDQMIAYRKLVSMKSDGSEDNIES

SEQ ID NO: 94090 - DNA, 818 bp, Zea mays
  misc_feature: Ceres CLONE 1583678
ctcaccgcggtggcggccgctctagaactagtggatcccccgggctgcaggaattcgtctcacccctagaaaaaatgcactcctggtatcctatgatatcagccaaagctccgaactccatcccagttcttctccacctcgtcctcctcctgctcctgcattctcgcccgtcccccaaattcaccttggccaccctccaccacctcgtcgacgcgggcagcagttcgcctcatcgtcctcccacctgccgacgtcgcggttcgcgctctcgcggcgtgccgcgcacccacgtctcccgcgagttccacgccttctgtgccacgcgcggacgcgccacctggagccactgttcgccgcgccctggggatctccgacctctacatctccatccgcggaagcagaccacctccaatccttctttttcacgcagtcattgcttgcctccttagcccaactgttggtaccagaggttcatgtttcatcataaggaatgaacagtagtcgacaaatggaactccactacataaacactggatttccatacacaatcaaccgagaggctcatggatttccttgaaggggctcacttttgcctcatgctggactttgctctcacgggagggctttcaggatcaggggaaatccatactggggaaaaggatgcatacaaaactcggtacaaaaaggggatactcccggtcctggggaaactattaacaggttatgccccaaggccttaggaacaaagaccaataccctggccgtaagaagccaaaggggggagcgccagaaaaatgggggaaaaaaccctaacacct

SEQ ID NO: 94091 - DNA, 818 bp, Zea mays
  misc_feature: Ceres CLONE 1583682
  misc_feature: Pfam Name: Photo_RC Pfam Description: Photosynthetic reaction centre protein
  misc_feature (737)..(737): n is a, c, t, g, unknown, or other
  misc_feature (738)..(738): n is a, c, t, g, unknown, or other
  misc_feature (794)..(794): n is a, c, t, g, unknown, or other
  misc_feature (796)..(796): n is a, c, t, g, unknown, or other
ctggagctccccgcggtggcggccgctctagaactagtggatcccccgggctgcaggaattcgtctcacccctagaaaaagggttggtttacagggactacttttgtaacttcttggtatacccatggattggctagttcctatttggaaggttgcaatttcttaaccgcggcggtttccacacctgccaatagtttagcacactctttgttgctactatggggaccggaagcacagggagattttactcgttggtgtcaattaggtggtctttggacttttgtcgctctccatggagcttttgcactaataggtttcatgctacgtcaatttgaacttgctcggtctgttcaattgcggccttataatgcaatttcattctctggtccaatcgctgtttttgtttccgtattccttatttatccactgggacaatctggttggttctttgcgccgagttttggcgtagcagctatatttcggttcatccttttcttccaaggatttcataattggacgttgaacccatttcatatgatgggagttgccggagtattaggcgcagctctgctatgcgctatccacggggctaccgtagaaaacactctattcgaagatggcgatggtgcaaataccttccgtgcttttaacccaactcaagctgaagaaacttattcaatggtcactgctaaccgcttttggtcccaaatctttggtgttgctttttccaataaacnngtggtacatttctttatgctatttgtacccgtcaccggtttatggatgagtgctantnggcgtagttggtctggctctga

SEQ ID NO: 94092 - DNA, 841 bp, Zea mays
  misc_feature: Ceres CLONE 1583683
  misc_feature: Encodes the peptide sequence at SEQ ID NO. 94093
tggagctccccgcggtggcggccgctctagaactagtggatcccccgggctgcaggaattcgtctcacccctagaaaaaacggacgagcgaggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgcaggcgaagaaggcgaaggcgtaccgccctaggtgccccggctgccgggtggaccgcctcaacgcggagcgggagggggtcttccctctcaaggacctcttcctcatctggctcggcaccatcacctgcaccctgccgatccagtctctgttccccatcttgtatgacatgaaaaaggatctgcatattgctaaacaaacacaagacattggattatatgctggttttgttggcgcttcatatatgtgtgggagggcagtctcctcaaagaataggagaatcgtggctgataagtaaggaaggaaaccagttatcgtactgacccttaaagcaatagatatcggcaatactatgtatggactaagctcagactattggatggcattaatcacacgatgcctgcttggaatcatgtgtggctatctcgggccaaataacgcttatgctacaaaagtgtgccgagaagatacaatcatctggctgtggcaggtgtaacgtcctcacgaagcattggtctcactatagatca

SEQ ID NO: 94093 - protein, 113 aa, Zea mays
  misc_feature: Ceres CLONE 1583683
MGGGNGETTQLGEPLQAKKAKAYRPRCPGCRVDRLNAEREGVFPLKDLFLIWLGTITCTLPIQSLFPILYDMKKDLHIAKQTQDIGLYAGFVGASYMCGRAVSSKNRRIVADK

SEQ ID NO: 94094 - DNA, 817 bp, Zea mays
  misc_feature: Ceres CLONE 1583685
  misc_feature: Encodes the peptide sequence at SEQ ID NO. 94095
ctggagctccccgcggtggcggccgctctagaactagtggatcccccgggctgcaggaattcgtctcacccctagaaaaatctccttcccctttcattcccaacgaggcaacgacccgcccctgccccgcctcgcgatccccacccgcggcggcgcggagggccggaatccaaaccctaaccctagcggcccgggcgccgcctccggtcccgcccgcccgccgcgccgggccgcgatggggcagtgctacgggaaggcgcgcggcgcgtcctcgcgggcggaccacgacgccgacccctcgggggcggggtcggtcgcgccgccatccccgctgccggccaacggcgcgccgctgcccgccacgcccaggcgccacaagtccggatccaccacgccggcccaccaccaccaggcggcgacgcccggcgccgccgcctggcctagcccgtacccggccggcggcgccagcccgctccccgcgggcgtgtcgccgtcgccggcccggtccacgccccggaggttcttcaagcggcccttcccgccgccctcgcccgccaaggacatcaaggccacgccttggcaagcgcctcggcggggggcaagcccaaggagggcaccattacccggaggagggcggccgcggggggccggggccgggggccggggcccggggcgggccgttgggggcccccaattccccccaaggccgacccgccccgttggaaaaaaaacggttcggccttcgcccaaagaaactttgggggccaaagtacctaatcctccgggaaaggaagggctcgggaagggggcccctttg

SEQ ID NO: 94095 - protein, 194 aa, Zea mays
  misc_feature: Ceres CLONE 1583685
MGQCYGKARGASSRADHDADPSGAGSVAPPSPLPANGAPLPATPRRHKSGSTTPAHHHQAATPGAAAWPSPYPAGGASPLPAGVSPSPARSTPRRFFKRPFPPPSPAKDIKATPWQAPRRGASPRRAPLPGGGRPRGAGAGGRGPGRAVGGPQFPPRPTRPVGKKTVRPSPKETLGAKVPNPPGKEGLGKGAPL

SEQ ID NO: 94096 - DNA, 1048 bp, Zea mays
  misc_feature: Ceres CLONE 1583687
  misc_feature: Encodes the peptide sequence at SEQ ID NO. 94097
  misc_feature (802)..(802): n is a, c, t, g, unknown, or other
  misc_feature (862)..(862): n is a, c, t, g, unknown, or other
  misc_feature (871)..(871): n is a, c, t, g, unknown, or other
  misc_feature (873)..(873): n is a, c, t, g, unknown, or other
  misc_feature (965)..(965): n is a, c, t, g, unknown, or other
  misc_feature (973)..(973): n is a, c, t, g, unknown, or other
  misc_feature (989)..(989): n is a, c, t, g, unknown, or other
aagctggagctccccgcggtggcggccgctctagaactagtggatcccccgggctgcaggaattcgtctcacccctagaaaaatctccttcccctttcattcccaacgaggcaacgacccgcccctgccccgcctcgcgatccccacccgcggcggcgcggagggccggaatccaaaccctaaccctagcggcccgggcgccgcctccggtcccgcccgcccgccgcgccgggccgcgatggggcagtgctacgggaaggcgcgcggcgcgtcctcgcgggcggaccacgacgccgacccctcgggggcggggtcggtcgcgccgccatccccgctgccggccaacggcgcgccgctgcccgccacgcccaggcgccacaagtccggatccaccacgacggagcccccccgcggggccggcgacgcccggcgccaccgccttgggcttagacccgtacccggaccggcggcgccaagcccgcatccccctcggggcatgttcgccagtcgccggagcccgagcccacacccccgggagggtactataacggcggacactgtaccctgaaggcccttccacaccgccacaaacaaaattctaagtgcccaccgacattagcctcaagcagaccatcaggaagagggagggcaaagggcaccaaagggatgagaggtcccaatatcactccataaatatagagagaccagtagacaaacgatgataccggagaactcaaggaatcccgtgttcaacacaatgattaagataccaatacggggtgaccacctgaaatatctaccngagcgaggaagagcagaatcacgacccgcgttgaggagacaaagagaaaggattggtggnctagagccncnaatgaaaacttataggcagtagcgggcaagacacggcatcttcaccagtcgatatggctagtagaacagtcgacggcggaacgtgaccacgngatcgacnaacgacagacatgcangaactacgaccaacagctagttaacaagcagtagcgcacaacactatagatatacaaag

SEQ ID NO: 94097 - protein, 109 aa, Zea mays
  misc_feature: Ceres CLONE 1583687
MGQCYGKARGASSRADHDADPSGAGSVAPPSPLPANGAPLPATPRRHKSGSTTTEPPRGAGDARRHRLGLRPVPGPAAPSPHPPRGMFASRRSPSPHPREGTITADTVP

SEQ ID NO: 94098 - DNA, 1092 bp, Zea mays
  misc_feature: Ceres CLONE 1583689
  misc_feature (45)..(45): n is a, c, t, g, unknown, or other
  misc_feature (912)..(912): n is a, c, t, g, unknown, or other
tgggggggtggggggagtggcggtttggtgggggccatatcttgnttagtcctgaacccggcggaaagaacaaaaactcacggggggcggctctctaactagtggacccccgggcttttgattcgtctccccctagaaaatcgactctttaccttccttcccttttcactcccggctcccactctcaccccttccgcctacccacgctacggaaacggaatacagccacctctccttcccccaacctctggttcaggtccgatgctccccatgtcgcctctactcgagctcgattcttaggggtactggcgctcgttgcagccttgccgcttgacacgtttatcctcgtggcacagtaccccctcttcgcgctgccagggatccaggacccctggacggtcgtgttacggctgtttcccttggacaccctgggaacagtcgctcagccaaggggcccctcccttctgcgcctgtttaacgacggacactatctttttagtacccacttagatacgctcaagaaaagggggaaaaaacgggcgcgccatacgcattaaacttccccaaacaagaaaaggggtgtccactaaactacacacaatcagaatcatcgataaaaaagcactagatggggtgggcggagggggctcccgcaaaaacctcttctatttttgagaaacagtgagagaatgcattactttccttatcaacccccccacctcgcaaaatattgagaagaatctaggccatttggtcgcgtcttgctgcctgctgcacccccaattttttgtattcaaccgggagtttccacgcccgctcagaccttcaaatatgtaactatgttaaccataagatgagtgctcgtcgaccgataaccaaagtatccatatcatattaaacaaaaaaagttcncgtatacagttccacattccaatctgatattacttacagggactcaaggtatgtactcagttgctcgctctgtggttgaatgtgaatgggtttcgcgaggtctgtttgttttccggttctttctcaacccgcggtcgaatgacttatataatatactatatctgtcttccgctgtgcccc

SEQ ID NO: 94099 - DNA, 842 bp, Zea mays
  misc_feature: Ceres CLONE 1583692
  misc_feature: Encodes the peptide sequence at SEQ ID NO. 94100
  misc_feature (269)..(269): n is a, c, t, g, unknown, or other
  misc_feature (270)..(270): n is a, c, t, g, unknown, or other
  misc_feature (319)..(319): n is a, c, t, g, unknown, or other
  misc_feature (326)..(326): n is a, c, t, g, unknown, or other
  misc_feature (335)..(335): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (433)..(433): n is a, c, t, g, unknown, or other
ctggagctccccgcggtggcggccgctctagaactagtggatcccccgggctgcaggaattcgtctcacccctagaaaaaatcgccagctgcactgcactgcacaacgcaacctcctcccctcaactacagggaaatcagccatgagtgcgtcgtcggcgaagccagccaccggcggcaagacgtcgtggccggaggtggtcgggctgagcgtcgaggaagccaagaaggtgattctggcggacaagccgaacgccgacatcgtggtgnnctgcctcaccaccacgcaggcggtgacctccgactttggggttcgaccngtgtccngcgtcttcngtcgggaccgttcgcccagaacgccccatgtttggctaaggctaagaaccctccagcccaaaaaagggtcgttcccgggccccccccccnnnnnnntnatatattttataaatttttatttattgtgggtgggggggagggaccactcccccctctactaagtcgaaccccaagatgggtgttgttttagaaggaacaagccgttcgctgatatcgacgcgacgagaatagtgatagttgagtcttggagttggttcttctgtgagtcctgcccggggtgtgagtggttgttggtctatgtaattatataggctcccatggtaatgagtttctttttatgccccacctattggtctgtggcgtatgatagatattaggcctcccctaagtgggtccaatatgcgttgctgtgttatcggttattcctcatttctgtacagtgtttctatcatgttggatctttgttcacacacttctgtctttgttcgaactcgtctcttgccttat

SEQ ID NO: 94100 - protein, 117 aa, Zea mays
  misc_feature: Ceres CLONE 1583692
  misc_feature (13)..(76): Pfam Name: potato_inhibit Pfam Description: Potato inhibitor I family
  misc_feature (43)..(43): Xaa is any aa, unknown, or other
  misc_feature (62)..(62): Xaa is any aa, unknown, or other
  misc_feature (65)..(65): Xaa is any aa, unknown, or other
  misc_feature (95)..(95): Xaa is any aa, unknown, or other
  misc_feature (96)..(96): Xaa is any aa, unknown, or other
  misc_feature (97)..(97): Xaa is any aa, unknown, or other
MSASSAKPATGGKTSWPEVVGLSVEEAKKVILADKPNADIVVXCLTTTQAVTSDFGVRPVSXVFXRDRSPRTPHVWLRLRTLQPKKGSFPGPPPXXXIYFINFYLLWVGGRDHSPLY

SEQ ID NO: 94101 - DNA, 1126 bp, Zea mays
  misc_feature: Ceres CLONE 1583693
  misc_feature: Encodes the peptide sequence at SEQ ID NO. 94102
  misc_feature (1)..(1): n is a, c, t, g, unknown, or other
  misc_feature (8)..(8): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (23)..(23): n is a, c, t, g, unknown, or other
  misc_feature (31)..(31): n is a, c, t, g, unknown, or other
  misc_feature (32)..(32): n is a, c, t, g, unknown, or other
  misc_feature (41)..(41): n is a, c, t, g, unknown, or other
  misc_feature (62)..(62): n is a, c, t, g, unknown, or other
  misc_feature (700)..(700): n is a, c, t, g, unknown, or other
  misc_feature (765)..(765): n is a, c, t, g, unknown, or other
  misc_feature (993)..(993): n is a, c, t, g, unknown, or other
  misc_feature (1054)..(1054): n is a, c, t, g, unknown, or other
ncggcccnaaannnaannncatnccgcgcanntccatcggnccccttagaataaccgcggangattgagtgggtggaactccccgcggtggcggccgctctagaactagtggatcccccgggctgcaggaattcgtctcacccctagaaaaagcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcgggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaagacctctgcgtcaccctggcttctggggccccgggaaagacgcagaaccgtgctgggaccagctccccggggtacgccggagccccgggtccgcttaacgccgcctctttgggggcccctttggggggcccgggcaagttcccaccccttgcttcaaacgccccgttctacctgggccgncccttccggccggtcaaaaacagccttttcccttcttcccggggcaaaccaattgtccttctccnttcaaaaaagggccccgcccaaaagggttcttaaaaacttttttctcccttttctggggcgcccccgcattagagcacataccggttggaaacccccaaagggaacgtgaaaaaacaaccatggaatctggcgtggaacccccttttagacagagtggccccgctcaaaacgtgaattccgggcggtgtcttcgccagcaccctatcccttacatatcattaccccgngaaaaaaaaaaaaccccctcccggggaagataataaaaagagatggcttcctaaggtgtgnaagagggaccaccacttcctttataaaaaaatagcgggggctcaccaggtaagtcggcccccccaacccccg

SEQ ID NO: 94102 - protein, 146 aa, Zea mays
  misc_feature: Ceres CLONE 1583693
  misc_feature (136)..(136): Xaa is any aa, unknown, or other
MMELQANGSAAVGGAMVVGLSPLSEALWRDSKALPPGAGPAALIGDVSARLTWKDLCVTLASGAPGKTQNRAGTSSPGYAGAPGPLNAASLGAPLGGPGKFPPLASNAPFYLGRPFRPVKNSLFPSSRGKPIVLLXSKKGPAQKGS

SEQ ID NO: 94103 - DNA, 1146 bp, Zea mays
  misc_feature: Ceres CLONE 1583694
  misc_feature (61)..(61): n is a, c, t, g, unknown, or other
  misc_feature (321)..(321): n is a, c, t, g, unknown, or other
  misc_feature (322)..(322): n is a, c, t, g, unknown, or other
  misc_feature (390)..(390): n is a, c, t, g, unknown, or other
  misc_feature (391)..(391): n is a, c, t, g, unknown, or other
  misc_feature (445)..(445): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (474)..(474): n is a, c, t, g, unknown, or other
aaggacaaagaggtgggggctttcagtagtttggtacttcactttggaaagggctccgtcntaaaaaagatggttggagggggggctccccgcgggggcggccgctctagaactagtggatcccccgggctgtttgaattcgtctcacccctagaaaaagacaccacacgacactccccgagcacttacgccgcaatagcaccacccccagacccaagtcctgtcaaggcctcaacacacacacacactctctcgcttgacctacccccctcctcccccagccgggcctgcagggtggttcgacgcttcgcccgcccacgnngtaggcggacgacccaaccggaattgggattttagtccattatccaaccagcggttaaggggcctccnnggaccttgcccaacagaaagaaaacggcccgcccggcaacgaacaccacaaggnccccaatgccgaaaccaannnccannntntggggacctaatcccacaccaaaccattctggggacccgatcgttcttgattatgagaataatagatgttgagggatcgccaccgaccccacggagctccgacaatggcggaggtgtcccaaccataaaccaccgtcacattggattttggaaaacaaatgcatttgaattctcattgaaagatctgacaatatgtaagatgagggattggatggggagagcgccacgagttatacgtgccggcgtttgggactattactgcgaactatgttgctcaaagtggggtgggtgacgcttaaatgacggcgagtagtatgcatggagcttccgtacctctagtagacactcgccgcgtgtagcttacagctaacggggggacataggaagtcgacgcactgaatgatagacgaagtctgcataaatcaaattactgacattggtcgggacgtatgtacaagaccaacatatgttgaatcatcacatccgcgggtgaaggatttcttctactacccctcaggtgcttgtggtgtcccctggctagggtgctgtgcgtgggggggctcgagaaaaaaatattattgttatattgtaaattacagcttcgttaagattagattatgaagggcacatctcacagtacattatgggacaaatatcttaatatgttgtagg

SEQ ID NO: 94104 - DNA, 812 bp, Zea mays
  misc_feature: Ceres CLONE 1583697
  misc_feature: Encodes the peptide sequence at SEQ ID NO. 94105
  misc_feature (660)..(660): n is a, c, t, g, unknown, or other
  misc_feature (731)..(731): n is a, c, t, g, unknown, or other
  misc_feature (772)..(772): n is a, c, t, g, unknown, or other
  misc_feature (777)..(777): n is a, c, t, g, unknown, or other
  misc_feature (796)..(796): n is a, c, t, g, unknown, or other
ctccccgcggtggcggccgctctagaactagtggatcccccgggctgcaggaattcgtctcacccctagaaaaagtctccccccgccacgacccctcagccctcacacaagagacgcagctgcgagtccgccagccttatcctcctccccgtctccggctccaacccgcaagcgcggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggttcttgctcaggggctgatcgctgagggtgttaggttgtggcagctggtgctaatcctggtcagattactcgtggtatcgagaaacagcgaaagcactangtgaagaactacggaaagtgtctaaggaggtcgaagatagtgagcttgcagatgttgctgctgttagtgcnggcaacactacgaaatgggtatatgatagcagagccatgancaggntgggtcggaaaggtgtggntaccccgaaggaagga

SEQ ID NO: 94105 - protein, 160 aa, Zea mays
  misc_feature: Ceres CLONE 1583697
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVRLWQLVLILVRLLVVSRNSEST

SEQ ID NO: 94106 - DNA, 854 bp, Zea mays
  misc_feature: Ceres CLONE 1583698
  misc_feature: Encodes the peptide sequence at SEQ ID NO. 94107
aagctggagctccccgcggtggcggccgctctagaactagtggatcccccgggctgcaggaattcgtctcacccctagaaaaaatcgccagctgcactgcactgcacaacgcaacctcctcccctcaactacagggaaatcagccatgagtgcgtcgtcggcgaagccagccaccggcggcaagacgtcgtggccggaggtggtcgggctgagcgtcgaggaagccaagaaggtgattctggcggacaagccgaacgccgacatcgtggtgctgcccaccaccacgcaggcggtgacctccgactttgggttcgaccgtgtccgcgtcttcgtcgggaccgtcgcccagacgccccatgttggctaggctagagcctcagcctagaggtcgtcggcaccgccggccatgaccacctgctatatgtcactactagtaataaagtataaataacagggaggatgcatgctcatccttggaatctgtacgcttgttggactactacttggctacttgaaacgactacttggctaaaaaaaagaatctccttcctctcctcctctcgcgtcctgtccaaggatccggccggcaaggatctccggggcgcgcgagcagccatggccgcgaacggagaggatttccggggccctctcctgcttggagcgcgagacgacggagcggcctggtggggccgttgacgacgccgggcccttccgcgaggccggccggagcagcagcccgcccgttggacgggcgctctacggcgggcgccgtcgggggaggcccttggtccgcgaacttcaggggcggcggggcgggggtccttgacgatgtgacgaacctcagaggtaagggg

SEQ ID NO: 94107 - protein, 73 aa, Zea mays
  misc_feature: Ceres CLONE 1583698
  misc_feature (13)..(73): Pfam Name: potato_inhibit Pfam Description: Potato inhibitor I family
MSASSAKPATGGKTSWPEVVGLSVEEAKKVILADKPNADIVVLPTTTQAVTSDFGFDRVRVFVGTVAQTPHVG

SEQ ID NO: 94108 - DNA, 688 bp, Zea mays
  misc_feature: Ceres CLONE 1583700
  misc_feature (585)..(585): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
tggagctccccgcggtggcggccgctctagaactagtggatcccccgggctgcaggaattcgtctcacccctagaaaaaaagcccccttccgaccttgcccctgcggtctcccgagtcccgaagcatccccttccaaaaccctcgccgcgccgcagccacccttgcttccgcacgctatcgcccgggaccagccatctatggcggcgtccctgctcctccgcgcccgtgcgcccgaaggggagctgcgtccccctctcggatccctggggggccgcatacagccaacactgggttgcccaaaattggccaaaaaggggggaaaggtttccaaaaaaccttttaagggcaaaaaacccgggggaaaaaaaagggtttttgggggaattgaattttgggggaaacaaaaaaacacccccggggggtctcctcttttggggggggggggaaaaaaaacccccccaagaatttttttttaaaaaaaacccccaaaaagggggggaaaaaaaaaaaaccccccccccgggggggggggcccttttttttccccaaaaagggggggggaaaaaaaacttggtggggagaanaaaaaaaannncccccccaaaacaaagggcgggcggggggggttttttacacccccccccccccaaaaaaaaaattttttctttttttgggagaaaaaaaaaa

SEQ ID NO: 94109 - DNA, 854 bp, Zea mays
  misc_feature: Ceres CLONE 1583701
  misc_feature: Encodes the peptide sequence at SEQ ID NO. 94110
ctggagctccccgcggtggcggccgctctagaactagtggatcccccgggctgcatgaattcgtctcacccctagaaaaagaggacatcctcggccttccagggcagcaaccacgaaagccttctgcgcggggtgctttcctcgcagcaaatattcctgccttttgcattccggctttgcaagtaccttgctttgggcatatatattgtgaggtctctatatatataggaggttcaaggtgatcggcagaaccacacatgcaaagatggcgagcgagcacaaggccaccacccttgttctcatgttctgcctgctagcgctggggagagcggagaacctaaaatacaaagacccgaagcagcccgtcgctgttcggatcaaggacctgctgggtaggatgactctcgctgaaaagatcggccagatgacgcagatcaagaggaaaaacgccacgggcgacacgctggccaaatacttcatatgtagcgtgctgagctgcagatgcagcctgcctgctcctcaggcgtctgctcacgcttgggccgccatggagaccgagatgcagaatggcgctctttctacgcgtctgggaataccgatcatctacagcatcgatgcaatgcatgggcacaacaacgtctacaaagctactattgtcccacacaacgtccggcatcggagctaccatggcaccctgacctcgttaagagaattggcagagcaactgcatcttaaagttagagctactgaaaattccttagcgcttttgcaccctgtatagcggtttgaaccagatcacagatgggggagtctgctagtgagagctacccctgagggatacaaagggttgtcca

SEQ ID NO: 94110 - protein, 171 aa, Zea mays
  misc_feature: Ceres CLONE 1583701
MASEHKATTLVLMFCLLALGRAENLKYKDPKQPVAVRIKDLLGRMTLAEKIGQMTQIKRKNATGDTLAKYFICSVLSCRCSLPAPQASAHAWAAMETEMQNGALSTRLGIPIIYSIDAMHGHNNVYKATIVPHNVRHRSYHGTLTSLRELAEQLHLKVRATENSLALLHPV

SEQ ID NO: 94111 - DNA, 1073 bp, Zea mays
  misc_feature: Ceres CLONE 1583702
  misc_feature: Encodes the peptide sequence at SEQ ID NO. 94112
  misc_feature (1073)..(1073): n is a, c, t, g, unknown, or other
ctccccgcggtggcggccgctctagaactagtggatcccccgggctgcaggaattcgtctcaccccctagaaaaaaaccagtaaaaggtcgggaaaaatccgaaatggccgctagtggcctcggtctctccacctccttcctccccggccacgacaccctcctccggcgccggcgccggcggccggcgggccacgccgccgcgtcgttccggccggtgacggcggagctcggcggcgtcgcgacggagctgggccgccagctggtggaggcggtgggcgtggggctcccctgcaccgtcatgcagtgcggcgacgtcatctaccgcaacacgctcccccggaaccacgggctcaccatcacgggccccgggcgtcacactttttcttccccccccaagtcgtacctctggtccacgcctcggcggtcgcgcccggggttcttccaacaatgttccgtccttcgcctttcgcccgaaacgccttctttccgcccttaccttcccgcaagggaatgactttgggttatttgggaaaagaaagctttggggggaggggccgcatttccgggggtccccggtgttaaagggctttcacctgggcgcaaacccccgcaaaagccggccgaaaataaagccagggggagaaatttttgttcctgtggaaagaaagaggcccacccggtaagttattggggtggcccagtgggagaagaaattttggggaaatagaaatttgaaaatcgttgtttcacgggaagggggacaattggtgcctccaattaagaccttggtggcgcggagattttctatgttgttttggggcttgttttgtgcgaatgatctcataagcgccaagaagggttataagggagatccttgaaacaaacaatttgggcctctattatgtggccgcttttttggaagggggcgagggaatacccactttatatggaatcctccggacggagaaggagagagtaaattcctccctataaagagggtgggagaacaaaaaattacttgagtggggtgtgtcgcaaacattctccgccaaagggagatatggtcggtatn

SEQ ID NO: 94112 - protein, 136 aa, Zea mays
  misc_feature: Ceres CLONE 1583702
  misc_feature: SWISSPROT Homolog: EC 2.7.11.1 Non-specific serine/threonine protein kinase
MAASGLGLSTSFLPGHDTLLRRRRRRPAGHAAASFRPVTAELGGVATELGRQLVEAVGVGLPCTVMQCGDVIYRNTLPRNHGLTITGPGRHTFSSPPKSYLWSTPRRSRPGFFQQCSVLRLSPETPSFRPYLPARE

SEQ ID NO: 94113 - DNA, 807 bp, Zea mays
  misc_feature: Ceres CLONE 1583703
  misc_feature: Encodes the peptide sequence at SEQ ID NO. 94114
  misc_feature (807)..(807): n is a, c, t, g, unknown, or other
ctccccgcggtggcggccgctctagaactagtggatcccccgggctgcaggaattcgtctcacccctagaaaaaactgcccacgccacccaaaaactcatggccagcgctgtctgcggcgtcaccgcgcgcgcccacctgccttccgccgtccctgcagccgcaagaaagctcttcttccgctgcagggccgcgtccaccatgaacgaggcatcggcgagctcgccggacgccgaggagaagaagacgacgactgtcttcgtggccggctcgacggggcgcaccggcaagctcgttgtggagaagctgctggccaagggattcggcgtcgtcgccggtacgacggacgtgagcagggcccgcggcagcctgccccaggaccccaaccttcagctcgtcagggctgacgttacggagggcgtcgacaagctggtggaggccgtgcgcggcgtcgatgctgtcgtctgcgcgacgggattccggcggtcctttgacccttttgctccgtggaaggtagacaactttggcacagtgaacctggttgaagcatgcagaaaggctggcgtagcaagattcgtactcgtcagctccattttagtaaatggggccgccatgggtcaacttctgaatccagcctacattgtgctcaatctacttggcttaacactggtcgcaaagctacaggcagatgatcacatcaggaaatcaggaatagattacactatcgtaagggctggagggctgacagatcaaccccctacagggaatatagtcatggaacctgagcatttttggttgtcgaaatttn

SEQ ID NO: 94114 - protein, 236 aa, Zea mays
  misc_feature: Ceres CLONE 1583703
  misc_feature: SWISSPROT Homolog: EC 1.1.1.219 Dihydrokaempferol 4-reductase
MASAVCGVTARAHLPSAVPAAARKLFFRCRAASTMNEASASSPDAEEKKTTTVFVAGSTGRTGKLVVEKLLAKGFGVVAGTTDVSRARGSLPQDPNLQLVRADVTEGVDKLVEAVRGVDAVVCATGFRRSFDPFAPWKVDNFGTVNLVEACRKAGVARFVLVSSILVNGAAMGQLLNPAYIVLNLLGLTLVAKLQADDHIRKSGIDYTIVRAGGLTDQPPTGNIVMEPEHFWLSKF

SEQ ID NO: 94115 - DNA, 1169 bp, Zea mays
  misc_feature: Ceres CLONE 1583704
  misc_feature: Encodes the peptide sequence at SEQ ID NO. 94116
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (28)..(28): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (470)..(470): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (797)..(797): n is a, c, t, g, unknown, or other
  misc_feature (966)..(966): n is a, c, t, g, unknown, or other
  misc_feature (1019)..(1019): n is a, c, t, g, unknown, or other
  misc_feature (1062)..(1062): n is a, c, t, g, unknown, or other
ttgtgtggtgtnnnnnggtnncngtggnaccccgggaaaaacgacacccccccaccacgaccnnnnnncccnnnnnnnnccaaagctggaactcaccgcggtggcggccgctctatactagtggatcccccgggctgctgtattcgtctcacccctagaaaaagcaacctttgccgagcggcaggacgactaatcggaggagttgctgtgcggggtgaaggaagaggagtcggctcatgtacaagaaccggccaagaatccgtcaggccgtcccaccccactaccccatgaaggggtcgaaacagcggccggccccggcctcacttcacctcggcagcactgggttaattccctggagccacgttttctacaaagtttcgtgattggtggtgtggggttgatggacttgaagcgtcactcatccggtcagacgtgttttcttgaccttgacgctgacatcattggtcganaccaccaaatacagcaaacataaagnnnnnnnnnnnnnnnnnnttgtgggggtggttgggtgtggggttctttctttggggtgttttggtgggttgtgtgggtgttggtgtgtccttgtttttcgcttttttctttctgttgtggcgctcttgcgtctccttcccttggtctgtcctgcgggccccgctcttctttgttcttcgggtcctcttcccgggtccctccgtcttccggcctcttcgttctgcgtcgtgtccgcgtgcttcggcttctgttctcgtggttgtgtctttgggcggttgtttgtggtttttctgcccctttgnccgtgtcttctgtgttttttgtctttgttgtctttgcgttcttcgtctcgtgcgttctggtggctttggtgttgttctttcgcgcttctcgctgttccgggagggtgtcttcttgccgcggagcgtgggttgctgtgttttagtgcttggttggtgcggtcttctgtcncctctctgctcgtggctaggtgcccttcttttgtgcgcgcgctgcgtgtgcgnttgtcttgcggctgtgttcttccctccccccccctcgtgcttnctcgctctctgcgatgtgttgagtccgctgtatgttcaggggaggttgggcttccctgtgtgtctaacatgcaagctaagggtttattgtatatgaatcagttgtgg

SEQ ID NO: 94116 - protein, 31 aa, Zea mays
  misc_feature: Ceres CLONE 1583704
MKGSKQRPAPASLHLGSTGLIPWSHVFYKVS

SEQ ID NO: 94117 - DNA, 877 bp, Zea mays
  misc_feature: Ceres CLONE 1583705
  misc_feature: Translation starting site: 182
ctggagctccccgcggtggcggccgctctagaactagtggatcccccgggctgcaggaattcgtctcacccctagaaaaaatcgccagggcgtcggatcggagcgagctcattctcaactcgactcaagagctctgcctcctccatctccccttctctggcctccggagccacgctgagagatggaggcgaatcccaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttcagggtagcagcagtcaagtatgccgacaaccggatgctcggatggcgtccgttcaaagatggagtgccagggccctacttgtggaaatcatacaaggagatctacgacgaggtgctgcaagcatgctctgcgttgcagaagctgggagtgcagccaggttcccggggtggggatctacggagcgaactgtcctcagtggatagtgggcatgcaggcttgcaatggctatagtctagtctggtgtcccactgtacgatactttaaggggcgggaactgttcgacttcatcatccatcatggcgaagaacaatgttgccctcctacggggaccaggaaaataaaggagatactggtcccccaaactggcaagtctggccaagaagaatgaaaaagcattgggggggggttctactttcgggcgaacaaccggaaacaagaaccaaaagaaagcggggattccaaattgggggaatccaacatggtttttggccctgggggaacaaatttctccttgaaaaaggtgggggggaaagagga

SEQ ID NO: 94118 - DNA, 847 bp, Zea mays
  misc_feature: Ceres CLONE 1583709
  misc_feature: Encodes the peptide sequence at SEQ ID NO. 94119
tggagctccccgcggtggcggccgctctagaactagtggatcccccgggctgcaggaattcgtctcacccctagaaaaaattcttatctcctcgcttctcttcacctccctacctgtagttttctccactcgtcctcgtcctttgtccctgtccttcggggacaaaaacaaccaaggcgcaagcggtaatcttccgtggtgggggcgttctctgctgcaagcagtggtgacgccgcttggagggagggcgggcgggaaaggatggaggcggtggtggacctcaagtacctgccggttttcccgaacggcggcgtggccgcggccaagaagaagacgaggctcgggaccactgcggttgccggcggccagacgggggtgtactaccgggaatgcctcaagaaccacgcggcgagcctgggtggccacgcgctggacgggtgcggcgagttcatgccgtcaccggaggccgacccggcggacccgagttcgctcaggtgcgccgcgtgcggatgccaccgcaacttccaccgccggctaccggagctgtccccgacgccgcctctcctcgctttgccgccgcctccaccgccactggcgccggcgccggctgtcgcgccgcatgccatgcgtgacagccgcacgatgcgcggctagaaggcaacagactaacgcctgccggacgccttcgacgacgacactgaggagtctgacgatggctcatatttcgaagaagaccgtcccctaagccactgccggcgactgggcatgatgccacctgccgccgggctacgatcaggtcgcgccacacattgctcatcaacgctgaagcaccagcgcggcagggcat

SEQ ID NO: 94119 - protein, 130 aa, Zea mays
  misc_feature: Ceres CLONE 1583709
  misc_feature (36)..(97): Pfam Name: ZF-HD_dimer Pfam Description: ZF-HD protein dimerisation region
MEAVVDLKYLPVFPNGGVAAAKKKTRLGTTAVAGGQTGVYYRECLKNHAASLGGHALDGCGEFMPSPEADPADPSSLRCAACGCHRNFHRRLPELSPTPPLLALPPPPPPLAPAPAVAPHAMRDSRTMRG

SEQ ID NO: 94120 - DNA, 873 bp, Zea mays
  misc_feature: Ceres CLONE 1583711
  misc_feature: Encodes the peptide sequence at SEQ ID NO. 94121
  misc_feature (671)..(671): n is a, c, t, g, unknown, or other
  misc_feature (850)..(850): n is a, c, t, g, unknown, or other
aaagctggagctccccgcggtggcggccgctctagaactagtggatcccccgggctgcaggaattcgtctcacccctagaaaaataccgaagcatcggctgagttcctccctggcacactctctgcgatctctctgtcagaaatgtcgtccctggcataacatactcctgccttttgctttgtctcgacgatcttccccatcttccatgtccatcccctttcactctttgcttcctcgacctgccacctccatcatatcctcgctgtctctcccttgtcctacttggggcatcttgggagattgatcataagaatactgttccctgccctctacctcctctgtgaggggggattcacaccatctagataaggccacatgtgtagctatgctacatcccacctgtctgatgatgggataacagaaccctttcctgggtctctctcacgatcccctgaaaatatttcagattttttgcaactcctaaaatatgtctccggttcctatgatactggacaaagatctgagagactgaacacgccaatatcgaagtatgaggtgtcgtaaagttctggaacctatcgcaggctcttatagttcgctatgccgtccctctcgtctaccttcggtgtgcactaggatcagaacgtagtggatgaatccatcttctcanctgaggatggaacagaatccttgttgagtagaccatatgggaaggacttgttataccccgaaatagtaaggtgccaaccttagcggagctatgcgaggctactggccccttttcttcactactacaatctacgggggtaaaaggactctattccaaagaacttgcgttgctaacttcgntttttgcccaaccccaatttggt

SEQ ID NO: 94121 - protein, 62 aa, Zea mays
  misc_feature: Ceres CLONE 1583711
  misc_feature: SWISSPROT Homolog: EC 1.1.1.49 Glucose-6-phosphate 1-dehydrogenase
MCSYATSHLSDDGITEPFPGSLSRSPENISDFLQLLKYVSGSYDTGQRSERLNTPISKYEVS

SEQ ID NO: 94122 - DNA, 1254 bp, Zea mays
  misc_feature: Ceres CLONE 1583720
  misc_feature (1)..(1): n is a, c, t, g, unknown, or other
  misc_feature (6)..(6): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (926)..(926): n is a, c, t, g, unknown, or other
nggggnaaaaaaaaaaaataaaaaaaaaaagatcagccacccccctcgtgtgtattatgggnnnnnnnnaaaagctggagctccccgcggtggcggccgctctagaactagtggatcccccgggctgcaggaattcgtctcacccctagaaaaatcttcaatcttggcggccaggtcacgtccttacctcgcgtggcctcccgttctgacttcggagtccctcggtctcaacgactagttgagagctctcggctcctgttcgggcgaggggaggaggttcatgaagctgctgtgggctccgttgcagccgtcacgggcgggagtccgtgattttggacgccccaccgcggcgagatccgggaagcgcgttggctgttgtgctgcgagttacaaggttcggtggccgattgcttcaccctgctgagaaattagaggggcggcccatggcggggtccaggttcaggacgttccaggtggggagaacggtgactccgcctattgacagctggcagccggggggtggggaaggatccctgaggaagggaccccgtatccaggttggctcggaggtggggcccgcaaccgctcccccgaacctagtcagtatcgtaagagtggcgataacccgaactcattgtgggagtttccaaggttcctcgattgtgggggacttcctccccgggccggttgtgtacgcccctggcgtgcgctatgtaaggagacgggggtttcgctagtgtagcaaatgtacgcgcaggtgtcaggtcgtggtatttaaacttattgcactgttggagtcatgcgatactccccccgctcctgtaatataaaaggcactcccgcttttattccaattcgcaactttcccaacgttacttggtcgtcacttttagggagtgcgcaagagtgtcgcgccaaatctcgtngaacgagagggtgttcgcgggcaaaactcactggacaaaaagacggggaaaggtttgtaattttgcacagttgatcggcggtataggggcaaggctttcgcctctcagacgcgcggggtttatgttggcataggctgccttaattatatcaactgaacgaacttctatctggtagaatgtcgctttaatgttggttgagcacatgacctgcttttttagagtccgaaacagagcgctattgaggtatgacccggaccaactcgtacattgggtagaatgaggtcagaataacggattcgttcgccgcaagactaggcacgcagaggga

SEQ ID NO: 94123 - DNA, 844 bp, Zea mays
  misc_feature: Ceres CLONE 1583725
  misc_feature: Encodes the peptide sequence at SEQ ID NO. 94124
aaagctggagctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggtcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgccccgtcgtgaccctgggcctgcagcccggcaagggctttcacgtccgcaaaatcgcctccatggtcccaccctacgacaagatcaagaacgccggcaaaaggtccgccatccgaatacgccgtgtgcgcgcctcaaggggcaggtcatcctgggtcattgggcaaat

SEQ ID NO: 94124 - protein, 152 aa, Zea mays
  misc_feature: Ceres CLONE 1583725
  misc_feature: SWISSPROT Homolog: EC 4.2.1.1 Carbonate dehydratase
MSSCLCLPKKKEGPAKEKPSTDTPTSSLLQNQKPSQPPPPPSKASSKGMDPTVERLKSGFQKFKTEVYDKKPELFEPLKSGQSPRYMVFACSDSRVCPVVTLGLQPGKGFHVRKIASMVPPYDKIKNAGKRSAIRIRRVRASRGRSSWVIGQ

SEQ ID NO: 94125 - DNA, 1273 bp, Zea mays
  misc_feature: Ceres CLONE 1583726
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (19)..(19): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (29)..(29): n is a, c, t, g, unknown, or other
  misc_feature (30)..(30): n is a, c, t, g, unknown, or other
  misc_feature (95)..(95): n is a, c, t, g, unknown, or other
  misc_feature (807)..(807): n is a, c, t, g, unknown, or other
ngggggggnnnnnnngccnccccnnntcnnccaaaaaaaagtaaaggttaattaaaaagtaagttcaatgattaggggggagtatttaggtgggngactttgaactcaacgtcgggtggcggccgactctttgagctactcgcatcccgcggtggtgcgggcaatgtcttctacagcaaatgagaaaacatctgtgggcgatcagatcaacttgtccgaggaggtgtggctcagtcattcgtacatccgacgtgagtgaaggtcatcttggaccggaaacaagcgtgctgccgctccgaattcgctacggaggcccgatggtgaggaggactcctatgccctactagattacttccgactacccgacgctgctggtgtcggactggacaaggctgggcttcgcggaggtggattatgggtgggggccgaccgcctatgtgacgcctctgactaaattggagtacatccgcacgtgcatcctctgcatagccatgcgcccacaagaccatggcgcaggctctatcacacagtgcggtgacgctcgagcgccatggtcatgcttgccactaacaccagtggtgtgacaatgaacctaagcagtggccttccagccaaggagccggtccatgggtgcgataaagctcctccccggtggtggtaccatctccgtatttccttggaatttttattttttttctgccaacggtccaactccttttaactggtaggggttaaaagttaattccaaattccggggttaattctaagttgagaatccacccccagtggcccacacccacaagttcntgtggtcctgtaccctggtggggccaaaaggccatcactctcccctcggctacagagataatacatgtggcgacgaccgtgggggttacaagagacccacaggaatcactcgttgattataatcgctctgtgttggcgctgcgccacatagagagagtattttacttctgtagtttttgttaccagaaacgtgtggcgcctgagggggggtgtgagcgggtgtcacgtcggaggtccgacgaagaggataatatccggtcccaccgaggcgatataagaagagacccccagagctgtgaggaggtggtagtaagaaactggaagagtgtgacatccccccctacggacaaatatatgtgttattagaggggggtgcttatacaccacctgggaaaaacaatataatattagtgtaagggggaatattgtgcgcaaagatagaaaaattgcctcatctttatttgtt

SEQ ID NO: 94126 - DNA, 800 bp, Zea mays
  misc_feature: Ceres CLONE 1583727
  misc_feature: Encodes the peptide sequence at SEQ ID NO. 94127
  misc_feature (793)..(793): n is a, c, t, g, unknown, or other
ctggagctccccgcggtggcggccgctctagaactagtggatcccccgggctgcaggaattcgtctcacccctagaaaaatttcccctcccgcccgcctccctccgtccactcggatccggaaaaccctaaccctagacgtcgcccggccgccgccatggaccccgacggcgacccggccttccaccgcaacgaggccatctccgcggtccaggatgtcgaccagtactatggcgacgacgacgacttcgacgacctctacaacgacgtcaacgtcggggacggcttcctccacgcctcccaccaggcgccgccgccgctgccgctgccgccgccacctccgactcagcaggccccaccgccgcagaagcaccagctccctccgccgtcccagcagctgccgccgccccagcagcatccacctgcccacgtcctcccgccaccgccgccgcaggccccaccgccgcagcagcaggtaagcatcccgggggtggccgtccctgctcctggcagacctcccgcccagaccaacctccctccgccgcctcagccaccggccgctcccgcgccgccgccgccgcctcagcaccaccatattcagcaagacgggatcaaccgccctggagggaacatcgccggtggccccatcgtggtcgggaacggtggccctgctggcgggggtgacggccctggcggcacgacgctgttcgtgggggaaactcactggtggacaacggacgcggatctggaatctgagctcagcaagtatgggccggtcaaagaggttagggtcntcgacat

SEQ ID NO: 94127 - protein, 214 aa, Zea mays
  misc_feature: Ceres CLONE 1583727
  misc_feature (213)..(213): Xaa is any aa, unknown, or other
MDPDGDPAFHRNEAISAVQDVDQYYGDDDDFDDLYNDVNVGDGFLHASHQAPPPLPLPPPPPTQQAPPPQKHQLPPPSQQLPPPQQHPPAHVLPPPPPQAPPPQQQVSIPGVAVPAPGRPPAQTNLPPPPQPPAAPAPPPPPQHHHIQQDGINRPGGNIAGGPIVVGNGGPAGGGDGPGGTTLFVGETHWWTTDADLESELSKYGPVKEVRVXD

SEQ ID NO: 94128 - DNA, 833 bp, Zea mays
  misc_feature: Ceres CLONE 1583728
  misc_feature: Encodes the peptide sequence at SEQ ID NO. 94129
  misc_feature (39)..(39): n is a, c, t, g, unknown, or other
  misc_feature (316)..(316): n is a, c, t, g, unknown, or other
  misc_feature (318)..(318): n is a, c, t, g, unknown, or other
  misc_feature (319)..(319): n is a, c, t, g, unknown, or other
  misc_feature (333)..(333): n is a, c, t, g, unknown, or other
  misc_feature (334)..(334): n is a, c, t, g, unknown, or other
caaagctggagctccaccgcggtgggcggccgctctagnaactagtggatcccccgggctgcaggaattcgtctcacccctagaaaaaaaaaatcctccgcctcactcccatcccatgccctcctctcaaccctagtccctccccatcccttactcatggcgctctcttcccacgccaccaccgctgctgcggcggcggccgtcggcacctttacccaatccactcgctcctcttcccggcgattccccgcgtcgtctgtctccccccgccccccgccgcccccgcgctccctacgcctcgacccatgcatggcgncnngtcctctcccccgnncacatggccgcggcccgaaggtctcctcgctgcagccatcggacaccttggagcgcgagccagcattcgtcccaacccacaagggccccgctcgcgggggctgtcccccggggactgcaacttggggtccctctacttcggcccaggagggggcgaaaacctatggggcgcctcaaggtctttaaatgggttcgggggccccaacccgtttaaagggggaaaccatgggactcttgggcccccttcccccggggtggtggaaaaaaccccccttggggggccgcgggggaaaaccccccaaattttttcccccctttttgggaaaaaaaaaattttttggggtatacccccccggttttaacctcctgggaaaaagcgccccccccctctttttgggacaccccggggggaaaaagaaaaaccacctccccaaatatttttaaaaaaacattccctctcagggaggggggggtgtttttttcgcgcgcccgcgggagga

SEQ ID NO: 94129 - protein, 120 aa, Zea mays
  misc_feature: Ceres CLONE 1583728
  misc_feature (54)..(54): Xaa is any aa, unknown, or other
  misc_feature (55)..(55): Xaa is any aa, unknown, or other
  misc_feature (60)..(60): Xaa is any aa, unknown, or other
MALSSHATTAAAAAAVGTFTQSTRSSSRRFPASSVSPRPPPPPRSLRLDPCMAXXPLPRXHGRGPKVSSLQPSDTLEREPAFVPTHKGPARGGCPPGTATWGPSTSAQEGAKTYGAPQGL

SEQ ID NO: 94130 - DNA, 1199 bp, Zea mays
  misc_feature: Ceres CLONE 1583731
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (35)..(35): n is a, c, t, g, unknown, or other
  misc_feature (61)..(61): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (75)..(75): n is a, c, t, g, unknown, or other
  misc_feature (520)..(520): n is a, c, t, g, unknown, or other
  misc_feature (521)..(521): n is a, c, t, g, unknown, or other
  misc_feature (532)..(532): n is a, c, t, g, unknown, or other
  misc_feature (534)..(534): n is a, c, t, g, unknown, or other
agagtttgtnnccccnnncaccnnntttatttcanacccatcccacacccggagggaaccnccctannnnnnnanaaaaatggacctcccctcaggggcggccgctctagaactagtggatcccccgggctgcaggaatgcgtctcacccctagaaaaaactcctctcctctctccccgaaccaaactaaacccctcccactccaactccttctattctcaaaatgctatacaaaatgtctcacccctaccaccgccagtcaaaaatacaatatttgtgagtatttccagaaggaaaaaagtatttcaataataacctatttcccccccggatcgaggccgtagaccacaagcttttttctgctctatcctacgacacgcgggaaccacatacccaaccatgggtgtccctgaaccaactaacactgcacagccagctaataaattgctgagcgctccctgcacgcgcccccttgcaagaggcaaggttcataggttggagaaaaaaaaattgtgccccnncccccaaaaananaaaagagaattcatcgggtcatgattataaaatcgcgacccattttgaaaacatttggtagaggtacaggcaccttaccaattctttaaccatctgggtacgggatttgtaaattttgttcatccctccactagaggtggacctatttctcaaaagtcactgcctcaagaagattttgcctaatggaaaactccgtgtgtagatgattcactgcactcgggtgttccctataaatcttggggcgatatacagatgcgctcttgcatcaatcctttccctgtggcgggccgatgtaggattttgcaggtggacacggaaatattcttatgctttgtaagtaccaatgagaagtaaactctccgttagtattatttaccttactctcttgtttactattgtagcgtttgtaatctcgcgggtacaaatcttattgtcgtttgtagctgtgtgtgtcaacaatcatcggacttgtaacaacctgctctagatatataatcttagtgtgatgtataaacgcctctctgcataaatttagggtacgagcgtgactctaaccagagatatattgctgtttgttaaagaacaaaatagttaagagtcatcattactatataataaatttatatgaaacctgctcttcatgaagacgataatggatagtggat

SEQ ID NO: 94131 - DNA, 1206 bp, Zea mays
  misc_feature: Ceres CLONE 1583732
  misc_feature: Encodes the peptide sequence at SEQ ID NO. 94132
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (69)..(69): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (800)..(800): n is a, c, t, g, unknown, or other
  misc_feature (932)..(932): n is a, c, t, g, unknown, or other
  misc_feature (1206)..(1206): n is a, c, t, g, unknown, or other
tattttaaaaaaatgtcacatagattacgcacctttgtaatagtaataaaagtttgttatgnnnngtcntnnnnntcaagcatggactccaccgcggtggcggccgctctaaactagtggatcccccgggctgtaggaattcgtctcacccctagaaaaaaaacccaatggcatcacgaatgtggaacctcaaagccctggtcacctcactactctgcatctcggcgttgtcgtcgtcgccatggccatgcacggcagccggtcatctgggcggcaagcccctggtcaccgccgtcaccaaggacgcgtccacctccctctacacggcgccgctcaaggacggccacccgctcttcctcgacctcactagcccggtcatctcgctggccacgtgcgcctcctcctccaagaacaacaacggcacgctcaccgttagggtatgacgccaacgccaccgacggccataacttgctgttccccgccaccttctcggcgaaggccacgtagcgcaccgtcatccaagctgtccgccggtcgccagcagctgacggtgccatcgtggctcgccgccctccttccagcatagcaacaattctgctccccggctgcccgggggtctgctcaacgtcagaaaaagaccccccgaacaaagttgtgcccctggttggctctggctccgactaaacgggcgagggtacccacctattgggagccccaatagacctctaccgggatgtaggacctaatacactatcgagatcgagacgacgccccgtccccagggatatagacaccttcantacaacaccgtatctggcgcaacccgacgcttcgtcctgaatccttgtctctctgataagaatcatacatatgggaccccgtgttaattataggatgacgacaccaatttattcaccgccactcagaaaatncacggcaataactcaaggttgccccctcccgacagagcgatcgcactaaatgaatcgaccctccaaccccgggattaattaacccctcgtggatacaccaaccgtcgctccgaacattggagaggcggaccccgcattgaccaggagtagcgcctaaagaacactacacgtcctgtacactccttcataggcacacccgaggaaacataatagcaataaccgaatccggaatgcgatatagtcaataacatccccgttgaaggagggcttaccn

SEQ ID NO: 94132 - protein, 91 aa, Zea mays
  misc_feature: Ceres CLONE 1583732
MASRMWNLKALVTSLLCISALSSSPWPCTAAGHLGGKPLVTAVTKDASTSLYTAPLKDGHPLFLDLTSPVISLATCASSSKNNNGTLTVRV

SEQ ID NO: 94133 - DNA, 917 bp, Zea mays
  misc_feature: Ceres CLONE 1583735
  misc_feature: Encodes the peptide sequence at SEQ ID NO. 94134
ttattttttgtttttactcattttcatactaagatactaaattacttctaactcccttctggaaaaaacatctgctaaggtggaactccccgcggtggcggccgctctagaactagtggatcccccgggctgcaggaattcgtctcacccctagaaaaaagcccaaacacgactactgcattacacacacacacaggataggagtacgtgtctgcttctctctccccgctggcctcctcctccagtacttcagacagtgcaccgtgctgcggcctctttcatccctcaaggccggccgcccccagaaccagagtcggagtgaatccatggctcctccgcccctctcctcctggccatgggcaagcctcggccagtacaagtacgtgctgctggggcctctggtgtggaaggtgctgcaagaatggcgggagcaggcgggcctgccgctcggctcctggtggctgcacctgctgctgctgttcgcggcgcgcggcctcacctaccagttctggttcagctacggcaacatgctcttcttcacccgccgccgccgcgtcgtcgccgacggcgtcgacttccgccagatcgacgccgagtgggactgggacaactttctcgtgctgcaaacgctgattggggccacggtggtcaacagcccactgctcccgggcctgcggcagctctgcctgtgggacccgcgcgggtgggccgtcgccctgctgctgcatgtgggcttctcagaaccgggtcttctacctggcccaccgggcccctccaaagggcccccggctctttcgccccggctaccaaggccgcggcaaccacttccttcggggggtcaaccccaagcccgcttgaacagcccgggggtttccggggaacgcccccctgggaagaggtccctggcctgggcttga

SEQ ID NO: 94134 - protein, 196 aa, Zea mays
  misc_feature: Ceres CLONE 1583735
MAPPPLSSWPWASLGQYKYVLLGPLVWKVLQEWREQAGLPLGSWWLHLLLLFAARGLTYQFWFSYGNMLFFTRRRRVVADGVDFRQIDAEWDWDNFLVLQTLIGATVVNSPLLPGLRQLCLWDPRGWAVALLLHVGFSEPGLLPGPPGPSKGPPALSPRLPRPRQPLPSGGQPQARLNSPGVSGERPPGKRSLAWA

SEQ ID NO: 94135 - DNA, 869 bp, Zea mays
  misc_feature: Ceres CLONE 1583739
  misc_feature: Encodes the peptide sequence at SEQ ID NO. 94136
aaagctggagctccccgcggtggcggccgctctagaactagtggatcccccgggctgcaggaattcgtctcacccctagataccactctggaagagctcggattctaaccttgtgtcagacccgcgggccaagggacagtctcaggtagacagtttctatggggcgtacgcctcccaaaaggtaacagaggcgtgcaaaggtttcctcgggccagacatgacattggtcctcgagtgcaaaggcagaagggagcttgactgcaagactcacccgtcgagcagagacgaaagtcggccttagtgatccgactgtgccgagtggaagggccgtcgctcaacggataaaagttactctagggataacaggctgatcttccccaagagtccacatcgacgggaaggtttggcacctcgatgtcggctcttcgccacctggagctgtaggtggttccaatggttgggctgttcgcccattaatgcggtacgtgagctgggttcagaacgtcgtgagacagttcggtccatatccggtgtgggcgttagagcattgagaggacctttccctagtacgagaggaccgggaaggacgcacctctggtgtaccagttatcgtgccgacggtaaacgctgggtagccaaagtgtggaaaggataactgctcaaaacatataagtttgtaagcccacccccaggaatgagtgctttttgcctcacaactttcccttagagccctcccggttagcgacaggccaaaataataggcgaacggggtttcctcccaccccgttacctgggggaatggggaacgctaccaataaaacgtgttgtggaaaatattggggaatataatggttagcccggtccccaaa

SEQ ID NO: 94136 - protein, 35 aa, Zea mays
  misc_feature: Ceres CLONE 1583739
KAGAPRGGGRSRTSGSPGLQEFVSPLDTTLEELGF

SEQ ID NO: 94137 - DNA, 825 bp, Zea mays
  misc_feature: Ceres CLONE 1583740
  misc_feature: Encodes the peptide sequence at SEQ ID NO. 94138
  misc_feature (508)..(508): n is a, c, t, g, unknown, or other
ctggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggccctttcaggtcattcctgggcccggtgagaagccnatgatagttgttcagcacaaggggggaggaaaaacagtttggccgccgaaagaagatctcctccatgggtccccatcaagaagcgtggagaatccttaaaaccttccccttggcagccccaaataaaaaatggttgtttggacaaggggcccctggccttatttttaaagggatttttcaaaagggcggggccccccaaaaaggaaatctttgggggggagaatttttcggggcccccccaaagaggggggcggggggggttattccctccaccgaggggaggcccacaccccggcggggggtgtgggcgtttatta

SEQ ID NO: 94138 - protein, 137 aa, Zea mays
  misc_feature: Ceres CLONE 1583740
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFQVIPGPGEKPMIVVQHKGGGKTVWPPKEDLLHGSPSRSVENP

SEQ ID NO: 94139 - DNA, 1143 bp, Zea mays
  misc_feature: Ceres CLONE 1583741
  misc_feature: Encodes the peptide sequence at SEQ ID NO. 94140
  misc_feature (45)..(45): n is a, c, t, g, unknown, or other
  misc_feature (55)..(55): n is a, c, t, g, unknown, or other
  misc_feature (57)..(57): n is a, c, t, g, unknown, or other
  misc_feature (58)..(58): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (1143)..(1143): n is a, c, t, g, unknown, or other
ttttttggggttcctctctgagtgttcttcatggtgtgtgttggntttggggccncnnctcccccccaannnnnncaaagctggagctcaccgcggtggcggccgctctagaactagtggatcccccgggctgcaggaattcgtctcacccctagaaaaaatggcgacctcacatagccccatacgcctgtctcgaagccggagaatgaagagatagcctatcaacgaagcagcaatatggcacctggatcgatcatgccgccgggacgctctgtggcctccgtcctcctccatggcctcctctgcctgcagctggttgccttggccgagatccagatggagggcggcagctgcatgcatttcagtggtctccccgccggctgctccgcccgaggacgccgatgagcgtcgcaactatttccgcgccatggaggccaaggacctgttccggcaccagcagatgatcaagattatggggaaccgcactggcactgggcagctgcagccagcaagaggcggcaaggccaacggagtcatccaaactggccggagggtgatgtcccgccaacttccattgtttcaaagcatacccgttggtggaagcggcgccttccaacaatacgccgccaccatgggggaaaatgtaacccttgggagcgccaggggggggggcattttccgggatacagaccccggggcggcttgcacgcttatacaaaaaccaccggggtgaaggtggggggaaaaaccccacgccctaaaaccaaaaaccccctgtggaccgggttggggaatataccaaaacctgttttcccagggtcctatggctcaggagctctctctcccataagaggggggcacaaaggcgcaccataaggcgggggtggaggagaaacccgaagtgtttccggggggggggggttctcctcgggggggaacaaaaattatggtcacccctggcggggccccaaaaagggaatgggccctaatctaaagagaaaaaaaatattggtgataccccggggcacggagacccaaatatcacgtctcttcttctttgggggacacgaggaaaccccgtggggtcctccacaaataaaaggaagaggccgcggaccaattatttccacccaaaacaaagan

SEQ ID NO: 94140 - protein, 146 aa, Zea mays
  misc_feature: Ceres CLONE 1583741
MASSACSWLPWPRSRWRAAAACISVVSPPAAPPEDADERRNYFRAMEAKDLFRHQQMIKIMGNRTGTGQLQPARGGKANGVIQTGRRVMSRQLPLFQSIPVGGSGAFQQYAATMGENVTLGSARGGGIFRDTDPGAACTLIQKPPG

SEQ ID NO: 94141 - DNA, 850 bp, Zea mays
  misc_feature: Ceres CLONE 1583745
  misc_feature: Encodes the peptide sequence at SEQ ID NO. 94142
ctggagctccccgcggtggcggccgctctagaactagtggatcccccgggctgcaggaattcgtctcacccctagaaaagcctctcgccatttttactcgtcggctggtccggccccagcgattcggtttggtgcgcctcgtggtccacgtgcgcgggctttgtgctctctcttccctctgtgtgtgtgtgtgtcagttcatcgggtaggttggtggcggcgtgagagatgaagagctgcggcgggggaggagcggacaggcagcagtgcccgtgcgactactgcggggaggcggcggcggctctgcactgccgcgcggacgccgcgcgcctctgcgtcgcgtgcgaccgccacgtgcacgccgccaacgcgctgtcgcggaagcacgtgcgggcgccgctctgcgcggggtgcgccgcgcgcccggccgccgcgcgcgtctcccccaccccgtccccgggcggcgccgacccggcgttcctctgcgcggactgctgcgagggctgcgccgccgcttccgcggcacgcgtgccggtcgagggcttctcggggtgcccctctgcggacgaactcgccgcgtcatgggggctcgacctccaccgcggcggccggggccgtgggcgacgactgcgaacgcggcgaacaacgacaaccccttcctctcggggctccaatactccgagcttggggggtggggatggcccaaacggaacctgggcggaccttcctcgtggcgggggcggaaccaaacgccgggtgccccgccccccttaaaccggggggggcgcccggcttaagggggccaaggcgcctttaacaaacaactctcccggataaatgggcgcggcgc

SEQ ID NO: 94142 - protein, 181 aa, Zea mays
  misc_feature: Ceres CLONE 1583745
  misc_feature (11)..(58): Pfam Name: zf-B_box Pfam Description: B-box zinc finger
MKSCGGGGADRQQCPCDYCGEAAAALHCRADAARLCVACDRHVHAANALSRKHVRAPLCAGCAARPAAARVSPTPSPGGADPAFLCADCCEGCAAASAARVPVEGFSGCPSADELAASWGLDLHRGGRGRGRRLRTRRTTTTPSSRGSNTPSLGGGDGPNGTWADLPRGGGGTKRRVPRPP

SEQ ID NO: 94143 - DNA, 910 bp, Zea mays
  misc_feature: Ceres CLONE 1583748
  misc_feature: Encodes the peptide sequence at SEQ ID NO. 94144
  misc_feature (439)..(439): n is a, c, t, g, unknown, or other
  misc_feature (814)..(814): n is a, c, t, g, unknown, or other
  misc_feature (910)..(910): n is a, c, t, g, unknown, or other
ctggagctccccgcggtggcggccgctctagaactagtggatcccccgggctgcaggaattcgtctcacccctagaaaaaactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccacctcgccgccagccaccggggaagaccggcgggcggcaagatcaccgacgagtttcacgggcgccggcgccatcgggcaggtggtgccaggtgatcnggcgccgtcgtcgacgtgcggcttcaatgaagggccctcccgcccatcctcaggggggtttgagggggtttgaaaaagaacatccccctttttggtccaaggggggggccaacccccttgggcgaaaaaaagggggggcccccccttcccctttgggaccgggcccggaggggggggttttttttcgggggaaaaggggggtctctaaaaaaagggtgggccccccacaaacacccggtcccttgtttggcggggggtttcccccctggggggcgtttttttttatatggttttttccggggcgccccctttttttttaaaaaagggggggttttttattgggaaaaaaccctctttttcccccccaataaaaanggggggagaaacccctccttttttttttttttgaaaggggcccccctttaggaaaaaaaaaaattttttttttttttgagaaaaaaaaaggggtgn

SEQ ID NO: 94144 - protein, 114 aa, Zea mays
  misc_feature: Ceres CLONE 1583748
  misc_feature (91)..(91): Xaa is any aa, unknown, or other
MASRRVVSSLLRSASRLRAASPAAPRPRGAPHRPSPAGYLFNRAAAYASAAAAQAAPATSPPATGEDRRAARSPTSFTGAGAIGQVVPGDXAPSSTCGFNEGPSRPSSGGFEGV

SEQ ID NO: 94145 - DNA, 936 bp, Zea mays
  misc_feature: Ceres CLONE 1583751
  misc_feature: Encodes the peptide sequence at SEQ ID NO. 94146
  misc_feature (307)..(307): n is a, c, t, g, unknown, or other
  misc_feature (398)..(398): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (841)..(841): n is a, c, t, g, unknown, or other
  misc_feature (842)..(842): n is a, c, t, g, unknown, or other
  misc_feature (851)..(851): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (876)..(876): n is a, c, t, g, unknown, or other
  misc_feature (877)..(877): n is a, c, t, g, unknown, or other
  misc_feature (880)..(880): n is a, c, t, g, unknown, or other
  misc_feature (883)..(883): n is a, c, t, g, unknown, or other
  misc_feature (885)..(885): n is a, c, t, g, unknown, or other
  misc_feature (886)..(886): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (901)..(901): n is a, c, t, g, unknown, or other
  misc_feature (904)..(904): n is a, c, t, g, unknown, or other
aaagctggagctcaccgcggtggcggccgctctagaactagtggatcccccgggctgcaggaattcgtctcacccctagaaaaaacggcgcgctggcgcgggcggacgcgatccggggcgaggagtaccagcacctggaccgccacgtgtgcctggactacaccggcatcaacctcttctcgcacgcgcagatgagcgcctccctgccgtccacctcctccgcgccgcccgcctggcagccgcccttcttcgacatcgcgtacaagtccacgagcctgcgcgcgcagtgcaatgcggggacaacgcncgggcgcggaggcggcgtcggcgccccttcacccgggcatcatggggttcgctcaagatccccggggacaagtacgcctgggggtccaccncccaacaggaccggggggtttccccctccttgccaaagtcctaatcttttccagccccggggaaaaaaacttggctccccgggggtgccaacaccccaaaagagcggagggcccctgggggggccccctagggcccaaaaaaaaccccgccccccccccccggggggggcccccaaaaagggttttccctttcccgggagaaacttttttttctcttttgggggggcgggaaaagatggagagggagagtcttctcggggggggggcaaaaaacattctttccaaaaaaaagaaaatttgttccccaagggggggggggtgttcccccccgcggtttgggagggggggagaaaacccccccttttttttttttcccccccggggccgcagaaaaggggggccccggaccccccccctgggggaaggcgcccacccccnnnngnncaacctgancgnnnnnnnnntnnnnnnnnnaatnngtngangnngagtgatannnnganatntttgattatagaggaatgaggggagggggggg

SEQ ID NO: 94146 - protein, 243 aa, Zea mays
  misc_feature: Ceres CLONE 1583751
  misc_feature (39)..(39): Xaa is any aa, unknown, or other
  misc_feature (216)..(216): Xaa is any aa, unknown, or other
  misc_feature (217)..(217): Xaa is any aa, unknown, or other
  misc_feature (220)..(220): Xaa is any aa, unknown, or other
  misc_feature (222)..(222): Xaa is any aa, unknown, or other
  misc_feature (223)..(223): Xaa is any aa, unknown, or other
  misc_feature (224)..(224): Xaa is any aa, unknown, or other
  misc_feature (225)..(225): Xaa is any aa, unknown, or other
  misc_feature (226)..(226): Xaa is any aa, unknown, or other
  misc_feature (227)..(227): Xaa is any aa, unknown, or other
  misc_feature (229)..(229): Xaa is any aa, unknown, or other
  misc_feature (230)..(230): Xaa is any aa, unknown, or other
  misc_feature (231)..(231): Xaa is any aa, unknown, or other
  misc_feature (232)..(232): Xaa is any aa, unknown, or other
  misc_feature (235)..(235): Xaa is any aa, unknown, or other
  misc_feature (236)..(236): Xaa is any aa, unknown, or other
  misc_feature (237)..(237): Xaa is any aa, unknown, or other
  misc_feature (238)..(238): Xaa is any aa, unknown, or other
MSASLPSTSSAPPAWQPPFFDIAYKSTSLRAQCNAGTTXGRGGGVGAPSPGHHGVRSRSPGTSTPGGPPPNRTGGFPPPCQSPNLFQPRGKKLGSPGVPTPQKSGGPLGGPPRAQKKPRPPPPGGAPKKGFPFPGRNFFFSFGGAGKDGEGESSRGGGKKHSFQKKENLFPKGGGVFPPAVWEGGRKPPLFFFSPPGPQKRGAPDPPPGGRRPPPXXQPXRXXXXXXNXXXXSDXXXXLIIEE

SEQ ID NO: 94147 - DNA, 953 bp, Zea mays
  misc_feature: Ceres CLONE 1583755
  misc_feature: Encodes the peptide sequence at SEQ ID NO. 94148
  misc_feature (43)..(43): n is a, c, t, g, unknown, or other
ccgcggtggcggcgctctagactagtggatccccgggctgcangaattcgtctcacccctagaaaaaagttcaccgtccctccctgtccttgccatggccatccccaccgcccccgccctcctcttcccctccgttctccctaactcattcccccgccgggacacctgggggaacctggtgcaggggaaaccgagtaaacgccgcgcggggacgcccggcgaccgcaaggaccgggggccgggacccctccccaggggggggaggtgggcgggggaaaaggggagaaagcaaacccgaaaacataggtaaaatgagcgcggcgagggggaattgctgcctgccccccaggcggccccccaccaaaaaaagaaatggcagaggaaagaagcatagtggccaagggtgcccccccccgggggcgagaaagaaaaggagatgagctggagggcggtaggggggggagggtagaactgaagcgggagggggtatgagcaagtgacaagaacaagggaaggacagggagacgtgaatagcgcaaggggggggagaggtaagttgaattgatggtactgggggaggggtataccaaggctacgtcaactaaacaataatgggagcggtttaggggggggccgagggggggcgcacgggaggcaggcgggaggcgaaagggggcgagacacaaaagcgagatgtccaacgggggtcttagtttgaggatgggtgtatgtcttgctctagcggatggtatagctggtgggttccagcgtgtatgcggggcgtaggtggggtacaactgggcgccggcggggagaacggggggactgtggatgcctaggggccccgaagaagaaacaatccactggaggggggagatcaaaacgaccagggggggccgccctatatgtggggggcgaccgtatagatgcggcagcaaatgatgacagaaatt

SEQ ID NO: 94148 - protein, 71 aa, Zea mays
  misc_feature: Ceres CLONE 1583755
MAIPTAPALLFPSVLPNSFPRRDTWGNLVQGKPSKRRAGTPGDRKDRGPGPLPRGGRWAGEKGRKQTRKHR

SEQ ID NO: 94149 - DNA, 823 bp, Zea mays
  misc_feature: Ceres CLONE 1583757
  misc_feature: Encodes the peptide sequence at SEQ ID NO. 94150
  misc_feature (610)..(610): n is a, c, t, g, unknown, or other
  misc_feature (687)..(687): n is a, c, t, g, unknown, or other
  misc_feature (688)..(688): n is a, c, t, g, unknown, or other
  misc_feature (710)..(710): n is a, c, t, g, unknown, or other
  misc_feature (712)..(712): n is a, c, t, g, unknown, or other
ctccccgcggtggcggccgctctagaactagtggatcccccgggctgcaggaattcgtctcacccctagaaaaactggtgaagctggacatccggcaggagtcggagcggcacaccgacgtgatcgacgccatcaccacgcacctcggcatcgggtcgtaccgcgagtggtccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtagagctcctgcagcgcgagtgcggcgtgcgccagccgctgcccgtggtgccgctgttcgagaggctggccgacctgcagtcggcgcccgcgtccgtggagcgcctcttctcggtggactggtacatggaccggatcaagggcaagcagcaggtcatggtcggctactccgactccggcaaggacgccggccgcctgtccgcggcgtggcagctgtacagggcgcaagaagagatggcgcaggtggncaagcgctacggcgtcaagctcacctttgttcacgggcgcggaaggcacgtggggcagggggtggcgggcccacgcnnaccttgcatctgtcccagccgncnggacaccatcacggggtcattccgtgttgacgtgcagggcgagagtcatcaagttctggcttcgggaaagaagaactggtgcttcacgaccttgcaaggctttcagggcct

SEQ ID NO: 94150 - protein, 273 aa, Zea mays
  misc_feature: Ceres CLONE 1583757
  misc_feature: SWISSPROT Homolog: EC 4.1.1.31 Phosphoenolpyruvate carboxylase
  misc_feature (203)..(203): Xaa is any aa, unknown, or other
  misc_feature (229)..(229): Xaa is any aa, unknown, or other
  misc_feature (237)..(237): Xaa is any aa, unknown, or other
PRGGGRSRTSGSPGLQEFVSPLEKLVKLDIRQESERHTDVIDAITTHLGIGSYREWSEDKRQEWLLSELRGKRPLLPPDLPQTDEIADVIGAFHVLAELPPDSFGPYIISMATAPSDVLAVELLQRECGVRQPLPVVPLFERLADLQSAPASVERLFSVDWYMDRIKGKQQVMVGYSDSGKDAGRLSAAWQLYRAQEEMAQVXKRYGVKLTFVHGRGRHVGQGVAGPRXPCICPSRXDTITGSFRVDVQGESHQVLASGKKNWCFTTLQGFQG

SEQ ID NO: 94151 - DNA, 870 bp, Zea mays
  misc_feature: Ceres CLONE 1583762
  misc_feature: Encodes the peptide sequence at SEQ ID NO. 94152
  misc_feature (826)..(826): n is a, c, t, g, unknown, or other
aaagctggagctccccgcggtggcggccgctctagaactagtggatcccccgggctgcaggaattcgtctcacccctagaaaaagaattgaattgagatttgggaaggaataaaaatatcttgttgtcccgctcgctccccctcgatttgtttgtttgtgtttatttatacagcccagctcatcgaaatgtcacattttggatactgctatagcaaggggtaggagttgtaaaagtaatgggacaaaaaaaaaacgaattcattcgcctccctgccctccatatgcagtcgtcgtcgtatctttggaataagtaaatagcagccccggaggcgactgactgactggcgcaactgtgttgctcgatccatcgaagcagacgcaggcggcggattcgcggaggagagatgatgagggagcagagcctcctggaggcgacgtgcggcgacctcttcgaccacatcgacgacctgctcgacttccccaaggaggactcggccgccgacgtgctcctgctggacgcgccggcgccggggagcccgctgtcgtcggcgcgcatcatcgacgtcggccgcgccggcagtgcgcccgctccccccgcgctggcgccgtcgcttcccgcgcagcaagacacaccgccttttcttcgcaccgcggggcccgacgtgttcgaccccagggacgtcggcgctcaccttggctcgtgcgacgacattgacatggacatgccgcactgggagtggctggtcgggctcttcgaagaagcattcatccggaacgagccgggttccccggggccgggcccatcattaaaagctcccccctggngggcggggcccttttccccccggaaaaaatgggggaaccccctt

SEQ ID NO: 94152 - protein, 155 aa, Zea mays
  misc_feature: Ceres CLONE 1583762
  misc_feature (141)..(141): Xaa is any aa, unknown, or other
MMREQSLLEATCGDLFDHIDDLLDFPKEDSAADVLLLDAPAPGSPLSSARIIDVGRAGSAPAPPALAPSLPAQQDTPPFLRTAGPDVFDPRDVGAHLGSCDDIDMDMPHWEWLVGLFEEAFIRNEPGSPGPGPSLKAPPWXAGPFSPRKKWGNPL

SEQ ID NO: 94153 - DNA, 929 bp, Zea mays
  misc_feature: Ceres CLONE 1583766
aaagctggagctcaccgcggtggcggccgctctagaactagtggatcccccgggctgcaggaattcgtctcacccctagaaaaagctctctcgcgcgcatctcccgtgcccctcactgtttagtggcgacgactgggcgacagtcgccgccgccgcccgctaggggccgtgcccctggtctccatcttcgggcgcttcgcccaccagatatgagcagctggcaattcgattttgaggccattatttgataacccgggacaagtgcactgttacctgaccattttagcttgttcagatggctacacagttgccatgcttcacacagctcagtccaccgtcttgtagttggataaaagatgtcgggaactgcaaggctacgcctgatagggtagccagaactgcccgagctttgggccactgtcacttccggtgctgtgcaggcccccgtagtgcaaactctttcaagaagaaagactcttgcgagaagaaagactcttttcttcgaacttcctccggaggtatctctgctccgtggcgagaaaaatggccaaggttgtgtcaatgaaaaggttccttctggaggggggttctgttagagggaattgggggtgcccgcccgaaccaaaatgatttccagtgaggcctaagaatccagggaagttagaatttgggaaggccggggcttccaaatgctggtccaatcggggaggagtggaaacgttcctttaaaggggcggtgtaggttttgggaccgtggaaacaccgaagggacagggcccaataagaaggggtttcctggtggctcccccctcacataaagccggcaaaaattggaaccgggagtttgaatcccgaggtccttggggtcctgtgggggaaacaaccccctgtattattgggggttgaattgttcccccataagagacaat

SEQ ID NO: 94154 - DNA, 898 bp, Zea mays
  misc_feature: Ceres CLONE 1583767
  misc_feature: Encodes the peptide sequence at SEQ ID NO. 94155
ctggagctccccgcggtggcggccgctctagaactagtggatcccccgggctgcaggaattcgtctcacccctagaaaaaacctcctccaacgacaacctccacctcgtcttcccctcctccgcgctcccgtcatctacaactctcgctcccacccacgagtcccaccggccaccgccaccaccaccagtctatcccctcgccatttgtttcctccccgtgcatgaaaccctaaaccaaaaccccacctccatccctgagccatcccctccagcgcggcgatggcaaaggcgctactttcctcctccctcctccccgcgctgcccggcgctgccggaggcagccggagcgctgcgaggccgatgctgctcccaccgctcaggttgcggcgcggccggcgcgccgcctcctcttgcaaggtgagggcgggcctgcacgggctcgactccgtcagcgggccccaccttcaagccgcactggagcgcgccgaagcggctctatacacactcgctgacaccccgggcgacgcccgcgggggcggggggccgacccaagccagggttgcggggggtccaaaagaacaagcaggctggttcggatttcattctccaaagggcccttggaggtccgggcctcaaaggggcccaaagggaagggtttttttgggaattccaggggggccataactccctaggggttttggccctaaatttcggcccaaacaaaaccatttgttaaaagggggtggaaacttttgccctcttaaccaaaaaaaaaaaaggggggaaaaacaaaacttccggggcaaattgtccaaaaattaaaacaggccggcccacaatataagggagaaaccctccccccgaaaaaatacccgccgggggaaaacaaagggaaaa

SEQ ID NO: 94155 - protein, 134 aa, Zea mays
  misc_feature: Ceres CLONE 1583767
MAKALLSSSLLPALPGAAGGSRSAARPMLLPPLRLRRGRRAASSCKVRAGLHGLDSVSGPHLQAALERAEAALYTLADTPGDARGGGGPTQARVAGGPKEQAGWFGFHSPKGPWRSGPQRGPKGRVFLGIPGGP

SEQ ID NO: 94156 - DNA, 906 bp, Zea mays
  misc_feature: Ceres CLONE 1583770
  misc_feature: Encodes the peptide sequence at SEQ ID NO. 94157
tggagctccccgcggtggcggccgctctagaactagtggatcccccgggctgcaggaattcgtctcacccctagaaaaactctccgaggtccgagcggggtaggcaggtgtccgaaacggatcaccaaaccccgccggcgcagccgagagatccgacgtcgccgcgatccatggccgcctcgacggcggcggcgcggcgtctcctcctcgccctcgccgtcctcgccgcctgccacggctcggcgccgcacggggccgtcgcgctccgctcgctcggcgtcgggggcgccaaggcggccgacggggacgcggccgtggacctcgacgcgtccaacttcaccgccttcctccagacttcgccggagtcgttcgccgttcgtcgaagtcttcgcccactgggtggcccggcctgcaaaaaactacaggcctcccttaggaaaggggttgcaaaaccttttccaggggccccaaatgcctggccactccccggggacctgttgtgtaggggccccattttttttttggtccctacaagggggaaaagggggggtttttttttgaaaaaaaattttctttgtgtggcccccttattcccctctcccccggggggggggggggcccccccccccacaaaaataataaatttttggcggcccgcggggggaacccccacacccggggaagaaaaatgggggttttttggggaacccttttgttgtggggggggggaaaaaaaccccccaccgttggttgttctgggagaggggggaaaaaaaaaaaggaaggggggggggggccccctttctctcttctttttcggccccacaaaccaaaaatttttttaaaaaaaaaagaataattgtcccccccccccacaaaaaatattattctttttgttttctttta

SEQ ID NO: 94157 - protein, 29 aa, Zea mays
  misc_feature: Ceres CLONE 1583770
MPGHSPGTCCVGAPFFFWSLQGGKGGVFF

SEQ ID NO: 94158 - DNA, 608 bp, Zea mays
  misc_feature: Ceres CLONE 1583773
  misc_feature: Encodes the peptide sequence at SEQ ID NO. 94159
  misc_feature (89)..(89): n is a, c, t, g, unknown, or other
  misc_feature (289)..(289): n is a, c, t, g, unknown, or other
ctggagctccaccgcggtggcggccgctctagaactagtggatcccccgggctgcaggaattcgtctcacccctagaaaaaattcactnactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcatagcagtaagcgaaggtttaaccttagctttacgccacgatctgncagagtaggcaatcaaaaatggagtcccaatggttgaagcccttcgggaatcccctcgaaggggactgggtccccctccgaacttcatctttgggggcccccactttcagcggtcccaaattgaaaggggctttggaacccaaaaaatgggaaagggggggaaaaacccaattgggggaataaccttttttggccccaaaattttttcccggaaaaaggaaaaattggggccgggggggaccaattgcacaaaattttttggagggggaaaattttctccccccccattttgtccccaaaaaaagggggggatgtggtt

SEQ ID NO: 94159 - protein, 64 aa, Zea mays
  misc_feature: Ceres CLONE 1583773
  misc_feature (53)..(53): Xaa is any aa, unknown, or other
MAPLLAAAMNHAAHPVLRSHLGPNNESFSRHHLSSSPHSSKRRFNLSFTPRSXRVGNQKWSPNG

SEQ ID NO: 94160 - DNA, 815 bp, Zea mays
  misc_feature: Ceres CLONE 1583776
  misc_feature: Encodes the peptide sequence at SEQ ID NO. 94161
ctggagctccccgcggtggcggccgctctagaactagtggatcccccgggctgcaggaattcgtctcacccctagaaaaaattcactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccttcggaaatccctcgaagggactggttcccctccgacttcatctttggtgccgccacttcagcgtaccaaattgaaggtgcttggaacgaagatggaaagggggaaagcaattgggatcacttctgccacaattttccggaaaggataatggacgggagcaatgcagacattggagcgaattcgtaccatatgtacaaaacggatgtcagattgctgaaggaaatgggcatggacgcatataggttctctatctcttggcctagaatactgcctaagggaacggtcgaaggaggtattaaccaggatggcatcgattactacaaaaggctcatcaacttgttgctagagaatggcatagagccatatgtaacaattttccactggggatgtccctcaagcactagaagagaagtacggcggaatcttagataagactcataagaggattgtaaatgattacaaaaacttcgcctaaagggggcttcgat

SEQ ID NO: 94161 - protein, 201 aa, Zea mays
  misc_feature: Ceres CLONE 1583776
  misc_feature (63)..(200): Pfam Name: Glyco_hydro_1 Pfam Description: Glycosyl hydrolase family 1
  misc_feature: SWISSPROT Homolog: EC 3.2.1.21 Beta-glucosidase
MNHAAHPVLRSHLGPNNESFSRHHLSSSPQSSKRRFNLSFTPRSARVGNQNGVQLLSPSEIPRRDWFPSDFIFGAATSAYQIEGAWNEDGKGESNWDHFCHNFPERIMDGSNADIGANSYHMYKTDVRLLKEMGMDAYRFSISWPRILPKGTVEGGINQDGIDYYKRLINLLLENGIEPYVTIFHWGCPSSTRREVRRNLR

SEQ ID NO: 94162 - DNA, 1196 bp, Zea mays
  misc_feature: Ceres CLONE 1583777
  misc_feature: Translation starting site: 207
  misc_feature: SWISSPROT Homolog: EC 5.3.4.1 Protein disulfide-isomerase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (23)..(23): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (42)..(42): n is a, c, t, g, unknown, or other
  misc_feature (44)..(44): n is a, c, t, g, unknown, or other
  misc_feature (47)..(47): n is a, c, t, g, unknown, or other
  misc_feature (48)..(48): n is a, c, t, g, unknown, or other
  misc_feature (595)..(595): n is a, c, t, g, unknown, or other
  misc_feature (845)..(845): n is a, c, t, g, unknown, or other
  misc_feature (954)..(954): n is a, c, t, g, unknown, or other
  misc_feature (999)..(999): n is a, c, t, g, unknown, or other
  misc_feature (1012)..(1012): n is a, c, t, g, unknown, or other
  misc_feature (1055)..(1055): n is a, c, t, g, unknown, or other
  misc_feature (1057)..(1057): n is a, c, t, g, unknown, or other
  misc_feature (1090)..(1090): n is a, c, t, g, unknown, or other
  misc_feature (1161)..(1161): n is a, c, t, g, unknown, or other
  misc_feature (1184)..(1184): n is a, c, t, g, unknown, or other
  misc_feature (1196)..(1196): n is a, c, t, g, unknown, or other
nnnnnaaaaaaaattaaaattanaataannnaaagatagggnancannaacagtgggcgaccactaagcgctcgatgccccccacacaatagacgccgctctagaataatggatcccccgggctgcaggaattcgtctcacccctagaaaaagtgtctcacccctccggacgaaatctgacccgggccacactccgatgctccgccatggcaatccgctccaaggcctggatctcgctgttgctcgcgctggccgtctcgctctccgcccgggcggaggaggagcccgccgccgcggcggagggcgaggccgtgctcaccctcgacgtcgacagcttcgacgacgccgtcgccaagcaccccttcatggtcgtcgagttctacgccccctggtgtgggcactgcaagaaactttgctccagagtatgagaatgcggccaatgcacttagcaagcatgacccaccgattgttctcgctaacgttgatgctaacgaggagaagaaccaggccgcttgctcccaagtacgagaatccaagggttcccaaccatcaagatctttcggggacccagggggaagaaccattcaggtaattncaagggggccccctaggggaagccttgattggcatttgcgtccaattactttgaaaggaaaacaagggttgggccccttgccgttcccaaaggaaaataccaaactcccaccccccggaacaaatagcccggggtgggccccccttttttttcgccatttgacacaaaagggaaaaaaaaacccttcccccttttttggtgtgttgggagatatatcctctttctgccacaaaaaaaaaattttccaggnacagggagcgaccccctcagaaaaatgttttcacccagtatatttcttttctctctggtgggagggagggccctcgaccgcacaaataaaaaaacagcttttctagggnttctctctctggaaaaccattcaacccagcccacttttactttantgtgagcacccgncacacaaccacacagtcactcgattcacaaagacctcggatananatatacacgaacattcaaattcacgacctcctncctttcttacgcgacaggacgacccataccacacacacagtgacacgcacgccttccaccgaccacaacanctccgagacactacaaccactanatgtactgatcn

SEQ ID NO: 94163 - DNA, 1195 bp, Zea mays
  misc_feature: Ceres CLONE 1583779
  misc_feature: Encodes the peptide sequence at SEQ ID NO. 94164
  misc_feature (15)..(15): n is a, c, t, g, unknown, or other
  misc_feature (19)..(19): n is a, c, t, g, unknown, or other
  misc_feature (62)..(62): n is a, c, t, g, unknown, or other
  misc_feature (63)..(63): n is a, c, t, g, unknown, or other
ggggggggggtgttntttnttttgtgtttgtgagggagggtgtggggaggggaggagaatannaaatcggttctgaaaaaagagctgggactccccgcggtggcggccgctctagaactagtggatcccccgggctgctggaattcgtctcacccctagaaaaagtctccccccgccacgacccctcagccctcacacaagagacgcagctgcgagtccgccagccttatcctcctccccgtctccggctccaacccgcaagcgcggtatggcttcgacattcggtgccacttctactgtcagccttatggctgctccaacaaggaagaatgtgcgccttcagaggagggtgaacttcacagtaagagcagctaaggagctgtacttcaacaaggatggctcagctatcaagaagctccagactggagtcaataagcttgcagacctactcggagttacactcgggacaaaagggaaggaatgttgttttgagagagcaagaatgggtccccctaaaatttggtaacgatgggggttaacagttgcccaaaaaaggtttgaacttgggaggaacccctcgtggcagaaaacattgggtggcctaaaattgggggccaggggcaaggcaagccagccttaaaaaaacccaattgaatccttaagccttgggagaggatgggggaaccaaaccccaccccttccttgggggggggttcccttgggcctcccacggggggggcttgtaaaattccggctcttaaaaggggggtgtgttttttaaaagggatcttttgtgtggggccacaacacctcgggggagtgggcccctgaaaaaccccccgggggttttggaagaaaaattttacaccctccctccgggggggaatatctcggcagaataaaaataccaaggcccgaaaaaagacacacctacattttttggataagaaaaaacctacacggcgaaaacttggtggtcccaaagggggggggggccccaagaaaataaatgggggagacctttggcccaaaatgtgtgggccgcgcccctgctttgagaggcgccggggccaaccaccccccccaagaaaatttgggttaaatttgttataaagccaaaagcgcccctttaggccaaggggttgggtctccgcaaaaggggggtgggtgtaccccctccaaaaaaaggggggag

SEQ ID NO: 94164 - protein, 85 aa, Zea mays
  misc_feature: Ceres CLONE 1583779
MASTFGATSTVSLMAAPTRKNVRLQRRVNFTVRAAKELYFNKDGSAIKKLQTGVNKLADLLGVTLGTKGKECCFERARMGPPKIW

SEQ ID NO: 94165 - DNA, 893 bp, Zea mays
  misc_feature: Ceres CLONE 1583780
  misc_feature: Encodes the peptide sequence at SEQ ID NO. 94166
  misc_feature (402)..(402): n is a, c, t, g, unknown, or other
caaagctggagctccccgcggtggcggccgctctagaactagtggatcccccgggctgcaggaattcgtctcacccctagaaaaatcgtctccgttcatggtgctggtggccgtcgaccggcaactccggcgcgggggcctctaatggcgcagtacaggcagcagtacggcgtcggcttttccgactcccgcggccaccatcaccaggtgctcccggactggcaccggccccaccacgcctccgccaagtcctcctcacggatccgccgccccgggaagcctgcgccgcgccgccgctcgccggctgctgctgccgccgtcgccgccgctctactcctcgccgccgtcttcctcctttcgcgccgcatctcgcgcagccccgcagagatcagccaaaattcnagcgctagggagacgttgccggactggaaccagagcaagagctggaaggagctcaagttcgggcacggcggaggtggccgcagcgcgcgggactccaggtactgggaccgggacgataggcgccgcgacgaggactacacagaggacgaaaaggagaagatctcgggtggaagtgggacctccggcgatgctggcggcagcagcgataaaggtaccacctctgagggaggtgggggaggataaagggttgactaccggcagcgatgctaaggatgttccagaagtgtctgtaggtggggaaggtgggaccttgtacaatgagggtggcaggaagggagctggagcagtacgaagcttgcgccatgggagccaccaggaacgggggtgaaggaggtttgatcccaataatgtatattacgatggccttcatacccaggaagagaaagggaggaagctcacctggcattcattcggagggggaaaaaggaaat

SEQ ID NO: 94166 - protein, 166 aa, Zea mays
  misc_feature: Ceres CLONE 1583780
MAQYRQQYGVGFSDSRGHHHQVLPDWHRPHHASAKSSSRIRRPGKPAPRRRSPAAAAAVAAALLLAAVFLLSRRISRSPAEISQNSSARETLPDWNQSKSWKELKFGHGGGGRSARDSRYWDRDDRRRDEDYTEDEKEKISGGSGTSGDAGGSSDKGTTSEGGGGG

SEQ ID NO: 94167 - DNA, 1300 bp, Zea mays
  misc_feature: Ceres CLONE 1583782
  misc_feature: Encodes the peptide sequence at SEQ ID NO. 94168
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (73)..(73): n is a, c, t, g, unknown, or other
  misc_feature (838)..(838): n is a, c, t, g, unknown, or other
  misc_feature (1068)..(1068): n is a, c, t, g, unknown, or other
  misc_feature (1132)..(1132): n is a, c, t, g, unknown, or other
acatttgtgccacaatatcgggggggtcacactcaaccaccccctcattacatctttcaccaaacnnnncccncccaaagctggactcccctcggtggcggccgctctagaatagtggatcccccgggctgcaggaattcgtctcacccctagaaaaaagcttctctcatcttgagaaagagctcctcgtcctcgctccctccccaaccatcaagagcgcacacgcacacgcacacgcacagcgcaagccggtctacgtacggcatggacaagagcgctacaactggccgcggcggttcaagccgccccggaaaggcggcggaggagcccaaggtatctctgctaccgccgaaggttgccgtcggcggccgctgcccaggaggaccatggcaggaagaggatgataccaacgtcaatgctgggttcggctgctgccatataatgaacgccgggtacccctccttgtcagtcacccccacctcgtgtatgtctcgatttggaaggaaaaccacacaggtattgggtttgtggggccgaggcggtgcaatttttaattccggcttcccgtctcccaggcgggcgttcccccggtgtattggaaagagggacctttcctgggggccccccctatgcgggaggaacgacccacaaccttcattagggggcgtataaacctattatggaatccctaaaccggggttccacacatatataggtgcccagagaaaaccggggtgaaatcctttcctctgggaggagaaaattcgggataaggcgtcagcaccttatgtggaataatagaccctgcgttgcctggcgggttctcttgtcatctgtnccaaaagaggtgcggtcgaaggataagggccattttactcccctcgtctgctactctctgggagttccctttctaatacctccctctcctgctgcggggagagtatctctggaggcacgtaatattattatagtgtgtcacctctgtgtcgtgggatcacatatgcagcgtagtggtgagatcattccccgccactcatagtcagccgttttgtgttcttaaggaagagntacgccactgctctgtgttgtaatggcgcgccctctcggagcgcgtgatcggaaccgcacactnagtgatcttctttatggtgatgctggtggggggtgtagacatatgttaatagtgcattctctgagttatagatggctgtctcggatgatggggcgcctctcctctctcgtggttgggtagtggggggcgcctatgcgtcgcgtaggtagaatgccgccgcgcccgtgg

SEQ ID NO: 94168 - protein, 135 aa, Zea mays
  misc_feature: Ceres CLONE 1583782
MDKSATTGRGGSSRPGKAAEEPKVSLLPPKVAVGGRCPGGPWQEEDDTNVNAGFGCCHIMNAGYPSLSVTPTSCMSRFGRKTTQVLGLWGRGGAIFNSGFPSPRRAFPRCIGKRDLSWGPPLCGRNDPQPSLGGV

SEQ ID NO: 94169 - DNA, 930 bp, Zea mays
  misc_feature: Ceres CLONE 1583783
  misc_feature: Encodes the peptide sequence at SEQ ID NO. 94170
aaagctggagctccccgcggtggcggccgctctagaactagtggatcccccgggctgcaggaattcgtctcacccccccctagaaaaaaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaataacgactgagcggcggcggtggcagccagcgaccccgacaagctcttgagcctgctgccgtcgcccgcccatgaagctccccatcatcgggcacctgcaactgaatggggggaaatcccctaggtggtccctcggccgggctcggccacccaggtaccgccccggaccctgatgctggctccggccttcggcgccgtgccccaaccgtgggtgggtctccgtcgcccgcgcggtcaccgaaggccgtggctccgcgaccctaagaaccaacgtctttcttcctcccggccccgagggtttcgctgggggttccccaaaatccattatggtaaagggggccccacccgaactcgggggctttgcccggcccctaaaggcggaaacaaccttctcgcaaaggccgacggaaaagcttggtcccacccgggccaacctgggctcaaagggcccagaaaaaggtggccgggtccgcaaaccgggcccgacgagggtaggagagacagaagagagaggg

SEQ ID NO: 94170 - protein, 63 aa, Zea mays
  misc_feature: Ceres CLONE 1583783
MVKGAPPELGGFARPLKAETTFSQRPTEKLGPTRANLGSKGPEKGGRVRKPGPTRVGETEERG

SEQ ID NO: 94171 - DNA, 803 bp, Zea mays
  misc_feature: Ceres CLONE 1583786
  misc_feature: Encodes the peptide sequence at SEQ ID NO. 94172
  misc_feature (803)..(803): n is a, c, t, g, unknown, or other
ctggagctcaccgcggtggcggccgctctagaactagtggatcccccgggctgcaggaattcgtctcacccctagaaaaagtttaagcttagcatgcgaaactatatcctgtctttatcgaaacaattcattactgattacatctcatcgcctgaagtgaacttcctcaccagtatatctggaagagttagcaagaagacaaagcttgtgttccgctttcttgacgaaggctctattgagccatcgacaaaccagacatatgggtccatgttgaaaaatctaacatttgtcaagacttttgcctctggaatacttgttcccaaaagctatatctggcctgttacaccagataattacctactgccttatacatcagttgttgatgatgctcacaaagcgcggctagaaatctatgctgctgattttgcaaatgactttactatcagctataactacagctttgatccattagcggaatatctttccttcattggtaacagtgccttctctgtcgatggtgtgttgactgatttcccgattactccttcagaggcagttggttgctttagtaacctgaacaacagcaagatcgaccatgctaaacctctggttatctctcataatggtgctagcggtgactacccagactgcaccgaccaagcttatgaaaaggcagttgctgatggtgcagatgtcattgactgtcctgttcaagtgaccaaagatggcatactgatatgcatgaagtctgttgacctaaagggatgtcactactggtgggaaaatcatccatttacttcgcn

SEQ ID NO: 94172 - protein, 236 aa, Zea mays
  misc_feature: Ceres CLONE 1583786
  misc_feature: SWISSPROT Homolog: EC 3.1.4.46 Glycerophosphodiester phosphodiesterase
MRNYILSLSKQFITDYISSPEVNFLTSISGRVSKKTKLVFRFLDEGSIEPSTNQTYGSMLKNLTFVKTFASGILVPKSYIWPVTPDNYLLPYTSVVDDAHKARLEIYAADFANDFTISYNYSFDPLAEYLSFIGNSAFSVDGVLTDFPITPSEAVGCFSNLNNSKIDHAKPLVISHNGASGDYPDCTDQAYEKAVADGADVIDCPVQVTKDGILICMKSVDLKGCHYWWENHPFTS

SEQ ID NO: 94173 - DNA, 775 bp, Zea mays
  misc_feature: Ceres CLONE 1583787
  misc_feature: Encodes the peptide sequence at SEQ ID NO. 94174
  misc_feature (775)..(775): n is a, c, t, g, unknown, or other
ctggagctccccgcggtggcggccgctctagaactagtggatcccccgggctgcaggaattcgtctcacccctagaaaaatcgcctccccccactccttccctccctccctcgctcacccagtggggcagccaaagccgagccgcaaccgcaaagatcttgcgcggcctcctttccccagctcgtcactgtgccgctcgtgccatccaccctcggttcacccaaccaacaatccatccgccaccacaccccgctgcggcgatgtgcggcggcgccatcctctcgggtttcatcccgccgtccggggtgccggcggcggcagcggcggccaagaagaaacagcagcggcgtgcgacggcggacctgctgtggccggggcccggcaagaagggagcgccccgggaggaggacttcgaggccgacttccgcgagttcgagcgcggcctcggagaggatgacgacgtggacggggccggcgacgaggtccaggagcttcctctgccggagccggcgaggctcgccttcgccgccgcggttggggcgccgcgcactgcagttggtgagcaccgagccatggtttttttttttatcttctattcttttggttagaccttagccatggaatgggcaaggctgttcagagtgggagctgatggcgctgccttggtattttgtatgcaacccgatagctttcgtattccaaatgtttcgttgagatgcacgcacacgcactgacagacagtccttattctattctagacggcgtgatgactccn

SEQ ID NO: 94174 - protein, 115 aa, Zea mays
  misc_feature: Ceres CLONE 1583787
MCGGAILSGFIPPSGVPAAAAAAKKKQQRRATADLLWPGPGKKGAPREEDFEADFREFERGLGEDDDVDGAGDEVQELPLPEPARLAFAAAVGAPRTAVGEHRAMVFFFIFYSFG

SEQ ID NO: 94175 - DNA, 858 bp, Zea mays
  misc_feature: Ceres CLONE 1583790
  misc_feature: Encodes the peptide sequence at SEQ ID NO. 94176
ctggagctcaccgcggtggcggccgctctagaactagtggatcccccgggctgcaggaattcgtctcacccctagaaaaaactatgacccctgctgcctttccaccttcctcgatctccctagctcgctctccaatctcccatttctctctctctctctctctctctctctctctcgtcttcgccatccaccatccatcccgttcgtcgtgatagatggcggcagtccagccgtccgtggagatgacgacgcagcaagggccgccagccgccagctattctccggccagggatggcggcggcggcaggagcgccgaggatgaggagaaggagaaggcggcggcgatcgacaactggcttcctgtcagcgcgacgcggaatgccaagtggtggtactccgccttccacaacgtcacggccatggtcggcgccggcgtgctcggcctcccctacgccatgtcccagctcggctggggtgccggcatcacgatcatgctcctgtcgtgggtgatcacgctgtacacgctgtggcagatggtggagatgcacgagatggtgccgggagaagcggttcgaccggtaccacgagctggggcagcacgcgttcggggaccggctgggccctgtggatcggggtgccgcagcagctgggggggaaaggtggggggggtaaaacatcggggaacatgggggaaccgggggccacgtcccctgcaaaaagttccccgaacggtgactgtgtgtgccgaccaacgccagccagtggcaaagggtcagggcctcaaaagaataagggctcaacccctacgatcacaaccgaggaatgcgggcggacggtggcgggacacaaaattagaaa

SEQ ID NO: 94176 - protein, 214 aa, Zea mays
  misc_feature: Ceres CLONE 1583790
MAAVQPSVEMTTQQGPPAASYSPARDGGGGRSAEDEEKEKAAAIDNWLPVSATRNAKWWYSAFHNVTAMVGAGVLGLPYAMSQLGWGAGITIMLLSWVITLYTLWQMVEMHEMVPGEAVRPVPRAGAARVRGPAGPCGSGCRSSWGGKVGGVKHRGTWGNRGPRPLQKVPRTVTVCADQRQPVAKGQGLKRIRAQPLRSQPRNAGGRWRDTKLE

SEQ ID NO: 94177 - DNA, 805 bp, Zea mays
  misc_feature: Ceres CLONE 1583792
  misc_feature: Translation starting site: 213
  misc_feature: SWISSPROT Homolog: EC 6.1.1.6 Lysine--tRNA ligase
ctccccgcggtggcggccgctctagaactagtggatcccccgggctgcaggaattcgtctcacccctagaaaaactctttccattcctccgcgccgccactagctgtcctaaaccctaccatcacttgagcctccaccttctccgcgtctcaccttcttctccgttctccttccgctcccctcttcacaacgaagccctagtgtcccgcgacatggcatctggtctggaggagaaactcgcggggctctcaacgggcggcgacgggcaaaatcctccgccggcgggtgagggcggagaggagccgcagctctcgaagaatgcgaagaagagagaggagaagaggaagaagctgggagaggagcggaggctcaaggaggaagagaagaagaacaaggctgcggctgccagtggaaaacctcagaaggcatctgctgctgacgatgatgacatggatcccactcaatactatgagaataggctcaaggctcttgattcactgaaggccacaggtgtaaacccctatccccataagttcccggttggcatttctgtacccgaatacattgagaagtacaggaccttgagcgagggggagaaacttacagatgtggcagagtgtttagctgggaggatcatgaacaagagaacatcggtcgtcgaagctattcttttatgatctttatggtgggtggcatgaaagttcaagtgatggctgatgccaggaccctcggagttggatgaagctgaattttctagtaccactcaggtgtgaagcgaggtgatattgttgccatatgtggatat

SEQ ID NO: 94178 - DNA, 854 bp, Zea mays
  misc_feature: Ceres CLONE 1583793
  misc_feature: Encodes the peptide sequence at SEQ ID NO. 94179
  misc_feature (854)..(854): n is a, c, t, g, unknown, or other
gcggtggcggccgctctagaactagtggatcccccgggctgcaggaattcgtctcacccctagaaaaaacacgttccacacgctggacacttgttgtagtcgctgtcacgctcttgcctcgctccttcccggctacattacataacggatcggagtgtgatgatccatcgatggagctgtgagctgagctgagcttaccaccaccacacacgggagatagctatagctagcatagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcccgcccaccttccccttcttcgtgggcgtggacccgcgcgtggtcgccatcgtggacgccgccgccttcaccgcgctcttcgacccggaactcgtggacaagcgcgacatcctcatcgggccctacaacccggggcgccggcttcaccggcggggacgcgcggtcggcgtggtacctcaacacgcagggaggaagaagcacgccgcgccgtcaagacctttcgcccatgggaacttccttcaaccggttccgcccgggaacatgggtccgccaaaattttccgggcggaagcgttcgggcggccattgtcttggaaccccccggggaacacccgaaaattccggccaaaggagacaacacgccacgcgaacaagaaaagcccctcn

SEQ ID NO: 94179 - protein, 195 aa, Zea mays
  misc_feature: Ceres CLONE 1583793
  misc_feature: SWISSPROT Homolog: EC 4.2.1.92 Hydroperoxide dehydratase
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPELVDKRDILIGPYNPGRRLHRRGRAVGVVPQHAGRKKHAAPSRPFAHGNFLQPVPPGNMGPPKFSGRKRSGGHCLGTPRGTPENSGQRRQHATRTRKAP

SEQ ID NO: 94180 - DNA, 810 bp, Zea mays
  misc_feature: Ceres CLONE 1583795
ctccccgcggtggcggccgctctagaactaggggatccccctggctgacaagaattcgtgctcatccctagaaaaaagtacgattcttctcatggatacgtgcacccagccctccgcctcctaatcatagaccggctcctcctctgttccagctcaagaatcctcgttcaccttctccattcctcacgacgtttctcttatctactacgacaacgggaccaccttcgcactccggtgttgagcctgcatcctgagcctctgaacccggagacgtcttcctattcaacaagggggagaagcacgacatcttctcttgctactacatgttcccggacgcaatcgatgacaggagctggtactcatcttggggctcttctccttctacatgcacgccaccaagactaatgcccggtgcgatttggtgccgcgtctgcgcaagtcgattactgcgctgatggaatcgatcacctggctaaggaaggaacaactcgccaaccctgagtgtgtagcagggcccttgtacactatgatcctcactctgcaggactgatcgtctcggctttggagcctcggcaatagcatcgtcgtggggaacgttcaccgtcagtacatcaggaggttccagcctaactggacgaaccctggtgttacctgcagcaaagggctacttgtaaaatcggggccatccatgagcacgaccatgctgacgtatcatcatggacgtaaagctgggggaggttgaattactcaagggcaggactggatctaaacaaggaaaggtgacattaccccgtgatgggatcaccaagt

SEQ ID NO: 94181 - DNA, 1246 bp, Zea mays
  misc_feature: Ceres CLONE 1583797
  misc_feature (1131)..(1131): n is a, c, t, g, unknown, or other
  misc_feature (1246)..(1246): n is a, c, t, g, unknown, or other
ttaaattttgttattgttttatttttttcttatatttatactattcactaattaaaatacttttttttttccaagctggagctcaccgcggtggcggccgctctagaactagtggatcccccgggctgcatgaattcgtctcacccctagaaaaagaggacatcctcggtcttccagggcagcaaccacgaaagccttctgcgcggggtgctttcctcccaccaaatattcctgccttttgcattccggctgtgcaagtaccttgcttagggcatatataatgtcaggcctctatatatataggtggttcaatgtgatcgggagaaccacacatgcaaatatcgcgagcgtgcgcaaggtctccagcctggttctcttgttctgcctgctatcgctggggagaacgcagatcctcaagtgcaaagcatcctaagttccccctccctgttcgggttaatggacctggcgggggtaagattaccatcccacgaaaaaatctgtcccgaatcaccctatatcaaagaaggaaaaaatgcaatggggcttacgccgtctgggagcaaaatacttttaataactttgactttccattaaagcctgccaggtaatttacacgttgtactagtttttcgtgtagggacgctccaagcccccagtggatttgggcaaacacacacatcgtgtgaaactggagataattacataagaaaggggcggactctccgcatttcctacacaggagggtactatggggtgaaaaattcccgcgaaaacccattcttcggcagagagatatattttccaaaagtcatcaaaataatctctcatgtaatgctcctcacaatacgaccagatgggtcactttttagaaaaaaatgaaatatgtcgcataataatttggaaatcctgacaaccacaccaacttctatctccatgttgcttaatctataatagcatttggtgggatctgatggcgaagacgctagtgtaatcaccactcttcggtcctccatgaaatgaatgaaatgggggagcagagagcagccaacaacagcgtcctccctatgttgacataatcatatgcagcgacctcttccctacagtataaaaatctgttcaagtattaccccncccctcattggtacgatcgcccaatctctaagcaaagatgtgggttggtctacaacgcatatgaaaatattctcctatcgagcaggcgcggggtgagactttttctcccctcgan

SEQ ID NO: 94182 - DNA, 826 bp, Zea mays
  misc_feature: Ceres CLONE 1583803
  misc_feature: Encodes the peptide sequence at SEQ ID NO. 94183
ggagctccccgcggtggcggccgctctagaactagtggatcccccgggctgcaggaattcgtctcacccctagaaaaaggtgggtagtggccctagcaataaacatcttgcccaaccggctctcgctacgcgcctacgcttcgtcaacaccggaaccgcccccaccccgccccgagcgccaattgcaccgccgctcccggccaaaccggccaagtcaacggcgcatccacttctccttaccatcccggaggtaatcttgcgccgattcggtgccgatttgcgccatccgcgaccggaggctccgccgggtcttgtgttcttgcggggcgggggctcaggacaacctggcctctgcttgattggattcggggcgttcggcgcctccagctcgcgatctttcctgccggtttcgtcgaccgctggtcaacctggccggtcggtcccgggggctcttcacctccgtgctgcctgccaccgtcgctttagtcaagtctcggccaagattttagctatctccgggcaaaaggctttaccgattcttggatgggtggcttcttgggggcgagaagccggttcctgtttcgtctcttgtgctccagcatgttctgtagcacaccggttccccatctccagtgaaaggtgtcgtgtgctcttggttttgtgcctcccgggaatcgttccggaaagctactttttgccgctgcggcgatggcgtcaagacacacccagatggcccaggggaaggaaaacctgaaagagttccggcagcttgggaaagcaacaaaccctatgggcctggcagaacagaatggatcttacaagccct

SEQ ID NO: 94183 - protein, 39 aa, Zea mays
  misc_feature: Ceres CLONE 1583803
MASRHTQMAQGKENLKEFRQLGKATNPMGLAEQNGSYKP

SEQ ID NO: 94184 - DNA, 839 bp, Zea mays
  misc_feature: Ceres CLONE 1583808
  misc_feature: Encodes the peptide sequence at SEQ ID NO. 94185
  misc_feature (824)..(824): n is a, c, t, g, unknown, or other
  misc_feature (839)..(839): n is a, c, t, g, unknown, or other
tggagctccccgcggtggcggccgctctagaactagtggatcccccgggctgcaggaattcgtctcaccccctagaaaaaataattcgcattcagctttttcatttttaaaaccgagcgtgacatgaatgctctagatttagcacacctagtacttgtttgagcacgtcgcctaataaaattccccattccaatacacagatctcgcacccgtaagtggcgacgaatctcgcggtgcggaggcgcgacagaggcggtgtcgactccgacggactcgcagccaccggtggagacgccccaccggcgcactcctccaacgttcatagtttaagggcttgatttggataattagtcatcaacagaagtgataaaaaatggtggttcttgcagcatcaatcgtttcaaagtcgggaaaagcacttgtttcaagacagtttgttgacatgtctcgcataagaattgaaggattacttgctgcgttcccgaaactggttggaactgggaagcagcacacttatgtcgaaactgaaaatgtgcgatatgtttatcaacctattgaaggtttatatcttctacttatcacaaacaagcagagcaatattcttgaagatctggacactttgaggctcctctccaagctcgtgcctgaatactccccttcattggatgaagagggtatttgtgaaacagcatttgagattatatttgctttcgatgaagccatatctcttgggaacaaggtaaatgtaacagtgcaacaagtcaaacaatattgtgagatggagagccatgaaagagaagcacacaagctgatgatgcaaaccnataatcatggaaccn

SEQ ID NO: 94185 - protein, 155 aa, Zea mays
  misc_feature: Ceres CLONE 1583808
  misc_feature (151)..(151): Xaa is any aa, unknown, or other
MVVLAASIVSKSGKALVSRQFVDMSRIRIEGLLAAFPKLVGTGKQHTYVETENVRYVYQPIEGLYLLLITNKQSNILEDLDTLRLLSKLVPEYSPSLDEEGICETAFEIIFAFDEAISLGNKVNVTVQQVKQYCEMESHEREAHKLMMQTXNHGT

SEQ ID NO: 94186 - DNA, 832 bp, Zea mays
  misc_feature: Ceres CLONE 1583812
  misc_feature: Encodes the peptide sequence at SEQ ID NO. 94187
  misc_feature (767)..(767): n is a, c, t, g, unknown, or other
  misc_feature (832)..(832): n is a, c, t, g, unknown, or other
ctccccgcggtggcggccgctctagaactagtggatcccccgggctgcaggaattcgtctcacccctagaaaaaacccacatcctcgccgcccgtcggcttgcattgcagttgcagcagcgcacaattaattggaagcgatcttctttcccgggtcatcaagtcctctcctcatcggccaaccatcacacagcacctccgcgagggatcccgcctctgcctggccgccgcccgtcgcctttgcagcaaggaagaagcgatcttctctcccgacaagtcctcgccggatctaagctagcgtgtggcttggcagtaccggggttttcaataaggactaaacacgttagggaataatgcttccagaaagatgtgcttgtatgttgaagagctatcctgcgagggactcggcagagtagcatgccatactcatcatcatgcatatatcatttgctagatcttgatgaccttgaagctcaagagtatctttcacacgatggcttcttggatcaccatcttgggggagacgattgaagtcttgcattggtcctctttttcttgtcaaggataagcaagtacccgcgcgctatctgtgtgcacacacacgggcatgcatgcatgcaagatgatggcgggacataataaaagaaacattattctcatgcacaagtatgagatgggggagattgcttggtcaagggaccttcgctaaggtctaccatgctcgcaacaccaggacctcagtaagtgtcgcgatcaaggtgatcgacnaggggaaaggttgtgaaagtcggcctcgtcgaccagatcaagcgagagatttctgcgatgaagcn

SEQ ID NO: 94187 - protein, 55 aa, Zea mays
  misc_feature: Ceres CLONE 1583812
  misc_feature: SWISSPROT Homolog: EC 2.7.11.1 Non-specific serine/threonine protein kinase
  misc_feature (34)..(34): Xaa is any aa, unknown, or other
MRWGRLLGQGTFAKVYHARNTRTSVSVAIKVIDXGKGCESRPRRPDQARDFCDEA

SEQ ID NO: 94188 - DNA, 1077 bp, Zea mays
  misc_feature: Ceres CLONE 1583816
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (1077)..(1077): n is a, c, t, g, unknown, or other
ggtgttgtttcctcattttatttttggggacttagttaatcaaagggggagcccttctatggggtttnnnnctcaaagctggagctccccgcggtggcggccgctctagaactagtggatcccccgggctgcaggaattcgtctcacccctagaaaaaacgccgccgtctacccccactcccccagcacgtgcgtgcacgcgcaggtgctcgaggacttctcccccgtttccgcccacatccgccgacctgcctcgccattccgccgcgccttcgcatcgtccgcgcgcccggcccttctcgttctaccccggtacgactcgacggtggtcgtgggcgccgaaggtgcggctccgaggcgccaggtggttcgtttgctgtttgcgcgatcgccggaggagtctgtgtaagctgtgctggctaagggtttgggggttcggattcagtggaggggctgcggcgtgagggagctagacatgtacggaccgccgtcccgaggcggcgggggagctggcactgccggagagcagcgtagggttgaccaagtttggcgaggaagcaacgagtttttcttgcaaggccggttcatatttggacctgatgtgagatcattgtttctcaccatgttcgttcattctttgcgcccgatgcgtggtcgttctgaagtattgtgtgggcccggaaattttttattcggatggactttttctccgaatcatttggagggaaatttttccagttttaatggggaccccagacgtggtatttgatcctttcaacttggaaagtaccgaacttttgaacgcttttgccggggctttccttaaaccttcctggggataaagaggtccctgcgctcactattgtggctcccgcttataatacgcggactccctttcttaataaagcgccaccgccatatttgtaaattgaaaccaagtggatgccgtgggaaaaagtggtggaaaaaaaccaaagaataatattgttggctgtttctaattgtaaataagcggaacggttgtatggtaaaaagcggggttaatttggggtagcggtccagatgtatggtgatccn

SEQ ID NO: 94189 - DNA, 816 bp, Zea mays
  misc_feature: Ceres CLONE 1583820
  misc_feature: Encodes the peptide sequence at SEQ ID NO. 94190
  misc_feature (749)..(749): n is a, c, t, g, unknown, or other
  misc_feature (750)..(750): n is a, c, t, g, unknown, or other
  misc_feature (760)..(760): n is a, c, t, g, unknown, or other
  misc_feature (761)..(761): n is a, c, t, g, unknown, or other
  misc_feature (765)..(765): n is a, c, t, g, unknown, or other
  misc_feature (768)..(768): n is a, c, t, g, unknown, or other
  misc_feature (816)..(816): n is a, c, t, g, unknown, or other
ctcaccgcggtggcggccgctctagaactagtggatcccccgggctgcaggaattcgtctcacccctagaaaaagcacaccggcatggcggccacggcgtactccgtggcgctcctcggcggcgcgcgccttcccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagcgaagtgggacgccgttgaggacaagcccaccgtcctcttgtacggcggcggcgccgtcgtcgccctttggctgacgtccgtggtcgtgggcgccatcaacgccgtgccgctgctccccaagatcctggagctcgttgggctcggctacaccggctggttcgtgtaccgctaccttctcttcaaggaaagcaggaaagagttggccgccgacattgagaccttgaagaaaaaatagctgggacagaataaacgctcatggaaagttttagagcgtcctttcttcttttggaagagatctattcgatcggagaacaatggcactacttgagtactattattgcccatgtattgtgtgctgaatatcttctgaaaaaaaggaaagttcgtttgttatgtacgtagtagcattgtaggttaaatggatcggaattaccatccgccaaattcctccttttggatttaaaaaannaaaaaaaaannaaanaanaaaaatttttccgccggggggagggttcccctccctttcggggtgacn

SEQ ID NO: 94190 - protein, 143 aa, Zea mays
  misc_feature: Ceres CLONE 1583820
  misc_feature: SWISSPROT Homolog: EC 6.1.1.9 Valine--tRNA ligase
MAATAYSVALLGGARLPAAPRSALLPRRSVCQLRFQDAPRLSLLRAKAASEDTSASGDELIEDLKAKWDAVEDKPTVLLYGGGAVVALWLTSVVVGAINAVPLLPKILELVGLGYTGWFVYRYLLFKESRKELAADIETLKKK

SEQ ID NO: 94191 - DNA, 840 bp, Zea mays
  misc_feature: Ceres CLONE 1583822
  misc_feature (327)..(327): n is a, c, t, g, unknown, or other
  misc_feature (329)..(329): n is a, c, t, g, unknown, or other
tggagctccaccgcggtgggcggccgctctagaactagtggatcccccgggctgcaggaattcgtctcacccctagaaaaagctttcccacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagcccccatgtcgctgcgtccgagcgagcgggtcaagtacggcggaccgctacaggtggcgttgaacggaagagggcggcggcggcncnaggaaatatggtggagatccgcaagagccgccgtgaggagaggctcctcaagaggcgccgtgagggggctcaaagcccaggtccctgcccctcccctccgggggtccaagaagaaaccttgaaaaagcctcccagcctattgggttaagtggggggttttatttccggaaggaaataaaaaaaccctttccagcttttgggggggccccccccaccccaagggttcccccccaaaaatttggggcttttctcttaaaaagaaaaggagggaaggtcccccccccctctttcgggagaaaaaaagtttttttttcaaaaaacccggggggggtggaatttctcccacaaaaaattttggggggggagggccttctcctcccccaccagaaaaaaggaggatttttccccccccacacagtgtggaaatttttttataaaaaacactcctacagggggggccttcctctccaaaaaaaaaaatttgttttttttcgtggggagcacttttaaa

SEQ ID NO: 94192 - DNA, 847 bp, Zea mays
  misc_feature: Ceres CLONE 1583823
  misc_feature: Encodes the peptide sequence at SEQ ID NO. 94193
  misc_feature (446)..(446): n is a, c, t, g, unknown, or other
  misc_feature (797)..(797): n is a, c, t, g, unknown, or other
  misc_feature (798)..(798): n is a, c, t, g, unknown, or other
  misc_feature (803)..(803): n is a, c, t, g, unknown, or other
aaagctggagctcaccgcggtggcggccgctctagaactagtggatcccccgggctgcaggaattcgtctcacccctagaaaaagcacaccggcatggcggccacggcgtactccgtggcgctcctcggcggcgcgcgccttcccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagcgaagtgcgacgccgttgaggacaagcccaccgtcctcttgtacggcggcggcgccgtcgtcgccctttggctgacatccgtggtcgtgggcgccatcaacgccgtgccgctgctccccaagatcctggagctcggtgggctcggctacaccgggngggttcgtgtaacgctaccttctcttcagggaaagcaggaaagaggtgggcgccgacagtgagaccttgaagaaaaaatagctggaacagaataaacgctcatgggaaagttttagagcgcccctttcttccttgggaaagaggactattcgatcggggaacccaggcacctacttgaggtactattactggcccaggggattgtggggcgggaaaatccttccggaaatccaaaggaaaggggtcctttgggttctgtaacctatatagcccatggggaggtgttaaaagggccccgggaattatcctattccgggcccaaaaatgctctcccttcttttgaatctttcnncccgngcgagcttagcaagagacccggtggccgaatatcgaaaagattc

SEQ ID NO: 94193 - protein, 137 aa, Zea mays
  misc_feature: Ceres CLONE 1583823
  misc_feature (118)..(118): Xaa is any aa, unknown, or other
MAATAYSVALLGGARLPAAPRSALLPRRSVCQLRFQDAPRLSLLRAKAASEDTSASGDELIEDLKAKCDAVEDKPTVLLYGGGAVVALWLTSVVVGAINAVPLLPKILELGGLGYTGXVRVTLPSLQGKQERGGRRQ

SEQ ID NO: 94194 - DNA, 861 bp, Zea mays
  misc_feature: Ceres CLONE 1583824
  misc_feature: Encodes the peptide sequence at SEQ ID NO. 94195
  misc_feature (733)..(733): n is a, c, t, g, unknown, or other
  misc_feature (861)..(861): n is a, c, t, g, unknown, or other
ctggagctcaccgcggtggcggccgctctagaactagtggatcccccgggctgcaggaattcgtctcacccctagaaaaacccctccccctaccgcctgcccttctgcaatcacggcagccactccccgtcgtcgagcaaaagcactccggtgagctagaaccggaagaggaatagccagcctgccggcgatccccgcagaccacgccagccagccgcctcacaagtcccagtcggcagggattcctaaacataacgcgcgctattcctattattagccagccgcctctgggcttaaccgccctcgtgcgcgcgttccggaggcgcgcgcccagaccagggccgcccccgcgccatggacgtgctgcggttcgtgcgcgccgccgcggcgccgcagcctacggtggcgccgccggcgtcggctgcgacggtgccggcgcagcgccagcggctgcgcatgtggccgcgtggcgggggagaccagccggccccggtcggcgcctcctccgcgcgcggcgcggagccgaggagcccgcccgacgaggagcggaaggcggagggggcccagcgggggcagggcaactgggtgctgcagatgctgcgggtgcagccgcggtgggtggatgcggcggacgcggaggcccacggcggcgggcaggaaacggacgaagagacggcggctgcggctgcggctggcgctggtggcgtcaaggagtgcgccttctgcggctgcngaaagacgactaaagctgcgtcttggggacggcgacggcgagtgttcgaacgcgcgtcgttctcgcgcttctgcggaggcgtcgctcgggaggctaagaagaatcaggaagtctacctctgcacatcn

SEQ ID NO: 94195 - protein, 169 aa, Zea mays
  misc_feature: Ceres CLONE 1583824
  misc_feature (127)..(127): Xaa is any aa, unknown, or other
MDVLRFVRAAAAPQPTVAPPASAATVPAQRQRLRMWPRGGGDQPAPVGASSARGAEPRSPPDEERKAEGAQRGQGNWVLQMLRVQPRWVDAADAEAHGGGQETDEETAAAAAAGAGGVKECAFCGCXKTTKAASWGRRRRVFERASFSRFCGGVAREAKKNQEVYLCTS

SEQ ID NO: 94196 - DNA, 826 bp, Zea mays
  misc_feature: Ceres CLONE 1583829
  misc_feature: Encodes the peptide sequence at SEQ ID NO. 94197
  misc_feature (593)..(593): n is a, c, t, g, unknown, or other
  misc_feature (596)..(596): n is a, c, t, g, unknown, or other
ctccccgcggtggcggccgctctagaactagtggatcccccgggctgcaggaattcgtctcacccctagaaaaaaccctgcccacccgaacaataaccaacagcttcaccctcctcctccagtgcaggccgtcggcggctggcggcgtcatttctcctccttcctctggcctgccctgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtaggtagccaagaagacatgagatgggggcgtccttgggctccgccgccagcaagaaccggcagcaggagcacggcggcgaggctccgcgaccagatccctgcaagaagacgcggctctcgacccctctctgcactatccacggccactcgaggctgatcccggggctcccggatgaggtctctctgcagatcctcgcgaggatgcccgcgatggggtacctcaaggcccagatggtctcgcggagctggaaggcngcngtgaccggcgcggagctgtactggctgaggaaggagctcggcgtggccgaagagtggctgtacatactgacaaaagccggcggcaggtgggcaaaagctggtctggcacgctctcgaatccgttagcaaccaatggcagaggctgcgctcatgcctgggatccaatgacagattggcggcctttacgggcctgggctggcgggactggtgaacgcccggctaggaatttt

SEQ ID NO: 94197 - protein, 120 aa, Zea mays
  misc_feature: Ceres CLONE 1583829
  misc_feature (44)..(91): Pfam Name: F-box Pfam Description: F-box domain
MGASLGSAASKNRQQEHGGEAPRPDPCKKTRLSTPLCTIHGHSRLIPGLPDEVSLQILARMPAMGYLKAQMVSRSWKAAVTGAELYWLRKELGVAEEWLYILTKAGGRWAKAGLARSRIR

SEQ ID NO: 94198 - DNA, 1172 bp, Zea mays
  misc_feature: Ceres CLONE 1583832
  misc_feature (20)..(20): n is a, c, t, g, unknown, or other
tattttttttttttttgatnggacagtgccgagtgacgcgagacggtaggactctgataaaattatgggggttttttcatagctggactccccgcggtggcggccgctctagaactagtggatcccccgggctgcaggaattcgtctcacccctagaaaaagtgcgctctcttttgctctctctatctctctcgtggcaacgactgcgcgagcgccggcgcctacgccaggtgcccaggcctccgtcggtcatttcgccaggcattcgtcgcgggctcttcgccggcgacgagcacacccaccaagttgaggattggtcctttacgagcatgttataatgggagagaacggagttcagctgacactgacctccactttgaagagcacaggcaagccacggatcaatgcggacgggctgaataatggatcacatactaccaaagagaagcatgaacacggtggcactttccaaccatcaaaaggccagaagcagcagctgtgcacaacatgtgcaaaagggcatacttgtcaatcggtcatcaaccggacaagacaaatgcgaagctcttaatcgactccaaagaagcgcttaaccaggaaccactcttgtattcaagccccttaaaatgggatgagggggcacaaagcccttttcattggggtcaccataccaacaatttcctatcctgtacccggccccgtgaaccgaacccaagtaggggaatgctttttggaattcccgaagttcccaatgtcaacggaggcctttgggcttggaaaggttttgcaaaaacctctagcccttgggatagattttaggcgccccaagaaaaccacccctcgtgtcgtttccttttacacaatgtggccttattggaatataaacaagtcctctctcttatgttttgaagagggccaaaaaaatcctgtaaatggcgggcggaaaagagccgctttttacacacactcattttctctgtgggaaaaaatttacaagaccatttctttgtgggtgtgcgccaacccgaaaatttataccaggctgcaccgcttttacataataagccgtgacattaaaaaaggagctatttgggtctattttctttggcggataagaccgccgcaagaaaaaaataacagtggcgcgggtttttctcaaaaatttattgcgg

SEQ ID NO: 94199 - DNA, 825 bp, Zea mays
  misc_feature: Ceres CLONE 1583833
  misc_feature: Encodes the peptide sequence at SEQ ID NO. 94200
ggagctccccgcggtggcggccgctctagaactagtggatcccccgggctgcaggaattcgtctcacccctagaaaaaaccttcctgacggcgactgcgcagccatatcctcctgacctcctctccatctcctctctttcgctgtctaccctcaccaactcctacctcccgagacaaattccgaggtcgacacaagaaaagggaaagaaccacaggtaattgccttcctgtgtcgggattgtagctccaatccactccgcgccggccgggtgcgctgccatccggatcagacgccctcgcatctctcgcccttccggcatcgtatcccctgggcggcagcggagtaaagatccgacccgcttgggattgtttgcttctcctttttgcggtgcgccgctggactccagtgctgcacatgctcgacgacggtgctgagctcctgcaatggcccgaagaaatgccggcgcaatgcagcgggagggttcggcggggtcggttaaggactggtcggaattcgacccttcgccgtctcccaagctggcgtactcgcagtcctacgtcgccatgagagggctgttgacgtcggtggcttctctggaccctgtcctgacgtcgagcagcctcaagtctctgtgggcagccttgtcatcgcacaggcacgctcggtccttgggagagccaaagtacatggggatgaactggaagatgcccatgttccacctgcttgtgtgctttcttagtgggagttttcattggattcacaccactcttctctctcgatttaatcaggtaacatagattctgaaaacgaggacgctttcgttt

SEQ ID NO: 94200 - protein, 117 aa, Zea mays
  misc_feature: Ceres CLONE 1583833
MARRNAGAMQREGSAGSVKDWSEFDPSPSPKLAYSQSYVAMRGLLTSVASLDPVLTSSSLKSLWAALSSHRHARSLGEPKYMGMNWKMPMFHLLVCFLSGSFHWIHTTLLSRFNQVT

SEQ ID NO: 94201 - DNA, 888 bp, Zea mays
  misc_feature: Ceres CLONE 1583834
  misc_feature: Translation starting site: 130
  misc_feature: SWISSPROT Homolog: EC 4.2.1.3 Aconitate hydratase
  misc_feature (248)..(248): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (260)..(260): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (273)..(273): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (321)..(321): n is a, c, t, g, unknown, or other
  misc_feature (379)..(379): n is a, c, t, g, unknown, or other
  misc_feature (444)..(444): n is a, c, t, g, unknown, or other
  misc_feature (447)..(447): n is a, c, t, g, unknown, or other
  misc_feature (479)..(479): n is a, c, t, g, unknown, or other
  misc_feature (480)..(480): n is a, c, t, g, unknown, or other
  misc_feature (503)..(503): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (530)..(530): n is a, c, t, g, unknown, or other
  misc_feature (535)..(535): n is a, c, t, g, unknown, or other
  misc_feature (537)..(537): n is a, c, t, g, unknown, or other
  misc_feature (538)..(538): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (556)..(556): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (632)..(632): n is a, c, t, g, unknown, or other
  misc_feature (633)..(633): n is a, c, t, g, unknown, or other
  misc_feature (660)..(660): n is a, c, t, g, unknown, or other
  misc_feature (664)..(664): n is a, c, t, g, unknown, or other
  misc_feature (666)..(666): n is a, c, t, g, unknown, or other
  misc_feature (671)..(671): n is a, c, t, g, unknown, or other
  misc_feature (673)..(673): n is a, c, t, g, unknown, or other
  misc_feature (724)..(724): n is a, c, t, g, unknown, or other
  misc_feature (743)..(743): n is a, c, t, g, unknown, or other
  misc_feature (771)..(771): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (806)..(806): n is a, c, t, g, unknown, or other
  misc_feature (825)..(825): n is a, c, t, g, unknown, or other
  misc_feature (850)..(850): n is a, c, t, g, unknown, or other
  misc_feature (859)..(859): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
tccccgccggtggcggccgctctgaactagtggatcccccgggctgcaggaattctctcacccctagattgattgatggtttgggtgttgctggctggggggttggtggtatagaagcggaggctaccaatgcttggtcagccaatgagcatggttttgcctggtgttgttggcttcaagttaactgggaagttacggagtggtgtcacggccactgatcttgttcttacagtaacaccaaaatgccntnnnnnaaaaanannnngggggggnaaaaaaaaaaaaaaaccccaccnnnannnnnnntgggaggnnnggggnttttttttgttttttttggggggggcccaaaaaaaaatttttttttttgggggtgttnttttgggggggaaaaaaaaaaaaaaatgtttctcctcccccccccaaaaaagagaggtggggggnagntgtgggtggtttttaaaaaaaaaaaaaaaaannagaggaggggtggtgggggtttnttaatttnnntatattgaggtttggtnagggngnncgnnnnnnnnnnnnntgnagtgttgttttgaggttgnnnnnagnnnannnnnnnnaaaannnnnnnaaggnnnncaagaggagggaggtgaggnncccctcgttgtgttttgttttttattntagngngaganancccccgtctttttttgttttgtttgggaaacaaaaacgaaaaaaaaaaagnggggggggggggggggggnccccccccccccacccccccacccgagnagaaaaatttttttttttaaannnaggggcgcggncccccgcccgcccggcagnggaagagaaaaaacaaacccagccnctttggggntttggtgnnntggttccgcgccccgaacc

SEQ ID NO: 94202 - DNA, 901 bp, Zea mays
  misc_feature: Ceres CLONE 1583836
  misc_feature: Encodes the peptide sequence at SEQ ID NO. 94203
ctggagctccccgcggtggcggccgctctagaactagtggatcccccgggctgcaggaattcgtctcacccctagaaaaaaaacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctcccacctccctctttctctcaatctctccttattcttctccttccacggcgaagccggcggctggtatggatcccaatggcctcaaaactggaggccttttgctcccgaccatcgagaggcggtgcacgtcgcctccatccgtcattgtcatcggcggtggcatctcgggcgttgcagctgcccgtgccctctccaattcttcatttaaggtgactgttttggaatcgagagatcgtattggcgggcgcattcatactgataactcgtttggatgcccaattgatatgggagcctcatggcttcacggcgtgtgcaatgagaattcccttggcccattggataagcctttcttggggcttagggttataccgcaccaggcgaagataacttcgggtcctggaatgatccaggaatttaggaaagcttatgccttctctttttgaataagggatggtaaatactgggtccccaaaagggaaaacacgtccgaataaatgttggggag

SEQ ID NO: 94203 - protein, 125 aa, Zea mays
  misc_feature: Ceres CLONE 1583836
  misc_feature (40)..(80): SWISSPROT Homolog: EC 1.4.3.4 Amine oxidase (flavin-containing)
  misc_feature (51)..(124): SWISSPROT Homolog: EC 1.5.3.11 Polyamine oxidase
MDPNGLKTGGLLLPTIERRCTSPPSVIVIGGGISGVAAARALSNSSFKVTVLESRDRIGGRIHTDNSFGCPIDMGASWLHGVCNENSLGPLDKPFLGLRVIPHQAKITSGPGMIQEFRKAYAFSF

SEQ ID NO: 94204 - DNA, 950 bp, Zea mays
  misc_feature: Ceres CLONE 1583838
  misc_feature (345)..(345): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (406)..(406): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
aaagctggagctccccgcggtggcggccgctctagaactagtggatcccccgggctgcaggaattcgtctcacccctagaaaaagtttgcctgcgattgaaagccttctctggcctgtctccaaattggcattcctgagcaaaaatcccctgcaacccgacccatggccatgggcaagctcgaggagaggacgcgtgcgttctggacgaaacgatggcttgtgttcgttggggccatgtgggatgcagtccatggcccgcacccacttaactctttagacgcctttctcccccggtggcagggggcagctctgggcttccagccagcgctgcaacgcgcggcccnccggggggtcggccaaaaactctgtgggggacccccccccggccctccccgnnnnccgggncgcctttcggggaaattgggccccctgggggggccctttttttggggcacttgggcccccccaaaaaaattcctccgggaaaaggggggggttctgggggcccgcctttcccgggaaaaaaaaggcggggcgccccccccctttggggggaaaaaaagggggggggggggttttcttttttgggaaaaaaaaaaggggccgcaaaattttttttttttccgggggggtttttccttttttttaaaaggaacccccccaaatttttttcccccaaaaaaggggggggcccccaaaggggggggccctccccaaaaaaaatatttagggggctataaaaggcccctcttttttatagaacaattttttttatagcggggtggggcccctccccaaaaaaggggggggggttttatttttttcggggggggggggtggttggggggaacccacccccgggggggccccannnggggtgagtatttttgtttttataaaaaannnccccctttttttggggtgtgggaggaaaaaaaacatcaaaaaa

SEQ ID NO: 94205 - DNA, 1074 bp, Zea mays
  misc_feature: Ceres CLONE 1583839
  misc_feature: Translation starting site: 97
  misc_feature (717)..(717): n is a, c, t, g, unknown, or other
  misc_feature (896)..(896): n is a, c, t, g, unknown, or other
  misc_feature (916)..(916): n is a, c, t, g, unknown, or other
gagctccccgcggtggcggccgctctagaactagtggatcccccgggctgcaggaattcgtctcacccctagaaaaaatcccttctcccgatcacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcttccggtaagggcaaagccgccgctccctccctcgccgccgggcaccctccccatcgtggggcacctacaccacatcgggccccagacccacatctcgctccaggagctggtggccaagtacgggcacaacgggttcctgatcctccgcgcccgccccgtgcccaccctgatcgtgtcggtcgtccagcgccctcctaggccgagattgcacacccccgaaccaacttctttctcgtcccgggccgtggttccatgggcctcccaatgttcttgcggctacaaacacctggctacggttggtctgttcttcgcccgttggggcggaagagctggggcagcatgatccacggaaagcttggaataaaacatcgccaccctggccttcatccgtcgcacagaagaggtcctaaaactcccttgtccgccccctttggggccaccgaaaggaaaagaaaggaagttggctcttctgtcttntgtggaaccatactcttttatgtatgaggggggtacgtctcaaattttctctccgtctccaaccgcgtctgtgtgagactatacgtagcccgggctcttctctgcgcttgcaataaatatctctccactatacgcttttacagctagcaccccggtcgccgttgtcccaggcgactacncacatcttactcgtagacgnaaaaatgggtcgggaaagttcgctctgtgttatatgtcgtgagaatatcgaccctccaccacaccccgcatctttctgaccttcccctatgatgtatgggaactattcgatcacactgtgacagcgctctattatgtccattctgcgtgacggtgggc

SEQ ID NO: 94206 - DNA, 1072 bp, Zea mays
  misc_feature: Ceres CLONE 1583841
  misc_feature: Translation starting site: 135
  misc_feature: SWISSPROT Homolog: EC 1.11.1.6 Catalase
  misc_feature (895)..(895): n is a, c, t, g, unknown, or other
  misc_feature (1055)..(1055): n is a, c, t, g, unknown, or other
cggccgctctagaactagtggatcccccgggctgcaggaattcgtctcacccctagaaaaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtgggcgcacttcgcgcgcgagcgcatcccggagcgcgtggtgcacccccgcggggcctcctccaagggcttcttcgagtgcacccgggaccccccctcgctgacgggcgctgaattcctgggcgggccctggcgtggggaaaccccttaatcgctcgccttttcgactgggaatccacgaagcgggggggtcccccggaaaatgaattccgcgaccccgcgccgggggttcgggtgtgggaggtttttatcccaccgccgagggggacaactgggggagcctggggtgggggggacaagactgtccctcgagggtctttctttcgcttcgtgcgggggtggcgaggaggagggatttccccccccagtggggtaaatctctatgaggccgtgactagaagaccaccgaaaacacctcctggtgtgtcgtcccagcatgagcgagggagtagttctctggtgccggggcgtggtgatatttaggcatgggtcgccggtgtcgcgacactctggtgtctccgagaggagtgatgagggagcgaggaatagtgcgcgggagtatacatgtagacctcggcgaagagggagtgtcggccgtcgccggaggaggngatcagctccgcgacgcgcggggtgggtggtgtggggacggagagtgagaatccaacgctccttcgtgttgggtagggaacacgcaccgcggcgagagcggcggtgggggaatcctcatgtagcgccccgtcggggaatatagccgccgcaacattcgcncgagcgtgaagtagtgg

SEQ ID NO: 94207 - DNA, 829 bp, Zea mays
  misc_feature: Ceres CLONE 1583844
  misc_feature: Encodes the peptide sequence at SEQ ID NO. 94208
ctggagctccccgcggtggcggccgctctagaactagtggatcccccgggctgcaggaattcgtctcacccctagaaaaaaaaccgtccatccacttaaaccccaccctcagtcctcacccaccaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcgtcctcttcctctaagcccacctccctttcccactccctcccctccaagcactcgctggccccaccccccgccgcatccgcatcctcccgtcgcggtctcacccccgtacccgcctccgcctccgccgccgccgctccagcgccggatccagtgccggttccagcaccggctccagcgccggctccagcaccggccgccccgccgaagaagcccgcgctgcagggcgcggccatcaagccgctcctggcctccatcgcgactggcgtcctcatctggctcatcccgccccccgccggcgtgccccgcaacgcgtggcagctcctagccatcttcctctccaccatcgtcggcatcatcacccagccgctgcccctcggcgcggtcgccctcctcggcctcggggccgccgtgctcagccgcacgctcacgttcgccgcggccctctcggccttcggcgacccgatcccctggctcatcgggctcggccttcttcttcgcgaagggggtcatcaagaacgggctcgggtcccgcgtcgcctaaccccttcgtcgcccgc

SEQ ID NO: 94208 - protein, 220 aa, Zea mays
  misc_feature: Ceres CLONE 1583844
MASSTAASPLTCHHLGSVGARPRLPSLSISLRRRSSSSSKPTSLSHSLPSKHSLAPPPAASASSRRGLTPVPASASAAAAPAPDPVPVPAPAPAPAPAPAAPPKKPALQGAAIKPLLASIATGVLIWLIPPPAGVPRNAWQLLAIFLSTIVGIITQPLPLGAVALLGLGAAVLSRTLTFAAALSAFGDPIPWLIGLGLLLREGGHQERARVPRRLTPSSP

SEQ ID NO: 94209 - DNA, 1303 bp, Zea mays
  misc_feature: Ceres CLONE 1583845
  misc_feature: Encodes the peptide sequence at SEQ ID NO. 94210
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (761)..(761): n is a, c, t, g, unknown, or other
  misc_feature (935)..(935): n is a, c, t, g, unknown, or other
  misc_feature (942)..(942): n is a, c, t, g, unknown, or other
  misc_feature (1106)..(1106): n is a, c, t, g, unknown, or other
  misc_feature (1108)..(1108): n is a, c, t, g, unknown, or other
  misc_feature (1196)..(1196): n is a, c, t, g, unknown, or other
tttggtgagtttgggtcgtttttatagctcccttttttctgtttttattggggaaagaaaaaaannntcaaagctgggactccccgcggtggcggccgctctagaatagtggatcccccgggctgcaggaattcgtctcacccctagaaaaactccacgacttcggtgcctccacctcgaggcacgcaacaattggaatacatctcgccgccgccgaggaccacggccatgatgtggtcgttcggcagctcgagcggtggtcgtactgcgctcgaccattactcggtcaccgccaccacctccgcaaccatatgccactcgaacccaaatcggaatcccacctccccacttgctggcctcggccccggatcccatccccgatttctcctccgcctccgccacgaatcccttctctgaagacttctcgtcccagaccaagggttctcaagaggccgctgagggggggcacccacggaggtaaaactcgaatctaagacgaaaggtgggcgacggccgaaagaacatctattggcatgccccgggcggcgcccgaaaatccgtttcctcaaagaatgaaggaagctctcccccgaaatacttcggccactcgggtgaaaatcgcacccccccgcgaaggaacgaggaaattccggttccacccccttccgcctgaagcattgaaccccgggggggaagtttccaaggagaaggcgcgttcttaccttagggccggcggagggccatatttcttattcggcggnccaggggagcgagaacagtacgttcccttctgtttaatgaaaaaggccccctgaatatatgtagctccctgtggttgttgcagaaactagttgtagcagcctcctcctcaaaaggaaagaagagaatccgccctctcggattgtatcacaaaagaaaaagagcctcgcgcgccngagaganatatccgctgaggagggtggtcatcttctgtggggggagggcgaaaaacctctaaaagcgctgaaagaatttgtgtgcctggtggaagaatatatttgacaagagagggactttgtaacgcccgttataccgatctgtgcggtctttagtcgaggaattcggcncnagtgtgagagaggcaaaagagattagggttcgtgttcttctgcttctggcagtagccgcgtgcgggaggagacacccacgatttatanatataagtgggaagcagtagaagaagtcgcacactatgtatctggggaacgcgcgtgtatgatatatggccaaaaagacggagaggtgtattgagagggagtatata

SEQ ID NO: 94210 - protein, 80 aa, Zea mays
  misc_feature: Ceres CLONE 1583845
MKEALPRNTSATRVKIAPPREGTRKFRFHPLPPEALNPGGEVSKEKARSYLRAGGGPYFLFGGPGEREQYVPFCLMKKAP

SEQ ID NO: 94211 - DNA, 801 bp, Zea mays
  misc_feature: Ceres CLONE 1583851
  misc_feature: Encodes the peptide sequence at SEQ ID NO. 94212
aaagctggagctccccgcggtggcggccgctctagaactagtggatcccccgggctgcaggaattcgtctcacccctagaaaaaagtatcgcctttgcccgcacacacggctcccattccatttccgctgcttgacgcgcacccacaccaccacagcacgcgacgcgagaccgaatccatccgtccgacgccgcctcgcctccctcagccctccgcagctcggcctctgcttgcgttgcgttgcgttgcgtgtgtatgtagtggccgcaacacaaaatcaagagacgtgatatatgcgacccccaacagccaacgaccggcctccaagcggtgggggtggagcagcagcagctggtgcagcagcaggggacgacgacttcgccttctactactcctacctccaggacgccgacgccgccgccgcctcagcgacgtcgacgctcgccctcgccgtcgacgaccccaaccccagcgccgcagggatgacgaacggccggcgccggaagcagcgcggggcagaggacgccggagccgccagggaaggtgaggaggcggccaagaaggacggcaagaagcggtccatcgccaagctgctcacctcgctggcggcgctggaggcggaggagcacgccgaccgcgcgggcgccgcggacgcgtccaggcgggagctggcgctgctcgagtccaacgccgacacccgctcgcaagccaccatggactactacgccaagatggagagcagcttcgacgcccacgccgagtccgtagccgcccgcaggtcaagcgctccaggctcgccgc

SEQ ID NO: 94212 - protein, 106 aa, Zea mays
  misc_feature: Ceres CLONE 1583851
MTNGRRRKQRGAEDAGAAREGEEAAKKDGKKRSIAKLLTSLAALEAEEHADRAGAADASRRELALLESNADTRSQATMDYYAKMESSFDAHAESVAARRSSAPGSP

SEQ ID NO: 94213 - DNA, 1035 bp, Zea mays
  misc_feature: Ceres CLONE 1583852
  misc_feature (1035)..(1035): n is a, c, t, g, unknown, or other
ggagctccccgcggtggcggccgctctagactagtggatcccccgggctgcaggaattcgtctcacccctagaaaaaagtttcctgtccctccgtgtgcttgcaatggcgcataggcaccgcccccgccctcctcttcccctgcgttctacctaactcattcccccgccggacaccctggccgacatctcgtccgggggaaaccgggtcacctccccgcgggcccccagaaccagggagcgggccgggccggtctcctcccccgggggcggtaggcgctccggagaggtagcaacaccccccgctcagggttgggggagtcgtcagagtgagaagaaaccagttcaaacagaaaggcaccccgccgaaccatgaatatctcccggataggtaaaaagtcagacgccccccccccccggtaggtatttgagggtgtatagaaacgcccgtgaacgggaaatgaggccaatcacccttgccaggaggccctgtaaaatccttgtcacggatatagaataaggggggataatgggggagaggcccgcctgttggtgagccccctatgtggaggtgataaattgaaccaccgattaatggaagactaatatgtggctaacaatttagactagcgtggcgtcggggggggcgggggggtagtggtgatagaactcatgttttagtttttgactattgaatagtgaggagtcgcccacgtcgtccttgtaaccttcagttattgtggggtatgtctagtgagctcacttacttatggagaattgcaagagaaagatactacgatcgcctcgttgatccgcgttagacagcaatccttaaaacttgtgccgctccctcgctgttgttcgcgcgcctcaatataacgcacctttacgacaccaacatatacggaagtggcggctgaggtacgggactcagttccttcgatgttcgtcacacaccgatgttagttattgctgacttgggcatcaggatcgagttatcatatgaggaggagatgtacatttctctatgtatgaan

SEQ ID NO: 94214 - DNA, 825 bp, Zea mays
  misc_feature: Ceres CLONE 1583856
  misc_feature: Encodes the peptide sequence at SEQ ID NO. 94215
  misc_feature (378)..(378): n is a, c, t, g, unknown, or other
  misc_feature (383)..(383): n is a, c, t, g, unknown, or other
  misc_feature (469)..(469): n is a, c, t, g, unknown, or other
caaaagctggagctccccgcggtggcggccgctctagaactagtggatcccccgggctgcaggaattcgtctcacccctagaaaaaaacccagccgcccattgccggcattgctcgcagcgctagcttcttgcgctcatcagtcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaaagctcccatcatcgggcaccntcacntcatcggctcccaccccgcacgtctcctttcgcgacctcacggcaagtacggggcacacggctgatgctggtgcaggtcggcgccntgcccaccatcggggtgtcaccgcccaggccgccaaggcgtgcttctgacgcacaacacgtggttgggttccgcccggggaaccccgtgcccaaattatccggtaaaattgaagggagtgggctttgcgcccctaagggaagaaattggccccgggcccagaaggggggaaaaaacaaccttttttagggccaaaaagggtctttccccaacccccggaaaccgaaaaaaaaaagggcccccccggggggggggccccaaaactcccaaaccccccccaaaagggccccccggggagagggggccccttataaaaaaaaagaaaatttggggggggggttccaccccacaaaatat

SEQ ID NO: 94215 - protein, 91 aa, Zea mays
  misc_feature: Ceres CLONE 1583856
  misc_feature (69)..(69): Xaa is any aa, unknown, or other
  misc_feature (71)..(71): Xaa is any aa, unknown, or other
MALEAAYDYLHVAVVQCTPTQAAAVLGVLLLLAIRLAAAARSSSATSPKWKQHRLPPTPPGKAPIIGHXHXIGSHPARLLSRPHGKYGAHG

SEQ ID NO: 94216 - DNA, 857 bp, Zea mays
  misc_feature: Ceres CLONE 1583857
  misc_feature: Encodes the peptide sequence at SEQ ID NO. 94217
  misc_feature (49)..(49): n is a, c, t, g, unknown, or other
  misc_feature (804)..(804): n is a, c, t, g, unknown, or other
ggagctcaccgcggtggcggccgctctagaactagtggatcccccgggnctgcaggaattcgtctcacccctagaaaaagaaggcagtctgcagaggggaaggtagccaaagtcagactctgttcatccaaccccaaaaaaaacctacctacacaaaccaaagtcaacgccgaaaaccaagaacaggggaatcctttctctttctccctctagaattcctctcttgcctcctgcgaccatgtccgcgcgcccgccgccgccgccgcgcccgcgtctggcgctgccaccgcgctcaacggcggagtcgctctttacgggcgccggcgacgccagccccggcccgctcacgctcgcctcagggctcttcccatctgatgccgacggcggcggtggccccgagaggcccctcctccctcggtgggccgggggcccccaaccttcacggcagctccttaactggcctcccttcggccggccttccgcagtaagcagctagaattgaaaccccaaaacgggggaggaaggaggggttccccaaaggtccctcccccgaaaacctttttggggggcgcccctcccggggttacacggtttcgccgggggtgcggtccctggttaccggggggggccccccggggagtcgaaaaccaacttatgggttttggtgcgagatcacccccggggggcgggatattttattccggggggaacaatagggggggtattttggtaatttgtcccgtccgcggggggggccaggggggttgcaagatgtagaccaccgatagaaacaacacaagtttntcccccccccccgggaggagtgtgggttagacgctttgatagaagcgagtgtc

SEQ ID NO: 94217 - protein, 85 aa, Zea mays
  misc_feature: Ceres CLONE 1583857
MSARPPPPPRPRLALPPRSTAESLFTGAGDASPGPLTLASGLFPSDADGGGGPERPLLPRWAGGPQPSRQLLNWPPFGRPSAVSS

SEQ ID NO: 94218 - DNA, 951 bp, Zea mays
  misc_feature: Ceres CLONE 1583861
  misc_feature: Encodes the peptide sequence at SEQ ID NO. 94219
  misc_feature (403)..(403): n is a, c, t, g, unknown, or other
  misc_feature (951)..(951): n is a, c, t, g, unknown, or other
tccccgcggtggcggccgctctagaactagtggatcccccgggctgcaggaattcgtctcacccctagaaaaatctccggcctcgcaccgcaaccgcaagcaagcgaagcgcatagtcctgcctgaccagagctagctgagctacgcccaacaacagctggtctgactgacatggcgaaggacatccaggcatctgggccccaggctggcgagttctcggccgatgactacaccgaccctccacaggcgccactggtccacgcggaggatctcacccagtggtccctgtaccgcgcggtcatagacgagttcatcgccactctgctcttcctctacatcaccatggtcaccctgatcgggtacaagctccaaaccgacgcttgggtgtcgaacccccaccccnccctaaggaggcgtcagcatcctcatagatcgcgagtggccatctggcgaaataatcctttaatccccggttactgcacccctcggcatgacaggggggcccacatcaaccccgcggacgtccctcccggccttatcctttgaaacaggaaagggttacccataaatccggcccccacaggggaaaacttcaggggggggatatagcccccgcggcgtccatgctgagggacccaggggccactttgggcaaaaaacccttaggccgaaccccgcccacggaaacaaggcggcccataattcgtcggtgggggggtaccaaataacaacacctctatgagcgatggtctttaaacaatataattgtgacacggaagacttatttcctccctacccctaacatcttctcctagtggagggaaagtggttgcgagcctcgggtggcgggaaaaccatacaagaaacaaacacacaaggtgcgcaaaagaatagggtgtggttggcgtcaccccatcataagtagaattaggagagctcccgccgctgccn

SEQ ID NO: 94219 - protein, 124 aa, Zea mays
  misc_feature: Ceres CLONE 1583861
  misc_feature (78)..(78): Xaa is any aa, unknown, or other
MAKDIQASGPQAGEFSADDYTDPPQAPLVHAEDLTQWSLYRAVIDEFIATLLFLYITMVTLIGYKLQTDAWVSNPHPXLRRRQHPHRSRVAIWRNNPLIPGYCTPRHDRGAHINPADVPPGLIL

SEQ ID NO: 94220 - DNA, 878 bp, Zea mays
  misc_feature: Ceres CLONE 1583862
  misc_feature: Encodes the peptide sequence at SEQ ID NO. 94221
  misc_feature (588)..(588): n is a, c, t, g, unknown, or other
aaagctggagctccccgcggtggcggccgctctagaactagtggatcccccgggctgcaggaattcgtctcacccctagaaaaagcgaggttccccgtcttcgtccgcgctgcaatccaacctggcgccgccgaacccttctctcgcccggtgctgccgaagccgaacccttctctcgcccggcctgccgtagtcctccactccgccggatcctctctcagctcgagcggtcttggagatccgtccgtcccgggatcatttggcgcggaggtttggcctgggaaaatggcaaacatacgtgcacttctggtcggcttatcgcgggcaaggggatccttagcagaggctggacgatgtgcttccacgaggccatcaattctagcatctctgggcgcacattacaagatccccatgccagcccgctggttctcatctacagggcttcctccacatctggtggtcggaatgccagcactatctcctactatgaatcaaggtaacatcgcgaaatggagaaaacaggaaggggacaagatagaggttggtgatgtgatatgtgagatagaaactgataaagccactcttgangttgaaagccttgaagagggggtattggccaagaattttagcccctgaaggttctaaagatgttcaagttggaccaccccattgctgtttaggtttgaagacgttggaggataattaagaggattcccgcctgatacatcctttcggggggtggaccaaaagggaggaagcactcaaccgaaaagggcacccgccaaaacaaaagtaagttaaaggtggtctggaaaccaaaaccccacaaaggggaggccggggattcagcccccgggcagcctaaaatttaaccggga

SEQ ID NO: 94221 - protein, 116 aa, Zea mays
  misc_feature: Ceres CLONE 1583862
  misc_feature (57)..(112): Pfam Name: Biotin_lipoyl Pfam Description: Biotin-requiring enzyme
  misc_feature: SWISSPROT Homolog: EC 2.3.1.12 Dihydrolipoyllysine-residue acetyltransferase
  misc_feature (101)..(101): Xaa is any aa, unknown, or other
MANIRALLVGLSRARGSLAEAGRCASTRPSILASLGAHYKIPMPARWFSSTGLPPHLVVGMPALSPTMNQGNIAKWRKQEGDKIEVGDVICEIETDKATLXVESLEEGVLAKNFSP

SEQ ID NO: 94222 - DNA, 895 bp, Zea mays
  misc_feature: Ceres CLONE 1583863
  misc_feature: Encodes the peptide sequence at SEQ ID NO. 94223
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
ctggagctccccgcggtggcggccgctctagaactagtggatcccccgggctgcaggaattcgtctcacccctagaaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgccatgttaaaaagggtcacccttcccctcggcctcaagagctctgcggttgccgcggccaagggcgtccgtggagaagcgggagcaggtggcggcgatggaagagcagcgggcttcagcctnnnnnnnnnnnnnnnnnnnnnnnnnnnnnnnnnnnnnnnnnnnnnnnt

SEQ ID NO: 94223 - protein, 149 aa, Zea mays; identical to SEQ ID NO: 10768
  misc_feature: Ceres CLONE 1583863
  misc_feature (2)..(134): Pfam Name: NDK Pfam Description: Nucleoside diphosphate kinase
  misc_feature: SWISSPROT Homolog: EC 2.7.4.6 Nucleoside-diphosphate kinase

SEQ ID NO: 94224 - DNA, 825 bp, Zea mays
  misc_feature: Ceres CLONE 1583868
  misc_feature: Translation starting site: 321
  misc_feature: SWISSPROT Homolog: EC 1.1.1.86 Ketol-acid reductoisomerase
ggagctccccgcggtggcggccgctctagaactagtggatcccccgggctgcaggaattcgtctcacccctagaaaaactctctttccagccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtggagagggatctgttcccgctgttaccggaggccttcaagggaatcaaacagatcggtgtaatcggctggggctcgcagggtcctgcacaagctcagaacttgagagactcacttgttgaggcaaagtcagatattgttgttaagattggtctccggaaaggttctaaatcttttgaagaagcccgagcagcaggattcaccgaagagagtgggacgctgggtgatatatgggagactgtatcaaacagtgatcttgttttgctactgatatctgattctgctcaggctgataactacgagaaaatcttctcgcacatgaaaccaaaccgtattcttgggttggcacatggatgtctccttggacattggcatttcctgggttttgatttccctaaaaacctcagggtgggtgcttaatgc

SEQ ID NO: 94225 - DNA, 1075 bp, Zea mays
  misc_feature: Ceres CLONE 1583870
  misc_feature: Encodes the peptide sequence at SEQ ID NO. 94226
  misc_feature (18)..(18): n is a, c, t, g, unknown, or other
  misc_feature (882)..(882): n is a, c, t, g, unknown, or other
ttttttttttcttctttnttcttctccgtcttctttactttactataccccaaacgacgcgcaggaatgagaggggggtgggtcaaaagctggactccccgcggtggcggccgctctagaactagtggatcccccgggctgcttgaattcgtctcacccctagaaaaactctctttccagccacctcactcttcacttgcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccttcttcaagaaggaaaaggtgtccctggccggccatgaggagtatacccccacgggtgagaaggaaatctgttccacgccagtaccagaaggctctcaagggaatcaaaccacaacatgtgttatgctgcttgcggctcgcctggggtacctagcccccagacgcctagaaacccgaataatccctccccttttttccaattcttattctcccaaacgaatgaatacgcgaaagatttggtggccctcctgccaaaaattggccaccataaaagcctctcttggaaacgaaaagaccccgtatgctaagccgggaaggagttcctccccctaaataatcgaatgaggaatccccccctggggagaagaaatattcgtctgggcacagaccctcccatttagagaacagagtaaattattccgagctctagattgcaccaccgcgnaattataagagagtttctctaggtctctatcaaccatcgaacaaccctatccacacaacaaacatcctcatccagcgcgcaggcctgtgaaaaacagtagaggggcgtaattctcacgtgacgtctatgaataacctaccatggagatctattgcgcgaaatgggtcaccactgcataagactccgcacacag

SEQ ID NO: 94226 - protein, 119 aa, Zea mays
  misc_feature: Ceres CLONE 1583870
  misc_feature: SWISSPROT Homolog: EC 1.1.1.86 Ketol-acid reductoisomerase
MPSLDFETSFFKKEKVSLAGHEEYTPTGEKEICSTPVPEGSQGNQTTTCVMLLAARLGYLAPRRLETRIIPPLFSNSYSPKRMNTRKIWWPSCQKLATIKASLGNEKTPYAKPGRSSSP

SEQ ID NO: 94227 - DNA, 841 bp, Zea mays
  misc_feature: Ceres CLONE 1583873
  misc_feature: Encodes the peptide sequence at SEQ ID NO. 94228
ctggagctccccgcggtggcggccgctctagaactagtggatcccccgggctgcaggaattcgtctcacccctagaaaaaggaaatttcatgcgttccttatcttccgttccgctcggaagtctctctaccaccttctccccattccgctgttccgccctctcgcgtcgcgtgcctccaggtccctcctctgcgtaactgggtggccgccgatccgccgccaccgccctgcgtcaggtgttccggtgacaagcgtccacctgtgcccggcctcggcggctgcactgcgcgccgcgggagccagcagccgcttctccaccaaggcgaccgtgccgctttcaagatgttggaataccaaaacgcaattggggggagactgaagctgaagggtaaagcgctccacctaaaggatggtggggtgaagaaaaagaagaagaagtaccagcgtgaggagtcgtctcagattgcgcacgatgagctccacaaaggggggagatctgaatcaccaattgatcccaacaatgagcggattgaatctgacaagaccggagatgaagggaacccacatcctgactatggccatctcacaccagcagagcgacgctacatggaacagaagcagaagatcgacatgcagaagatggccaaagtcgccaacgagtccccatagagaccgcattccaagacttcaaacaagtacctgggcaaacctaagcgagcactaccacatcccccaaagttgggtcccgggcaaacatagcccaaactggcttggggttacgcaacaaaaaattggggggctgggctctaatccattttgggttaaacaaggctaagggatc

SEQ ID NO: 94228 - protein, 108 aa, Zea mays
  misc_feature: Ceres CLONE 1583873
  misc_feature (3)..(109): Pfam Name: DUF1754 Pfam Description: Eukaryotic family of unknown function (DUF1754)
MLEYQNAIGGRLKLKGKALHLKDGGVKKKKKKYQREESSQIAHDELHKGGRSESPIDPNNERIESDKTGDEGNPHPDYGHLTPAERRYMEQKQKIDMQKMAKVANESP

SEQ ID NO: 94229 - DNA, 797 bp, Zea mays
  misc_feature: Ceres CLONE 1583874
  misc_feature: Encodes the peptide sequence at SEQ ID NO. 94230
ctccccgcggtggcggccgctctagaactagtggatcccccgggctgcaggaattcgtctcacccctagaaaactccctcctttcacacccatctcgatcctcccaacccaaaccctagcggacgcgccgctgccatggccgaatccggcgagtcgtccccgaactccgccgcggccacggacgacacgcagcacgagatgccggaggccggagcggctgcgccggcggtgcatgcgcagccgcgcccgccgccgccgccgtccaaggtgcggctgatggtcagctacgggggccgcatccagccgcggccgaacgacaaccagctcgcgtacgtcaacggcgagaccaagatcctgtcgctcgagaggccgctctgcttcccggacttcgccgcgcgcctcgccgcgcttgtggggaacgccgcggacgtccgcgtcaagtaccagctgcccggggaggacctggacgcgctcgtctccgtcaccaacgacgaagatctggagcacctcgtccacgagtacgaccgcctccacggtcatcggcacgccaggggcttcctccgccggctcaggccgcggcggatccgcgccccaggctcaaggtcttccttctttccccggtcagtgggccccgccttcggccggagcggggccgggatcctcgaagccaaattcggagcaacccccaatggtttgtccaattgcgctccaaaacggtccttggtgccccttcgtccaaggaaggaacccgccgcccccgtggcccccgccagcggcaaaaagccggggaccgggga

SEQ ID NO: 94230 - protein, 220 aa, Zea mays
  misc_feature: Ceres CLONE 1583874
  misc_feature (59)..(145): Pfam Name: PB1 Pfam Description: PB1 domain
MAESGESSPNSAAATDDTQHEMPEAGAAAPAVHAQPRPPPPPSKVRLMVSYGGRIQPRPNDNQLAYVNGETKILSLERPLCFPDFAARLAALVGNAADVRVKYQLPGEDLDALVSVTNDEDLEHLVHEYDRLHGHRHARGFLRRLRPRRIRAPGSRSSFFPRSVGPAFGRSGAGILEAKFGATPNGLSNCAPKRSLVPLRPRKEPAAPVAPASGKKPGTG

SEQ ID NO: 94231 - DNA, 820 bp, Zea mays
  misc_feature: Ceres CLONE 1583879
  misc_feature: Encodes the peptide sequence at SEQ ID NO. 94232
ctggagctccccgcggtggcggccgctctagaactagtggatcccccgggctgcaggaattcgtctcacccctagaaaaaactcctctcctctctccccgaaccaaaccaaacccctcccactccaactcctcgattctcagagtgctgtacaagtgtctcgccctaccgcggccgtcaaaaatccgatctttccgccgtttccggaggccacacggctgcaagactgaccaatcccccgcggatcgagccgcagacgccagcagttcctgctcgcggaccgcaggcggggcccggacggagcatggggtcccgatccgccggcgcggcgctgcggctgtggctgctggcgctcctgctgggctgctgccaggggaggttcgtggtggagaagaacagcctcaaggtgacggcgcccgacggcctcaagggcacctacgagtgcgccattggcaacttcggggtgccccagtacggcggcaccatggtcggcttcgtcgcctaccccaaggccacaaggagggctggaagaagctcgaacgacttcgacttctcctacaaggacaagccggggggggttcccacctttcctgctcgtgaaagggggaaattggttcttccccaaaaaaggctggggatttgcccaaaaagcgggggcccgggggaaaccccttgtggggggaaggaaaaaaagaaaaaacccccttttttcaaagggggaacacccccgggagggggggggaccccccgggttttttttaaaaaaaactcctctttttcccccgcggggttttaaaaaccaaaaaaatttttgggggaaa

SEQ ID NO: 94232 - protein, 163 aa, Zea mays
  misc_feature: Ceres CLONE 1583879
MGSRSAGAALRLWLLALLLGCCQGRFVVEKNSLKVTAPDGLKGTYECAIGNFGVPQYGGTMVGFVAYPKATRRAGRSSNDFDFSYKDKPGGVPTFPARERGKLVLPQKRLGICPKSGGPGETPCGGKEKKKKPPFFKGGTPPGGGGTPRVFFKKNSSFSPAGF

SEQ ID NO: 94233 - DNA, 976 bp, Zea mays
  misc_feature: Ceres CLONE 1583880
tcaccgcggtggcggccgctctagaactagtggatcccccgggctgcaggaattcgtctcacccctagaaaaagagtgtgccctcttctcctcctcgcggctccccaagctcctgctccgcgcgcgtagcacgcgcggcacctcccagtcccaacacgcccgcaagctccgctcaccgcaaggtggtgtttgaaccatgaagatagcagaaatgactgcttaccactatcaagctcacgacctgaatcaggcgactatcccgctagctgaatccagttgcttgccgtacaccctctgtggctcaatgggcatagtcctcctgcaaaatgggttaaggttgattttaacctattcctgggggcccaaagttaattgtacttgaggggtgcaaccaattgtcttttggaggaaaatcgaaaccttgaaaacccccccgggggggggggggggggggggggggacccctcacccaagcactgggggccgagaaataaacataaccggggatgttttaaaaaaccctcaacttttacggaacacaaagggggggaaaacagaccccggtgggggcgcgtacccaatatcccccaataaatgggaagaatatatttggtatattaaaggacccttattgttattatacccccacactaacggaaagggggtgtgaaaaaagggggttttaacatatgtaccaccattaaaaaaatagataagagatagagacttcaagttttgtggcagtgaggggtttgtttttgatcccttcctgcaaatttgtattttaaaggaagagttaatgaggcaccctcagggcggcgccaacaagtggaagttcgccccgacaaatatgagacagaaatatttattttgtttcataaacacaaaaataatgacgtgtggcggactcaaacaagaataggaatagaagtgatacctacacaagggagaaaacatcatcgccgatattcacaaa

SEQ ID NO: 94234 - DNA, 1216 bp, Zea mays
  misc_feature: Ceres CLONE 1583881
  misc_feature: Encodes the peptide sequence at SEQ ID NO. 94235
  misc_feature (27)..(27): n is a, c, t, g, unknown, or other
  misc_feature (425)..(425): n is a, c, t, g, unknown, or other
  misc_feature (642)..(642): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (721)..(721): n is a, c, t, g, unknown, or other
  misc_feature (735)..(735): n is a, c, t, g, unknown, or other
  misc_feature (798)..(798): n is a, c, t, g, unknown, or other
  misc_feature (799)..(799): n is a, c, t, g, unknown, or other
  misc_feature (815)..(815): n is a, c, t, g, unknown, or other
  misc_feature (927)..(927): n is a, c, t, g, unknown, or other
  misc_feature (946)..(946): n is a, c, t, g, unknown, or other
  misc_feature (949)..(949): n is a, c, t, g, unknown, or other
  misc_feature (950)..(950): n is a, c, t, g, unknown, or other
  misc_feature (954)..(954): n is a, c, t, g, unknown, or other
  misc_feature (956)..(956): n is a, c, t, g, unknown, or other
  misc_feature (995)..(995): n is a, c, t, g, unknown, or other
  misc_feature (996)..(996): n is a, c, t, g, unknown, or other
  misc_feature (997)..(997): n is a, c, t, g, unknown, or other
  misc_feature (998)..(998): n is a, c, t, g, unknown, or other
  misc_feature (999)..(999): n is a, c, t, g, unknown, or other
  misc_feature (1000)..(1000): n is a, c, t, g, unknown, or other
  misc_feature (1001)..(1001): n is a, c, t, g, unknown, or other
  misc_feature (1002)..(1002): n is a, c, t, g, unknown, or other
  misc_feature (1003)..(1003): n is a, c, t, g, unknown, or other
  misc_feature (1004)..(1004): n is a, c, t, g, unknown, or other
  misc_feature (1005)..(1005): n is a, c, t, g, unknown, or other
  misc_feature (1006)..(1006): n is a, c, t, g, unknown, or other
  misc_feature (1007)..(1007): n is a, c, t, g, unknown, or other
  misc_feature (1008)..(1008): n is a, c, t, g, unknown, or other
  misc_feature (1012)..(1012): n is a, c, t, g, unknown, or other
  misc_feature (1149)..(1149): n is a, c, t, g, unknown, or other
gggggggggcggggggggaaaaagaantccttggcttggtcgctcgtgggcccaccgggcacagagggggcaaagcggggctcaccgcggtggcggccgctcttaactagtggatcccccgggctgcaggtattcgtctcacccctagaaaaaaacggcatagctggagcagcgaagtcttctcggctctcttcgcccccactgccgacaaataaccgccgcaattcgaagcaagagagccgccccaggagaacatatagtgagactgagagcccgaggagggggtggcgcgatggggctctcgggcgcgacgatctcggcgccgctcggctgctgcgtgcttcggtgcggggcagttggcggaggtgaggccctgaaggcggacgccgagaggtggcggcgggcgggatggagccgacgcgttngcgaaccgaaggtgaagtgcgtggcgaccgagaaacagaactagacggaggcggcccgagcggctaggggcttggatttggcggacaaagtaggaaagcctcattggatggcggggggcgagactgcgcggagcgtgggtagggtagggcgcccaaagcgccttggtgaaaggacaggtcacaaaggatcgcatgccaaagcttaggctggcggagngtctctgatgttgnnntgtcaaataggatcagtaatgagaggcgactaccaggcgggcgtgcgagccgtcacagggacnagggacaagatggngcgttcgaataccccttctatgtaacaggcaagagacttaagagcaaggaataaaaagatgannggcgttcaaatagagncgaaaatgatatttgccgttcggtgaataggacacgacaagtatccgatgcgtccatatggagggcgcgttctatagaatttgcggtattcgctatacttaatgcgccgggnatacggtataatatcgcgnggnngggngncggcgtacaggactgtctgctaacgataccaaatagtgnnnnnnnnnnnnnnggtngtcgattgcagaggtggaggagaggattatgtacgcctggggccggaggtatatatcgtgggcatatgactgagagttgtgcgtcgcacctaacgggtatacgagatagggcacggtcatgactcactagacagcgncgctcaagatcgcgacgatatgggtaggttatgtcatatagtggaattgtgcgcacgccgtgatgag

SEQ ID NO: 94235 - protein, 58 aa, Zea mays
  misc_feature: Ceres CLONE 1583881
  misc_feature (45)..(45): Xaa is any aa, unknown, or other
MGLSGATISAPLGCCVLRCGAVGGGEALKADAERWRRAGWSRRVXEPKVKCVATEKQN

SEQ ID NO: 94236 - DNA, 2329 bp, Zea mays
  misc_feature: Ceres CLONE 1583883
  misc_feature: Encodes the peptide sequence at SEQ ID NO. 94237
acttctgcttctccaaaccactcgcatttccacatcaacatcaacacgaggccctgccgccgccgccgcccgcccgccccctcctaaaccccgcgacgacactgagcgagccgagccccggcgaccaaccatggccttctccgctaaaccccactgctcctgctccaccaccaccaaaccccccacccccgtcgcccacctctctccacccccctccctctccgtccgcgccgccgcctgcgccccgcgctccgcctatggcctctccgccgccggcgtgggcggcggcaaggcgtcccccagcaccgttcgcctccgcgcgcgggcccagcgcatccgcgcgtcgcagcagcagccgcggcggcgccctgaatacgtgccgaaccgcatcgacgaccccaactacgtgcgcatcttcgacaccacgctccgcgacggggagcagtccccgggcgccaccatgacgagcgccgagaagctcgtcgtcgcgcgccagctggcccgcctcggcgtcgacatcatcgaggcagggttcccggcctcctcccccgacgacctcgacgccgtgcgctccatcgccatcgaggtcggcaacccgcccactgccagcgctgggaccgtccacgtgcccgtcatctgcggcctgtcgcggtgcaacaggaaggatatcgacgccgcatgggaggccgtcaggcacgcgcggaggccccggatccacactttcatcgccaccagcgagatccacatgcagcataagctcaggaagacgcccgagcaggtcgtcgctattgccagggagatggtggcgtacgcgcgcagcctcgggtgccccgatgttgaattcagccctgaggatgccggcaggtcaaatcgagaattcatgtatcatatactggaggaagtcattaaagctggagcaaccactcttaatatcccagacactgtcggatacactcttccttatgaatttgggaaattaattgctgacataaaggcaaacacttctggaattgaaaatgctatcatttccactcattgccagaatgaccttggtcttgcgactgccaacacattagcgggtgctcgctcaggagcaagacagttagaggtgactattaatggtattggtgaaagagctggaaatgcttcattggaagaggttgtcatggcaattaaatgtcgtggggagctcttagatggtctatatacgggaattaattcccagcatattactttgacaagcaaaatggtacaagagcatagtggacttcatgtgcaaccacataaggctattgttggtgccaatgcctttgctcatgaaagtggaattcatcaggatggcatgcttaaatataaaggaacatatgaaataatatcgcctgatgatattggtttaacacgtgcaaatgaatttggtattgttcttgggaaactcagcggaaggcatgcagtgagatctaagctagtggagcttggatatgaaatcagtgacaaggaatttgaagatttctttaaacgctacaaagaggtcgcagagaagaaaaagcgtgtaactgatgaagacatagaagcgttattgtcagatgagatattccagcctaaggttatttggtcccttgctgatgtacaggcaacatgtggaacacttggcttatctacagcaacagtgaaactgatagcaccagatggagaggagagaatagcatgttcagttggaacaggtccagttgatgcagcttacaaggctattgaccaaataatccagatcccaactgttctccgagaatacggtatgacctcagtcaccgaaggcatcgacgcaatcgcaacaacccgggtggttgtcaccggagatgtgaccaacaactccaaacatgccttgactggccgcgctttcaaccgctccttcagcgggagcggggcagcaatggacattgtcgtctccagtgtcagagcttacctgagtgccctgaacaagatgtgtagctttgctggtgccgcgaaagccagcggcgaggtacctgagagtgcaagcgtccaaagcgcagagtgagcttggcgacaatttggttctcatgtggactgggcggcgtaagagccagagcaactgttaaagagggtgacatttcgtttttgtattaggctgttcaatgatgggggttttgccttgtcagtgtggtgattgtgctgttcttttttgggaggatagcccagcttggaacgtacaggcaattttggacctaggtagtgtacaatttgtatcttatatgaacaatacttccaataatcgaaagacttaagatgggttgctgaaaaaaaaaaaaaaaaa

SEQ ID NO: 94237 - protein, 640 aa, Zea mays
  misc_feature: Ceres CLONE 1583883
  misc_feature (101)..(380): Pfam Name: HMGL-like Pfam Description: HMGL-like
  misc_feature (473)..(618): Pfam Name: LeuA_dimer Pfam Description: LeuA allosteric (dimerisation) domain
  misc_feature: SWISSPROT Homolog: EC 2.3.3.13 2-isopropylmalate synthase
MAFSAKPHCSCSTTTKPPTPVAHLSPPPSLSVRAAACAPRSAYGLSAAGVGGGKASPSTVRLRARAQRIRASQQQPRRRPEYVPNRIDDPNYVRIFDTTLRDGEQSPGATMTSAEKLVVARQLARLGVDIIEAGFPASSPDDLDAVRSIAIEVGNPPTASAGTVHVPVICGLSRCNRKDIDAAWEAVRHARRPRIHTFIATSEIHMQHKLRKTPEQVVAIAREMVAYARSLGCPDVEFSPEDAGRSNREFMYHILEEVIKAGATTLNIPDTVGYTLPYEFGKLIADIKANTSGIENAIISTHCQNDLGLATANTLAGARSGARQLEVTINGIGERAGNASLEEVVMAIKCRGELLDGLYTGINSQHITLTSKMVQEHSGLHVQPHKAIVGANAFAHESGIHQDGMLKYKGTYEIISPDDIGLTRANEFGIVLGKLSGRHAVRSKLVELGYEISDKEFEDFFKRYKEVAEKKKRVTDEDIEALLSDEIFQPKVIWSLADVQATCGTLGLSTATVKLIAPDGEERIACSVGTGPVDAAYKAIDQIIQIPTVLREYGMTSVTEGIDAIATTRVVVTGDVTNNSKHALTGRAFNRSFSGSGAAMDIVVSSVRAYLSALNKMCSFAGAAKASGEVPESASVQSAE

SEQ ID NO: 94238 - DNA, 990 bp, Zea mays
  misc_feature: Ceres CLONE 1583884
  misc_feature: Encodes the peptide sequence at SEQ ID NO. 94239
  misc_feature (855)..(855): n is a, c, t, g, unknown, or other
  misc_feature (856)..(856): n is a, c, t, g, unknown, or other
tccccgcggtggcggccgctctagaactagtggatcccccgggctgcaggaattcgtctcacccctagaaaaaacttactgggtcctcactcccacaccaaccaagccacctcctctgcctgccgcattctcctgctgctgggcggtcacggctgcaagtactagaggaggacatccgcttccattactgcgcctgcggaggatcggacgaaccagtagcggaggcttcgattttcggcgggcgcaataaatttcccgcatggctcggaaggccgcgtcctcgctcgtctcccgctgcccccctggcgagggccccctgccgggcgcgccgccccgctggcccccctctgacgctggcccagggaaagtggccctggcagaatggggatggcaccaaggcctgtttggccaggggggcccccccccaaaaagggttttaagccacctgggacttcctagcccatatttggaagggggaggcccccttttcccccccccccggtttacagttcaccccgggtgtgggaaaacaccaccaccagaaaaaaggggcccccccccccccggcctttaggaagggggggccaaaaaacccattttttgtatttaaagaaaatattttcccccccacgaaaaaatccctcgcggggggcgagaaagaagaaaaatcacttttgttgtctcccccacacaaagaaatcctcgggggggggaaacaccccccccccccccccttttttaaaacatctcggggtgggtaataagaggggagaatagattctttccactcccaaatagggggggggcccgctctataggggggggggggccccccgcccgcgcgaggggcgagcnntttttttttcaccccccggtccccaatgaatgaaatgtaggcgccgcgtgttcgcgcaaaagaagaggccttttttttttagaaaaaagggggggggcccgccggggtgcacaaaaaaataaacaaaaaaccag

SEQ ID NO: 94239 - protein, 104 aa, Zea mays
  misc_feature: Ceres CLONE 1583884
MARKAASSLVSRCPPGEGPLPGAPPRWPPSDAGPGKVALAEWGWHQGLFGQGGPPPKRVLSHLGLPSPYLEGGGPLFPPPRFTVHPGCGKTPPPEKRGPPPPGL

SEQ ID NO: 94240 - DNA, 836 bp, Zea mays
  misc_feature: Ceres CLONE 1583886
  misc_feature: Encodes the peptide sequence at SEQ ID NO. 94241
  misc_feature (73)..(73): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (132)..(132): n is a, c, t, g, unknown, or other
  misc_feature (134)..(134): n is a, c, t, g, unknown, or other
  misc_feature (136)..(136): n is a, c, t, g, unknown, or other
  misc_feature (138)..(138): n is a, c, t, g, unknown, or other
  misc_feature (141)..(141): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (152)..(152): n is a, c, t, g, unknown, or other
  misc_feature (155)..(155): n is a, c, t, g, unknown, or other
  misc_feature (165)..(165): n is a, c, t, g, unknown, or other
  misc_feature (179)..(179): n is a, c, t, g, unknown, or other
tggagctcaccgcggtggcggccgctctagactagtggatcccccggctgcaggaattcgtctcacccctagnaaattttgtgcctgcgccattggggcctgtttggagannnnnnnnnnnnnnnntnnnancnancnctnannnnnnaacnaanacaaaactancctcagcaacaacncaaactcccaccacaaccaacaccacaccatccaagcaatggcagagatgaccaaaacactgtccaccaccggcgcggcgctccggacccccgacacgcagcaaccggcggcagcgggcgcggccaagggcaccaactctgagaagctccggttcatggaggacatgacctccaacctgtacgccgtgcaggagctcgtgctgggggagatcctcccccgcaacggcggacaccgagtacctctacagcaagggcggtctcgtcggtgctacagatggcgccaccttccgcacgatggtgtctatggctacgtacaaggacttgcaagcggaaatcaggcgcatagcccacagtcgatgctcgcctattcctgtcggggcaccccgtccccaaagttgatataagcttcagctagtccggcggaaagcagaaaacttatgcccaccattgaggacaagattaaccccccaccaaataggtgtaaaaacgtacataaggcacggtatataaacctggtacgagcgattcggaaaggacaagcgcggtaaaactctctcaatctccataattactgttcaagtcgtaagacaataagaagacaagaggaacggccttcctagggcaactggcgccgtgcacttacgacaagtgatgccg

SEQ ID NO: 94241 - protein, 121 aa, Zea mays
  misc_feature: Ceres CLONE 1583886
MAEMTKTLSTTGAALRTPDTQQPAAAGAAKGTNSEKLRFMEDMTSNLYAVQELVLGEILPRNGGHRVPLQQGRSRRCYRWRHLPHDGVYGYVQGLASGNQAHSPQSMLAYSCRGTPSPKLI

SEQ ID NO: 94242 - DNA, 967 bp, Zea mays
  misc_feature: Ceres CLONE 1583889
  misc_feature: Encodes the peptide sequence at SEQ ID NO. 94243
ggagctccccgcggtggcggccgctctagaactagtggatcccccgggctgcaggaattcgtctcacccctagaaaaaacacaccttccgtcccccggcctccgctcgcctcgccgcccgcctgtccctgtctgtctctctctctcctcgctgagtcgccgccagccatgaacaacctcctcacggattcctttgagctcccccggcgggactcctcaagagatgcagacattgaaatgggaatgcatcaagctgatgcttcagacaacttaaaagatttcttgaagaaagtcgatacaattgagagtttaattgcaaagctgacaaatctattgaataagctacagactgcaaatgaggaaatccaagggggttaccaaaagcaagtttccatgaaaagcaatttaaccccccggatgggagaaaaaatatttgttgaaagtggggggaaaaatttttttctctccgggggagaaaaaaaaaatttgggttgaattttggaaaaaaaaaaccaaccttttttctatatttgggggaaaaaaaccccttgggattttgtggggaaaaaagggttttttttccctcggggggcacccgggattttaggagagaagcgcgaagactccttcctgtgtggtggcgcccccggtttaaaaaaaaaaaaaaatatttgtgtaggggggggcggcgccccaggggggggtaaaatttcttttttaccaccaccccccttggggaaaagagaaaacaaacattggttgggccacacgagaaatattgtctaggggaggggggggtttgtttataaaaaaaaaagagggttttgttttttccccgtaaagaggagggggtatacaccacctctccggttagagagagaagagagaatagatattttcggggcgcccccgcacccgtagccccgcgcgcgagaaaaaaaggctggatcgggataaaggcggtctta

SEQ ID NO: 94243 - protein, 108 aa, Zea mays
  misc_feature: Ceres CLONE 1583889
MNNLLTDSFELPRRDSSRDADIEMGMHQADASDNLKDFLKKVDTIESLIAKLTNLLNKLQTANEEIQGGYQKQVSMKSNLTPRMGEKIFVESGGKNFFLSGGEKKNLG

SEQ ID NO: 94244 - DNA, 853 bp, Zea mays
  misc_feature: Ceres CLONE 1583891
  misc_feature (853)..(853): n is a, c, t, g, unknown, or other
ggagctccccgcggtggcggccgctctagaactagtggatcccccgggctgcaggaattcgtctcacccctagaaaaaaaaccgatgcagtgaaacagatggcttgaccggttccatatgcggcggcggcacacgccatacagcagggaaagcattcgccgcagacccgtggtagaagaagagggtgagaccagtccatctatttctagctatccatcttctatatatatacgcagttatattatatggccaattagatagagattagagagggagctgggaatgaaattttgtacagggaagagagagagagagggtagttgatgggaagggtttgatgtgactgccctttcttttcgctttgcttcctggatccaactgccgccgccgcatctgtcttcgttgattcggtgttcttcgatcggatgcctttatctgcctagatcggagcaagagcaaagcgcggggtgtaaatcctgagaggaggaagagaatgaggagaggatatccataccggctccccccgtcttgcttgtgctttggcggtacggttcttgtaagaacccgcagctgccgcgtccgggttcttttcaagaacccgctgcgggggatgggtctgtaggaaaagggacagggaccggccctcggcaggaggggggactcccgccctgggtttcccggggctttccttgggcgggatgccaacttccacactgcgcgtggggggtgtatgggcctccctcggaaaggcccccagaacggacaatgggacttggccccccgaatataagtcccacggaacttgtgcgccagcaaacacctggggcaaagcggggtattgggggggccgccn

SEQ ID NO: 94245 - DNA, 1265 bp, Zea mays
  misc_feature: Ceres CLONE 1583894
  misc_feature: Encodes the peptide sequence at SEQ ID NO. 94246
  misc_feature (8)..(8): n is a, c, t, g, unknown, or other
  misc_feature (19)..(19): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (89)..(89): n is a, c, t, g, unknown, or other
tgtgtgtngggtttccttntctaccgtttcattgctccgcggggtgtgagtgcggtnnnaagannnnnnnnaaaagctgggactccccncggtggcggccgctctagaactagtggatcccccgggctgcaggaattcgtctcacccctagaaaaatctccccgcctccacccacggcactcgcaagcaccgctcattagtcactagggttttaaactttccccccgatccgcctcgccgccggcgtcgtcctccgccggaaatccaccaccctacacccagccggagacgactatggtgggttccggctcgatggcgggctacgggatcccgtcgatgctcaaggaatgccaccgccacctctccgggctcgaggaggccgttctcaaaaacatcgacacctgccgccagctgtccggcattacgcgcacctctctcgggcctaagggaatgaacgaaatggttatcaatcagtgtggaccacctggttgtcacaaaccatgccgccacccattggccaagcacccccgaagtgcagcaactctgcgagctaaaattcctggtactgggctggggaacgggactcaaccgggaagaagatttgggggaatggggggcccaagcactcaccaattatggaaaaagcccgggcgaaaaaatacacataaagcaaaccgttgtaagggaaaccctcacatagaggggaaggggcgcccttcaacccctccaccacacgggaaaaaattataatgtatgagggggggttgtaacaacctctaacggggagcccacgcggttggatgaccaaggcggactaacatctgtgtgttcggtgtctccccctgggcagaaaatagatagtctcatattggaggtttacaactccaatagggcactttccgacatcacaacaacaaactcacaaggctcaccgcgagccacatataacaacccaacattacgcagggtgctgccggactcgccgtgattgttccgcagcaccggagatagaatattaactctcagccgctcagtccgccccccccgtcgtgcctactcaagagatagtcttatagaggggtctcgagtgagggagcgaccgctctccatatggggtctgcccccccctctctaacgaggagtggggcgcgcggagtgccctcctgcgcgctatatatagtatagagtgattctgggcgccccccgcgcaacaagaagaccgtcgcgtcgcaaagacaccttatggcccgaggagttcctgtggt

SEQ ID NO: 94246 - protein, 151 aa, Zea mays
  misc_feature: Ceres CLONE 1583894
MVGSGSMAGYGIPSMLKECHRHLSGLEEAVLKNIDTCRQLSGITRTSLGPKGMNEMVINQCGPPGCHKPCRHPLAKHPRSAATLRAKIPGTGLGNGTQPGRRFGGMGGPSTHQLWKKPGRKNTHKANRCKGNPHIEGKGRPSTPPPHGKKL

SEQ ID NO: 94247 - DNA, 832 bp, Zea mays
  misc_feature: Ceres CLONE 1583896
  misc_feature: Encodes the peptide sequence at SEQ ID NO. 94248
gagctccccgcggtggcggccgctctagaactagtggatcccccgggctgcaggaattcgtctcacccctagaaaaaaaatggcagccaagccataataataatataataatagtaatcgatggggtctcacctcctcttgccgttcctcctgctactgtcctcaccatatgtgcaagctcaacagagaatcaccttgggctcctccttaacaacccaagggcctaacagcttttggctctccccttctggtgactttgcctttggcttccggtccatcgagggcaacacctcctcctacttgctcgctgtctggttcaacaagatcagcgacaagacagtggcatggtatgccaagaccgctgatccagatccagcgctggtacaagtttcatccggttcatgcctcgagctcacgtccagtggagcgctctcgctccaggaccctactggcaaagaggtatggaatccagaagttgtgagtgcagcctatgcttccatgctcgatactggaaacttcgtactggctgctgcagatggctcttccaagtgggggaccttcgataacccagcagacactattctgctcactcaggtgctcacccctgaaaacaagctccacagccggaacattgccacagactactccaatggacggttccaccttaacctgcaaaataatggtgttttcttctatgctactgctgtgcaatccgatcctcaacatgaatataattggtccatgcctgggaaaccccacaaattgggtattcaatgcgactggcattgaaatacatcaccttgggataatggaacaaccaggtaaaattcca

SEQ ID NO: 94248 - protein, 222 aa, Zea mays
  misc_feature: Ceres CLONE 1583896
  misc_feature (71)..(182): Pfam Name: B_lectin Pfam Description: D-mannose binding lectin
MGSHLLLPFLLLLSSPYVQAQQRITLGSSLTTQGPNSFWLSPSGDFAFGFRSIEGNTSSYLLAVWFNKISDKTVAWYAKTADPDPALVQVSSGSCLELTSSGALSLQDPTGKEVWNPEVVSAAYASMLDTGNFVLAAADGSSKWGTFDNPADTILLTQVLTPENKLHSRNIATDYSNGRFHLNLQNNGVFFYATAVQSDPQHEYNWSMPGKPHKLGIQCDWH

SEQ ID NO: 94249 - DNA, 807 bp, Zea mays
  misc_feature: Ceres CLONE 1583897
ctggagctcaccgcggtggcggccgctctagaactagtggatcccccgggctgcaggaattcgtctcacccctagaaaaagtcccctccaccaaaaccgacgacgacgtcgctctcctccaccggtgctcggcgctctccctccaccagcggcggtccacagacgctcggcgagctccaccggcgggcgctggcggctggtcagatccgctcggcagtcatccacctggcacatcgggtagctcgcgcctccgttggcagtcccaccgccgcccggccctcccccagcgcccccggtgatccggaccgcacccgcttgctcggcctaacgaccggctcctgccccgccgcagccgaagctcccagcgtcctcctgcaggccgagctgaaggttcagcgcgccggtggagttcgacgacgaaactccgtcacgtcatacctctccgcctcccgtcttccagacgtctctaatcggggtcccagcgtctcggagaagaggagcagcacggcacggcagctgtggcgaggaaggctcctgtcccatcccaacccagttagcagccgcccaaggaggaggagatccaatcggcgtgcgggcgtccgcggtccatccatcgatccaattccaatctgcaggagtacacttggtcaaaatctggttgtctctagagcgagcgacaccaatctttggtgttggccctttcgtcagtgagtagcatccttctggtacaggtgtatggtaattgtgaagtaacaaaggatttggaacccagccctctgttctccacagcgcttcgaagatgccgca

SEQ ID NO: 94250 - DNA, 936 bp, Zea mays
  misc_feature: Ceres CLONE 1583898
  misc_feature: Encodes the peptide sequence at SEQ ID NO. 94251
  misc_feature (44)..(44): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
gcccttttgcagaccgcacaaggggcgggagggacccgtactcnaaagtacaagctataagcagannnnnccaagctggactccccgcggtggcggccgctctagaatagtggatcccccgggctgcaggaattcgtctcacccctagaaaaaaaagttctcccttcccctctcgcttcgcttcgccaacgcctgcgagagctagggtttcgtgcgccactgccacttccggtcttccgcccgccatggccgaggcccccacgtatcagatcctggtgcgtctcctcgacgggcgcaccacatgtcttcgcttctccacgcccaccgtctccggcgccgtgctcctcgaagctgtcgcgtctatatctcgcgtccccgccgccgccctccgcatcgtcaccggccgcttcgacgtctcgccctccaacgtcctcacctcatcagctgatggccagttcccctccgcctccgcgctcctccgccttcgaggaggcaagggcgggttcggctccctcctcagaggggccgcctccaaggcggggcagaaaaagactagcaactttgacgcctgccgcgacatcaacggtcgccgcctccgccacgtcaacgctgagcgccgcctcgaggaatggaaggccgaggccggggaccgccatctagaaaagctcgccgagaacttcatcaagaagaaggccaaggaggcgggccgccgcggcgggaccctcagcctgctgaggtggaaaagtaccctggagaagtaccgccaaggatgctggaaatctgcggtcaacgcgggttggagggaatccgtaacgtccatcttcttgggaaaggagggaagaaccgccccctaaacccgcgccttctggccgccggaacgcctaaaaaaagctttaaagaattctgggtttggggaaaaagaaacacaagttagga

SEQ ID NO: 94251 - protein, 202 aa, Zea mays
  misc_feature: Ceres CLONE 1583898
MAEAPTYQILVRLLDGRTTCLRFSTPTVSGAVLLEAVASISRVPAAALRIVTGRFDVSPSNVLTSSADGQFPSASALLRLRGGKGGFGSLLRGAASKAGQKKTSNFDACRDINGRRLRHVNAERRLEEWKAEAGDRHLEKLAENFIKKKAKEAGRRGGTLSLLRWKSTLEKYRQGCWKSAVNAGWRESVTSIFLGKEGRTAP

SEQ ID NO: 94252 - DNA, 876 bp, Zea mays
  misc_feature: Ceres CLONE 1583901
  misc_feature: Encodes the peptide sequence at SEQ ID NO. 94253
gcggtggcggccgctctagaactagtggatcccccgggctgcaggaattcgtctcacccctagaaaaatttcgtcgcaatcctcaaaaagggaagacatggcggcgagcgcactgctgacggggtcgccttggctgcgcatgcgcctcctaccggacgcgcccgcgcgccccttccgccacctccacctccgccggagcttctccgtccgcgcctccggcgccgacggcagccccgcccccgtccgcgtccgcttcgcgccgtcgcccaccggcaacctccacgtcggcggcgcccgcaccgcgctcttcaactacctcttcgcgcgctccaaggggggccgcttcgtgctccgcgtcgaggacaccgacctcgagcgctccaccaggaagtccgaggaggccgtcctcgccgacctcgcctggctcggtctagactgggacgaaggtcccgatgtcggtggggattttgggccttatcgccagtcagagcggaactccctgtacaaacagtatgctgagaagcttttggactctggtgcggtttaccgctgcttttgctccagcgagcaactcgagcaaatgaaggaagtcgccaagccgagacaacttccctcctgtgtatttgggggaagggggcaagtggcttcagatgcccgaagtccaaccggagtttagaaaaaagggacacccttaccccttacccgttttccgtggggcccaaagaaagggggcttttgaaaaattagggacccttaatctccggggggagaggctcgtttgggaacttttaaccacccccctggggggattttccgggaatttttggagaaagccatggggccagccctgtggggattaaacttcttgcgggggga

SEQ ID NO: 94253 - protein, 192 aa, Zea mays
  misc_feature: Ceres CLONE 1583901
  misc_feature (48)..(193): Pfam Name: tRNA-synt_1c Pfam Description: tRNA synthetases class I (E and Q), catalytic domain
  misc_feature: SWISSPROT Homolog: EC 6.1.1.17 Glutamate--tRNA ligase
MAASALLTGSPWLRMRLLPDAPARPFRHLHLRRSFSVRASGADGSPAPVRVRFAPSPTGNLHVGGARTALFNYLFARSKGGRFVLRVEDTDLERSTRKSEEAVLADLAWLGLDWDEGPDVGGDFGPYRQSERNSLYKQYAEKLLDSGAVYRCFCSSEQLEQMKEVAKPRQLPSCVFGGRGQVASDARSPTGV

SEQ ID NO: 94254 - DNA, 936 bp, Zea mays
  misc_feature: Ceres CLONE 1583902
  misc_feature (262)..(262): n is a, c, t, g, unknown, or other
  misc_feature (849)..(849): n is a, c, t, g, unknown, or other
aagctggagctcaccgcggtggcggccgctctagaactagtggatcccccgggctgcaggaattcgtctcacccctagaaaaaagttccagagccctccagagcaaaaaaaatatattatcgaatactaaagcattttcctcatcgatagaatatagaattttaaaaagggagcgaaataggtttttcctttttgcagctccgtcgtccaacaacctcctccgatccggccgccgcagcgtagccgaattggtccctcgctnagcttctccgggccgggctaaaggctggtttcagggcggcctccaatctcctccggggcgggctggaagaaagaagaatcaccgcggtttggctcaaggggccttggggggcttcccttgatggggattttgggttggttcccaatgggaaaaccccggggtaaaccccccccgggggggggaggaaacccttttttccggccaaaaaaaaaatccccgcccttgggttccggcccccccccccccccgggggttttcttttatagaaaaccccccacggcccccctgcgggcccgtgtgtggtgttttttggggggtacgggggggggaggaaagggcccccccccggaggggctttttttggtttacacaaaataacaacaacaaaagaaaacgccacccaaaagaaaaaaaaaaaacaatatgttcctcctgcgggattataaaagcgcggtgtgttttgtttaaagggggagaaaaaaaaacctcccccccacaatgtgtgggggttcgaattgtatcttcgttgtgtagattgagaaccacctagggggagggtttctggtgaggagggggggcacaaatantttttctaacaaaaaaccacccaccggagatgtctttgtatgaccctgcccggagagaaataaaatactttctcccctctcccacag

SEQ ID NO: 94255 - DNA, 929 bp, Zea mays
  misc_feature: Ceres CLONE 1583905
  misc_feature: Encodes the peptide sequence at SEQ ID NO. 94256
aagctggagctccccgcggtggcggccgctctagaactagtggatcccccgggctgcaggaattcgtctcacccctagaaaaaattcgacgaggtcacgactcacgaggggactcccgagcgcacgcgcgaatcgccgcggacctcgccggaggcggcgacgagctcggatcccggcgatctagtcgccggaggcggtcccgatggctcggcggtcgtcttcctcgtcgtcggggacctggcggtacctgaacccggcgtactacctcaagcggcccaagcgcctggcgctcctcttcttcgtcttcgtcgcggccaccttcgccttctgggaccgccagtcgctcgtcagcgagtacgagtctgagatttcccgattagaagatgatataaatcggttgcccccccacctaacaaaggctggagttaatctggatgaaaatccagtagtaagcaataagaattccagaaaagatcttgtaggtagaaattgatccctgtccattatgaaagaccgggaaaaaaagttaaagagggcaatgctccctggcttggaaattctttatgtttaagtatggccctggggggaaatggaacgaggctttcagcccaacaatccgaaaggaatgggttatcaaccagccttttgggtgggccttttggaagccacccccttgggttggactcccctttggattccccctttaacataaatggggcgctggaaaaagaatgaaattttccagaaaagccttggaagaaccgggggtggggcgggaagtccattttgaacctttggaaccaagggaattttttgatgggcggagggtgtttttttgaaaaaccgacccactaaaggggttttgtttgggagagggcctgcccttaaatttccaaaaccgaatcctaattcctggggggagataaaag

SEQ ID NO: 94256 - protein, 96 aa, Zea mays
  misc_feature: Ceres CLONE 1583905
MARRSSSSSSGTWRYLNPAYYLKRPKRLALLFFVFVAATFAFWDRQSLVSEYESEISRLEDDINRLPPHLTKAGVNLDENPVVSNKNSRKDLVGRN

SEQ ID NO: 94257 - DNA, 896 bp, Zea mays
  misc_feature: Ceres CLONE 1583906
ctggagctccccgcggtggcggccgctctagaactagtggatcccccgggctgcaggaattcgtctcaccccctagaaaaataattcgcattcagctttttcatttttaaaaccgagcgtgacatgaatgctctagatggagcacacctagtacttgtttgagcacgtcgcctaataaaattccccattccaatacacagatctggcacccgtaagtggcgacgaatctcgcggtgcggaggcgcgacagaggcggtgtctactccgacggactcgcagccaccggtggagacgccccaccagcgcactcctccaacgttcatagtttaagggcttgatttggataattagtcatcaacagaagcgataaaaaatggtggttcttacgagatcaatcgcttcaaagtcgggaaaagcacttggttgaagacagttcgttgacatgtctcgcataagaattgaaggattacttgctgcgttcccaaaactggttggaactggagaagcagcacacttatgtcgatactgaaaatgtgcgatatgtttatcaacctattgaaggtttatatcttctacttctcgcagacatgcagagccatattcttgaggatatgggacactttgagggcttcttctccaaggtcgtgcctggaatactcccccttcaatgggatgaggaagagtactttgtgaaaacaacatttgaagaatataatttgctttcgaaggagaccttatccgctttgggaaacaagggaaaattttaaccagtgaaacaaagatcaacccaattatggtggatcaatggaaaaccccctgaaagaagaaaggccttcccaaccttgaatgactccaggaaccaaaaaatcacttggaaacccccaggggatcttcct

SEQ ID NO: 94258 - DNA, 859 bp, Zea mays
  misc_feature: Ceres CLONE 1583907
aaagctggagctccccgcggtggcggccgctctagaactagtggatcccccgggctgcaggaattcgtctcacccctagaaaaagatgaagctgcaaaccttccggagcgggggcgaagcataggcagccagaggagagggtacgcgagagcgtgattgcaccgggagctggtggcggagctgagccgggccggattaggatcagctaaactaatctcacaaaaactggccacgcaaccttgaaggctcgatcacgcgagctgagagagcggaggagtccgctcggaggggaggaaagggcggagggaagaggagacggagcgaggagtccggtttctgttgagcggaaaccgtgtagagattagatttttagatctaacggacttgcacgctttataagtctgcccaccacacgatctaactcgagtcgagtcctcttctatttgagggaacgatcaaatacgcgtacacggccggtatccacagcgccggcacggcgcacctcctctcggagaatcgaagccgaactgggcggcgggcgtaatggatctgctgaagcgggaactggagaagaagcggaaggcggcgacggccgacttcgggggcaaagacttcgtgcggcgctccgagctggagcagaagcagctccagaagccgccgcgacgaagcacggcagctcctcggccagtccggcacttcaggggccctccgcggaattccgccgcaacctgctaacgggtttccgaccccgggaaccctcataggtcccagactccaaacggggggggcgggcgaacccctaaacccttgaggttccttgggcctgccggccaaccttatttgaggggaccccttacgc

SEQ ID NO: 94259 - DNA, 825 bp, Zea mays
  misc_feature: Ceres CLONE 1583910
  misc_feature: Encodes the peptide sequence at SEQ ID NO. 94260
  misc_feature (684)..(684): n is a, c, t, g, unknown, or other
aaaagctggagctccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcggggcccgggcggcttcntcgccttcgtcggcaacctccctcttcccttttatcgcgttcgctgggcctcttctttctcttccgcccccgcgcagggacgggccccgggcgccggggcctgggggggcctcggcggggccccaagtacttccggcccgg

SEQ ID NO: 94260 - protein, 222 aa, Zea mays
  misc_feature: Ceres CLONE 1583910
  misc_feature (176)..(176): Xaa is any aa, unknown, or other
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGRLXRLRRQPPSSLLSRSLGLFFLFRPRAGTGPGRRGLGGPRRGPKYFRP

SEQ ID NO: 94261 - DNA, 819 bp, Zea mays
  misc_feature: Ceres CLONE 1583913
  misc_feature: Encodes the peptide sequence at SEQ ID NO. 94262
ggagctccccgcggtggcggccgctctagaactagtggatcccccgggctgcaggaattcgtctcacccctagaaaaaatagccttcccattggaaagcgaacgctcacagctcacagctcacgcacccatccacctccaaagtccaaaagcggaacccacgcctgccgcaacggcgaaaccgtcggaaccctagatctctctcgcccgcgctccgaaaccccagatccgccatgcaccagcctagagctcgctacccacccggctatggctccggcggtggaggcggagccggacgtggcggtggaggcggaaatggaggaggtggcggcggcggtggcggaaaccacaactactacggccgaaacccgcagcaacaccactaccaccagcagcagcagcagcagcagtcgcagcactctcataggaactcttcgtaccagcaacagtggctgcggcgagaccaggcccccgccgttgcgggggcagcgtccggaaacgctgtggccaagacggcgtctcagcttgacgccgtaggctcgagctcccaagactggaaggctcaactaaatataccagctccagatacacgctacaggacagaggatgtcactgcaacaaaaggcaatgagtttgaagattatttcttgaaacgtgaactgcttatgggaatctacgaaaagggatttgaaagaccatctcctattcaagaagaaagcattcctattgcgctgactggaagtgatattcttgcaagggcaaaaaatggcactggaaagactgctgccttttgcattccggcacttgaaaaattgatcca

SEQ ID NO: 94262 - protein, 195 aa, Zea mays
  misc_feature: Ceres CLONE 1583913
MHQPRARYPPGYGSGGGGGAGRGGGGGNGGGGGGGGGNHNYYGRNPQQHHYHQQQQQQQSQHSHRNSSYQQQWLRRDQAPAVAGAASGNAVAKTASQLDAVGSSSQDWKAQLNIPAPDTRYRTEDVTATKGNEFEDYFLKRELLMGIYEKGFERPSPIQEESIPIALTGSDILARAKNGTGKTAAFCIPALEKLI

SEQ ID NO: 94263 - DNA, 947 bp, Zea mays
  misc_feature: Ceres CLONE 1583917
  misc_feature: Encodes the peptide sequence at SEQ ID NO. 94264
aaagctggagctccccgcggtggcggccgctctagaactagtggatcccccgggctgcaggaattcgtctcacccctagaaaaacggtttgtgtttcttccgagctcctcctcagcgtcatgatgttctcgacgtcgctgtctcagccggtcaccttcgggaagcacaactatgtggagtccctgccccgtgacactgtctccgactacgcgtagttcgcctacacctttgaccccctcttcgcctccatctccgacaccgacggcgtcacctcagaccggtcccgtctcatgtgcgctggcgatttcattgtcgaccggtgctcggtcgctgagtcctactccgcgaacgcgagatccgcgcgcgtgggcgcctcctagtgctacgtcttcgcagttttgtaaccagacagtgcagcagaacttgccccctcctcgcgcagtcctcgatccgcgtcgacctacttcatgctacctattcagcaaacggtaggcagggggtaccccaaagagagcgcgtcattctttggcggcggagcattttgcgggattggtggcagctttgggaacgtactagctcgaagactggacagggacccttttcttgggtgctggcgccctggaggggaggcactggccgataattccgggtaaaagcctggggggggcaaattctatgggcccctccgaggggggtgtgtcttttgaggcggatttctactggggggaaatgggccaaagaaccccgggacaatgggggggcgcaattccacccaagattcggcggtgtttttttctacatgtttcgaaggggcaagagaattcttaatgggccgtgggcccccctgtgtgtgtgtggcattctccacgattctctggaggggggaggcggcgccaccggctttggctgggggtctgggtccttttgtggggggagggaaaagaaag

SEQ ID NO: 94264 - protein, 31 aa, Zea mays
  misc_feature: Ceres CLONE 1583917
MMFSTSLSQPVTFGKHNYVESLPRDTVSDYA

SEQ ID NO: 94265 - DNA, 977 bp, Zea mays
  misc_feature: Ceres CLONE 1583920
aaagctggagctccccgcggtggcggccgctctagaactagtggatcccccgggctgcaggaattcgtctcacccctagaaaaaaggtttgtgtttgtccggagcgcatcctcagcgtcatgatgttctccacgtcgctgtggcagccggtcagcgttcgggaacgacaactatgtggagtccctgacccgtgccactatctccgactacgcgtaggtcgctgacacctttgacacccttttcgcctcgatctccgacaaggtaggggtcacctcggaccggtagcgtctcatgttcgctggcgatttgattgtctacgggtgctccgttgccgagtactcctccgcgaaggagagcaccctcgcgcttgtgctcctcctaatgctacgtacgcggcatttttggagaaggagagagaagcaaaacttgcagcctccacgtgcagccctggaaccgcgtcgacatactttatgctaacacttcagcaaaaggcaggcagggggtacccagaagagagggggctcattctttggctggcgaaggcatttttgaggaattgggtcacagctttttgcgaaaactactatgactgattgacttgtacagggggcccttttcccgtggggggcctggggcccctggagggagaaggcactggtctgaaatcattccggggaaaaatgcccaggagaccgggccaaatatctttggatctccttccaggaggtggcagttcctctctgaaagaccggtttttgactaggggtaaaatggggccgaagataccccggggccaatgcggggcggcatttctcacccaaggaatcgaccagtcgtgttcttaaaaccgttcgcaaggggaaaagaaaggcttgaaaggacaggggcgagccactctgttatatgggaatttacaatggaattgttaagggtgaggggaggcctcaaggccttaggcgggggagggagcccttatg

SEQ ID NO: 94266 - DNA, 846 bp, Zea mays
  misc_feature: Ceres CLONE 1583923
  misc_feature: Encodes the peptide sequence at SEQ ID NO. 94267
cccgcggtggcggccgctctagaactagtggatcccccgggctgcaggaattcgtctcacccctagaaaaaatcccagatcaggatttgtcgactacccgccgaatgccagagagaaatatgctcatcttctctccgccggatcggttcattccagagcgagggagaaagggaggcggtgcgtcgaggggggccgagattttgcctctttgtagccaaatatgggtatgagctgcttcgcgcaccgccgcctctccgacttcgcccgccgccaggactgcctcctcatcttcgtcttctgcctctcgattcccatacgttaccagtagttttaatttaactcggagtaattgtaggaacagtggtccgtaaactgcgctcacctttgcctgttcgtggtccttttgagctttctcctccctctttctctgactctctccttattcttctccttcctcggagagaccggcggctggtatggatcccaatggcctcaaaactggaagccttttgctcccgaccatcgtgaggctgtgcacttcgcctccttccgccgttgtcatcggctatggcatctcgggcagttcatctggctttgccctcgtcaattcaccatttcaggagaactggtcttggactctcgaaatcttattggctggcccgttcattctgataacccgtttgggatgcccaattggtatagggatccctcatgggtacccgagcgtgtcgcatggaggagtcctctcgtcagcatgtttgataccctccatgttggcctaaaggtttttacccccgccaaacccaatatataaccccaggcttccgttaatatgatctcttaacg

SEQ ID NO: 94267 - protein, 101 aa, Zea mays
  misc_feature: Ceres CLONE 1583923
MDPNGLKTGSLLLPTIVRLCTSPPSAVVIGYGISGSSSGFALVNSPFQENWSWTLEILLAGPFILITRLGCPIGIGIPHGYPSVSHGGVLSSACLIPSMLA

SEQ ID NO: 94268 - DNA, 822 bp, Zea mays
  misc_feature: Ceres CLONE 1583924
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (737)..(737): n is a, c, t, g, unknown, or other
  misc_feature (741)..(741): n is a, c, t, g, unknown, or other
ctggagctccccgcggtggcggccgctctagaactagtggatcccccgggctgcaggaattcgtctcacccctagaaaaaatagctttcagttgggatttgggaatttgtattatgtgttccatggttggtcacagcttgtggcatgcattggtccataggtcaaatgcctggccaaggaaaataaatcatgtaagggcttgtttgttttcatttcaatctatgtgggcctttgttcggttacaagtataaaatctcaccatggatttaatcctagtctggattgtgtgaatccatatctcacccaatcccatggtgggattaactccatcatttaatcccaccatggatttaatcctagtctggattgggtgaatctatacctcacacccaatcccatggtgggattaaatctatcatttaatccatgtatctgtcaaagctagttattcttttgatccatagattctaatatataaacttgtgcaatatcttcatggatttgtttcattaggtatgagatatggatagaatccatgctttccataatttaaaaatttccaacctttgggttataatccatgatgagtttaactgaataaaatttttgagtaggcttgggttattttggggcatggattgtgatatggatttaatttcaatccatactaatccagagttggattggtgtaaacgaacaagcctgatgatgggnnnnnnnnnnngggggtgtaaaanccanaggaaagtcaaaatctctacctaatttttttccaatcccatccaatcatgtagttgtaagaacaaaggccttaattttgaa

SEQ ID NO: 94269 - DNA, 799 bp, Zea mays
  misc_feature: Ceres CLONE 1583925
  misc_feature: Encodes the peptide sequence at SEQ ID NO. 94270
  misc_feature (799)..(799): n is a, c, t, g, unknown, or other
ggagctcaccgcggtggcggccgctctagaactagtggatcccccgggctgcaggaattcgtctcacccctagaaaaaaaaaaagcattgcgacggtcctcgaggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcgaggaaagaagaccctgttgagcttgactctagtccgactttgtgaaatgacttgagaggtgtaggataagtgggagcctccgggcgcaagtgaaataccactacttttaatgttattttacttattccgtgggtcggaagcggggcaccgcccctccttttggctccaaggcccggcctcgccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgtttgctttn

SEQ ID NO: 94270 - protein, 55 aa, Zea mays; identical to SEQ ID NO: 82409
  misc_feature: Ceres CLONE 1583925

SEQ ID NO: 94271 - DNA, 849 bp, Zea mays
  misc_feature: Ceres CLONE 1583927
  misc_feature: Encodes the peptide sequence at SEQ ID NO. 94272
  misc_feature (733)..(733): n is a, c, t, g, unknown, or other
aaagctggagctccccgcggtggcggccgctctagaactagtggatcccccgggctgcaggaattcgtctcacccctagaaaaaaaacaaagcattgcgacggtcctcgaggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcgaggaaagaagaccctgttgagcttgactctagtccgactttgtgaaatgacttgagaggtgtaggataagtgggagcctccgggcgcaagtgaaataccactacttttaatgttattttacttattccgtgggtcggaagcggggcaccgcccctccttttggctccaaggcccggcctcgccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagcntagagtgtcagaaaagttaccacagggataaactggcttgtggcagccaagcgttcatagcgacgttgctttttgattcttcgatgtcggctctttccaacattggggaagcagaa

SEQ ID NO: 94272 - protein, 55 aa, Zea mays; identical to SEQ ID NO: 82409
  misc_feature: Ceres CLONE 1583927

SEQ ID NO: 94273 - DNA, 855 bp, Zea mays
  misc_feature: Ceres CLONE 1583932
  misc_feature: Encodes the peptide sequence at SEQ ID NO. 94274
ctggagctcaccgcggtggcggccgctctagaactagtggatcccccgggctgcaggaattcgtctcacccctagaaaaagcggctttctcgctaattactcggcgcggcagcagacttgggctgcacaagcttgctatctctggttcaattggcccagcttgcgctctgattgcccccccaaaactgcgtgcgtgtctcgcagcgtgctggaattgctcatctgttcgtctggcgaagcaattggctagccgattacatctccagctcaccttgatctcactgcagtctgctgaaatcgcccgtctctgagggccattgccgctcgcttcattcgtgggttgctgagggcgccttgggggcctggggcctgaatttgcgtggggcagccttgggaaagcgcaagggaacctttcctcgtgaccatgaatctactggaggagttgatccgggcgatagagctctggctccggattgttaaagagcaggtgcccttgatcgaccccacccttgacccagtgttacttgttcccggtaatgctggctccatccttgaagctgttgatgatgaaagaaacaaggaaaaaatttggggtgcgcatcccttgctgctgaacatgagttcccaggaaaaactcttgggcccaaatttaatgccttccaccgcgaaaaaaccggtttcctgtttaaacaagaaaaaccagaattttcctggtccccctgaaagaaaaaaaaatggggttttgtatggccccatttgaaccccttttaaaccccaaaaacaatgaatccactgtgggggaaatagacacccccggtgtttacctaaccttatctccataaaacaatgtgataa

SEQ ID NO: 94274 - protein, 111 aa, Zea mays
  misc_feature: Ceres CLONE 1583932
MNLLEELIRAIELWLRIVKEQVPLIDPTLDPVLLVPGNAGSILEAVDDERNKEKIWGAHPLLLNMSSQEKLLGPNLMPSTAKKPVSCLNKKNQNFPGPPERKKNGVLYGPI

SEQ ID NO: 94275 - DNA, 1222 bp, Zea mays
  misc_feature: Ceres CLONE 1583933
  misc_feature (8)..(8): n is a, c, t, g, unknown, or other
tttttttnctggttgtcccttcaatctcgcgcgggggcggccgacccctcctcgggtagtaaatgtggtggcgggggttgcaaagctggactccccgcggtggcggccgctctagaactagtggatcccccgggctgcaggaattcgtctcacccctagaaaaaagtatcgcctttgcccgcacacacggctcccattccatttccgctgcttgacgcgcacccacaccaccacagcacgcgacgcgagaccgaatccatccgtccgacgccgcctcgcctccctcagccctccgcagctcggcctctgcttgcgttgcgttgcgttgcgtgtgtatgtagtggccgcaacacaaaatcaagagacgtgatatatgcgacccccaacagccaacgaccggcctccaaagcggtgggggtggagcagcagcagctggtgcagcagcaggggacgacgacttcgccttctactactcccaaccccagggacacccaacgccgccggccggcctcaagcgaacgtcaaagcttcgccccctcccccggtcgacggacccccaacccccaggcgcccgcaaggtgatgaaacaaaacgggcccgggcgcccggaaaagccagccgcgggggggccataaaggaacccccccgggaaccccgcccacggggaaaaaaggttgataaggaaaggcccgcccccataaaaaaagggaacacgggcgcaaagtaaaaagcgcggggttcccatttcctgcgccaaaaagacatgggggctgtcaaacccctctctcccccttgtggagacaggaggctctccccttagataatagagcgcggcgaaaaaaggaataaccaacagccccccagaaaaacccggattgcctggggggggccccccctcccgcgggaaaacccacccttttcccacagagggcccggagagagagccttggggcgccccctgggtcttcccgaaagttccccaatacagggccgcgaaaaaaatcacctgggattttttgagaagggggggcaacacccatgggggagaagcatattcttatcgcccccccaaaaaatgggggagaaaagacatagcccttattaataaagcgccaccccaccggcccctatataatccccgaaaaggcctctcccccccccacagggagtaccacaaaagagcacttccacaaggagtttccgccccacagcgtgcatgggc

SEQ ID NO: 94276 - DNA, 715 bp, Zea mays
  misc_feature: Ceres CLONE 1583934
ctggagctccccgcggtggcggccgctctagaactagtggatcccccgggctgcaggaattcgtctcacccctagaaaaagttcttcacttcgacaggagctggagcgcccgccctccagcccaggtccgcgccgccgccgcgccgaccacaatcccagcgcccgctgcccagacccagcgccgcctgcggttgtgagcgcgaacaggagagagcgggtcttcggggcgagcgccacgcgcagacggcggttgaggagcctgagaaaaccctggtcttccttcaagatcctggtggatcgcgcccagctccgcgaaatttccttgatgtctatgtaggttcgtcctaaagattcgattttgttggctcttttgatccgacgcagatccgtacagttctcgcctgatttctgcattcaggcgccaggaggcttgctggctgtttttggattggtgtcttctcccatgggtcttgcaggtgtaggagggtgaattctgtctgattaatcagcggaagggcaagcggctaccggtggctgcgccaaactgggggggcgaacagggctccggaaggcaccgggaccatttgggccctgggatctaaaccgggtttcccggaccccctccctttgccaaagggccccagttctggggttgggcccaccgggtttttttggccccccaaagtgttgttggcccccaattttttgagggggg

SEQ ID NO: 94277 - DNA, 778 bp, Zea mays
  misc_feature: Ceres CLONE 1583937
  misc_feature: Encodes the peptide sequence at SEQ ID NO. 94278
  misc_feature (729)..(729): n is a, c, t, g, unknown, or other
ctggagctccccgcggtggcggccgctctagaactagtggatcccccgggctgcaggaattcgtctcacccctagaaaaagcgtgtgcttattagttatctgttagcgtttgctgcagtgctcttctatggagctccgaccccggactggaattatctcgtaggcccttccaggtgctactctacttcagctgctgtccctgtgcaactcgtccgggcaagttttgtggctcgctcgtggttttgtagctaggttaagcgagtgaagttacactcggtagcgcagtatttcctgcgagattgtttattcttctgttaatgtacctaccttactatttcgtttggattatggatactgggtgcatccgtttcatgtttaactccactcctgagtcctcacctcgtgctgcccgcgccatttccacctcccactgtcctttcgtccagtccccagccctgcagcccaaccgtggaggttctggaaggcggtgtatcccttctagaaccttctcgagatgcagagcgccgcggctttccggccatgccccactcggctgctggtgagcagcccttgtcgccccctcctctcggcccgcccgcttcgtgcctccgccgctggcgccgtcgctaccagaagcagcgccgtgggccctcgcggtctggggctcgggctgctgccagcctcgcccgatcgggaatggcagtgccgccagcgacaggtgtcatgcancgcggcccggggatgctgtggcggcccccgaagccgaaagaaggaagca

SEQ ID NO: 94278 - protein, 88 aa, Zea mays
  misc_feature: Ceres CLONE 1583937
  misc_feature (72)..(72): Xaa is any aa, unknown, or other
MQSAAAFRPCPTRLLVSSPCRPLLSARPLRASAAGAVATRSSAVGPRGLGLGLLPASPDREWQCRQRQVSCXAARGCCGGPRSRKKEA

SEQ ID NO: 94279 - DNA, 900 bp, Zea mays
  misc_feature: Ceres CLONE 1583940
  misc_feature: Encodes the peptide sequence at SEQ ID NO. 94280
aagctggagctcaccgcggtggcggccgctctagaactagtggatcccccgggctgcaggaattcgtctcacccctagaaaaaaattagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaagacggacggagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtcttctccttccggccgcgctccctggtggtcgacatcatcatggaccggggcccccgactcgtgcttcgcgccctacgggcgaccactttccccaaaggggcggaaaccgggtcaccgtggcaccctgcttcaacgcccagcaaggttgcggtccgcagcggcccccgcgggaggaaagaaagaggattccgacacaacgttatataaggtgtttacgccctttatggaactaacgatttaaaggtggtttgaaattgtaaatgaaaatcgactagggtagcagtggatagaaaaagaactgtgggctgcacgccagagagtgtgaggcgaccaaatctgtttgtgagatcgatt

SEQ ID NO: 94280 - protein, 200 aa, Zea mays
  misc_feature: Ceres CLONE 1583940
  misc_feature: SWISSPROT Homolog: EC 1.14.13.88 Flavonoid 3',5'-hydroxylase
MAAQLHHALYELLHEAAAAQRALLLAIPFSLLLLPLLLRYLAASASASATKTDGAAPASDPDKLLSLLPSPPMKLPIIGHLHLMGDIPYVSLAALATRYGPDLMLLRLGAVPTVVVSSPRVAEAVLRTYDHVFSFRPRSLVVDIIMDRGPRLVLRALRATTFPKGAETGSPWHPASTPSKVAVRSGPRGRKERGFRHNVI

SEQ ID NO: 94281 - DNA, 844 bp, Zea mays
  misc_feature: Ceres CLONE 1583943
  misc_feature (283)..(283): n is a, c, t, g, unknown, or other
ctggagctccccgcggtggcggccgctctagaactagtggatcccccgggctgcaggaattcgtctcacccctagaaaaactcagcagcagcacgcgctccgctccccacgccagcacgcccgagccccgaatcgagtcccctaccccatcgatccccgccgcccgcctttccccgccattcttctagaacctacccagctctcggggaccttctctcccagcccgagatccctccccaccgagatcccgcgccgccatggtgtcgtgaccgcggcggatgcngcgtcatggagcgggtagcctagtcccccgacgaccgccctgagcccgcctgcggcggcggcgcagccgcagccgctggaagtggcggtttgcgcaggtctttcgcaagcgcgccgggggagaagatgttgcaagatgtggacataatctctgcaaatgaggttgacaaatccggggatcatcttgctactggagattgaagggggacctgttgggttttgttcaaaaaaaccgacattgctgataaaggctggcccaaaagaactgaggaggcagaaaaatctgtttccaggggatccccgagttccctttaaagaacccaattttcgaagtcccggaaaccggaagtttggacccccccaaaaaagttgggaaaatggaagagaagattttcccgggttccgggggggggccaaaaaaccaaaaaatggcaccccttttttccttgggctaaaaaggaaaaaaaaacaacccaaggttttgggaaagcccccaagggggaagtggccgggggccttttttaaaaaccttcccccagtgggttgggaaaaagagaacaaa

SEQ ID NO: 94282 - DNA, 1113 bp, Zea mays
  misc_feature: Ceres CLONE 1583952
  misc_feature: Encodes the peptide sequence at SEQ ID NO. 94283
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (80)..(80): n is a, c, t, g, unknown, or other
nnnnnnnnnnnnaaaaaaaaaaagcggggaataaagtgaacaaaacaaaagctgaaaaccggtgggttggggggggggtntcaaaactggagctccccgcggtggcggccgctctagaactagtggatcccccgggctgtaggaattcgtctcacccctagaaaaatcttgagaaagaactcctcgtcctcgctccctccccaaccatcaagagcgcacacgcacacgcacacgccgcgcgcaagccggccgacgtacggcatggagaagagcgctacaactggcggcggcggttcaagcggcggcggagaggcggcggaggaggcgaaggtgcctctgctgcagccgagggctgcggcggcggcggcggccgaggaggaccatggaggaggaggaggatacgacggcaaggcggcgtcggcggcggcggatgaggagggcagggacgcgtcgtggtcgtcgctgccgctgcggcggcgcgcctgggaggagaacaagaagctgtgggttgtggccgggtccgtccatcttcacgcggcttcgcggtcctttcgcggtcaccggtcaatcagccaggcccttcattcggccacattcgggcgcccacccgaggctcggccgaccctacggcggcttcggtgctcccaccgggtccttcaatggaagggtttcaagccaaaccgggcaattccctgtgcttgggggcaattggggcggaaacccggccgcctgtgggaataacacgtcctgtttggctcggggggccaagtttccggttaaacgcggggggagcgggaaaaggccaatgttaacccccccagttgtgccggggggggaatttcttaaccactttgtcaaaacccggggtccggttaggaaaattacattctcccttgtatcacgggcctctgtgcccccccccgtgggggtgggaaaagttatcccccccgctggtgttacacctggttgttcacacggggagagccccgccctggccttggaggtgaggccgccctgggggggcacaaaggaacaccccggggaaacatatctctccgccccggtgtgtgggcacggggggaaacccgccgggcgcgcgctctcctccgggaa

SEQ ID NO: 94283 - protein, 159 aa, Zea mays
  misc_feature: Ceres CLONE 1583952
MEKSATTGGGGSSGGGEAAEEAKVPLLQPRAAAAAAAEEDHGGGGGYDGKAASAAADEEGRDASWSSLPLRRRAWEENKKLWVVAGSVHLHAASRSFRGHRSISQALHSATFGRPPEARPTLRRLRCSHRVLQWKGFKPNRAIPCAWGQLGRKPGRLWE

SEQ ID NO: 94284 - DNA, 1303 bp, Zea mays
  misc_feature: Ceres CLONE 1583955
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (140)..(140): n is a, c, t, g, unknown, or other
  misc_feature (141)..(141): n is a, c, t, g, unknown, or other
  misc_feature (176)..(176): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (434)..(434): n is a, c, t, g, unknown, or other
  misc_feature (435)..(435): n is a, c, t, g, unknown, or other
  misc_feature (446)..(446): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (473)..(473): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (546)..(546): n is a, c, t, g, unknown, or other
  misc_feature (553)..(553): n is a, c, t, g, unknown, or other
  misc_feature (571)..(571): n is a, c, t, g, unknown, or other
  misc_feature (572)..(572): n is a, c, t, g, unknown, or other
  misc_feature (590)..(590): n is a, c, t, g, unknown, or other
  misc_feature (607)..(607): n is a, c, t, g, unknown, or other
  misc_feature (646)..(646): n is a, c, t, g, unknown, or other
  misc_feature (647)..(647): n is a, c, t, g, unknown, or other
  misc_feature (649)..(649): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (683)..(683): n is a, c, t, g, unknown, or other
  misc_feature (724)..(724): n is a, c, t, g, unknown, or other
  misc_feature (752)..(752): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (797)..(797): n is a, c, t, g, unknown, or other
  misc_feature (802)..(802): n is a, c, t, g, unknown, or other
  misc_feature (823)..(823): n is a, c, t, g, unknown, or other
  misc_feature (840)..(840): n is a, c, t, g, unknown, or other
  misc_feature (861)..(861): n is a, c, t, g, unknown, or other
  misc_feature (864)..(864): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (884)..(884): n is a, c, t, g, unknown, or other
  misc_feature (885)..(885): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (908)..(908): n is a, c, t, g, unknown, or other
  misc_feature (912)..(912): n is a, c, t, g, unknown, or other
  misc_feature (916)..(916): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (937)..(937): n is a, c, t, g, unknown, or other
  misc_feature (944)..(944): n is a, c, t, g, unknown, or other
  misc_feature (1003)..(1003): n is a, c, t, g, unknown, or other
  misc_feature (1005)..(1005): n is a, c, t, g, unknown, or other
  misc_feature (1032)..(1032): n is a, c, t, g, unknown, or other
  misc_feature (1038)..(1038): n is a, c, t, g, unknown, or other
  misc_feature (1060)..(1060): n is a, c, t, g, unknown, or other
  misc_feature (1072)..(1072): n is a, c, t, g, unknown, or other
  misc_feature (1073)..(1073): n is a, c, t, g, unknown, or other
  misc_feature (1078)..(1078): n is a, c, t, g, unknown, or other
  misc_feature (1083)..(1083): n is a, c, t, g, unknown, or other
  misc_feature (1099)..(1099): n is a, c, t, g, unknown, or other
  misc_feature (1104)..(1104): n is a, c, t, g, unknown, or other
  misc_feature (1105)..(1105): n is a, c, t, g, unknown, or other
  misc_feature (1106)..(1106): n is a, c, t, g, unknown, or other
  misc_feature (1107)..(1107): n is a, c, t, g, unknown, or other
  misc_feature (1108)..(1108): n is a, c, t, g, unknown, or other
  misc_feature (1115)..(1115): n is a, c, t, g, unknown, or other
  misc_feature (1116)..(1116): n is a, c, t, g, unknown, or other
  misc_feature (1117)..(1117): n is a, c, t, g, unknown, or other
  misc_feature (1118)..(1118): n is a, c, t, g, unknown, or other
  misc_feature (1119)..(1119): n is a, c, t, g, unknown, or other
  misc_feature (1133)..(1133): n is a, c, t, g, unknown, or other
  misc_feature (1144)..(1144): n is a, c, t, g, unknown, or other
  misc_feature (1156)..(1156): n is a, c, t, g, unknown, or other
  misc_feature (1157)..(1157): n is a, c, t, g, unknown, or other
  misc_feature (1158)..(1158): n is a, c, t, g, unknown, or other
  misc_feature (1159)..(1159): n is a, c, t, g, unknown, or other
  misc_feature (1160)..(1160): n is a, c, t, g, unknown, or other
  misc_feature (1161)..(1161): n is a, c, t, g, unknown, or other
  misc_feature (1162)..(1162): n is a, c, t, g, unknown, or other
  misc_feature (1163)..(1163): n is a, c, t, g, unknown, or other
  misc_feature (1164)..(1164): n is a, c, t, g, unknown, or other
  misc_feature (1165)..(1165): n is a, c, t, g, unknown, or other
  misc_feature (1166)..(1166): n is a, c, t, g, unknown, or other
  misc_feature (1182)..(1182): n is a, c, t, g, unknown, or other
  misc_feature (1183)..(1183): n is a, c, t, g, unknown, or other
  misc_feature (1184)..(1184): n is a, c, t, g, unknown, or other
  misc_feature (1185)..(1185): n is a, c, t, g, unknown, or other
  misc_feature (1192)..(1192): n is a, c, t, g, unknown, or other
  misc_feature (1193)..(1193): n is a, c, t, g, unknown, or other
  misc_feature (1194)..(1194): n is a, c, t, g, unknown, or other
  misc_feature (1195)..(1195): n is a, c, t, g, unknown, or other
  misc_feature (1196)..(1196): n is a, c, t, g, unknown, or other
  misc_feature (1197)..(1197): n is a, c, t, g, unknown, or other
  misc_feature (1198)..(1198): n is a, c, t, g, unknown, or other
  misc_feature (1199)..(1199): n is a, c, t, g, unknown, or other
  misc_feature (1203)..(1203): n is a, c, t, g, unknown, or other
  misc_feature (1217)..(1217): n is a, c, t, g, unknown, or other
  misc_feature (1249)..(1249): n is a, c, t, g, unknown, or other
  misc_feature (1297)..(1297): n is a, c, t, g, unknown, or other
  misc_feature (1299)..(1299): n is a, c, t, g, unknown, or other
  misc_feature (1300)..(1300): n is a, c, t, g, unknown, or other
  misc_feature (1301)..(1301): n is a, c, t, g, unknown, or other
  misc_feature (1302)..(1302): n is a, c, t, g, unknown, or other
  misc_feature (1303)..(1303): n is a, c, t, g, unknown, or other
nnnnnnnnnnaaaannnnnnngnnnnnnncccgcnnccccnnccnnnggnnnnncttgttgggtgtccaatgtgggactcaccgcggtggcggccgctctagaacagtggatcccccgggctgcatggaattcgtctcanncccctagaaaaaaaatcagcctcccgatggcgtcncctctgtcacagctccccagccatcgccttctctaaccccgccacagcctccggcgctgtccgcctacgcgccgcggccttccctgctgggcgctccggcggcgcgggtgggcggtggcggctgccgtggccctcgcccaactcccgtggctcaggcgaggcacgcccctttcaaggcgggccttccaggcttccgggagagttggaacccgatccnnnnaaaggaccacaaaaaaaagnnnnnnnnnnaagggcgtnnggagagagggncnnnnnnnnnnnngnnnnnnnngcccnagagaggggggaggagtcttgtggggcgggggnnncaggcacagggacaagagggggaggggggggaggaggnttaggtngaagggaggcgaaagggnngtgtgagtgagggtgggntgtgggggggcgggggnaagtatggggggcaaggccggacctgtgttgtggggtannancgacccgttccgaggaggagagggnnngcgggtnaggtgtaacacatgagtagagggacaaaggggcggtagcgntccacacccccacacaccacacagacancgtatagggggtgtgagggnnnntnnntcttnnnnnnnnnnntgnagagngatgtaataagattggatcgnttccttcgccgctcggnaccggaagataatcgtctgtnacncagcgnnnnnnnnnttcccnncnnnncgagcggnnnnnctgttntagngagntacnnnnnnnnnaacataaanccagggncgcgcgggggcgggagggcgaggcaccataaagacgcagacggacaagctgatgcgcgngnacgcgccgacgcagcatgatgaggaanatgagncctcgcagcacacgacggtcgntccgctgcactnncaacnctagncacagtaatcagacanacacnnnnnaaaacgnnnnnccaacatggagtgnctatagtatgnccacacacacgnnnnnnnnnnnagcagagggagggagnnnnaaaaggnnnnnnnntgtnttttttctagggancagtctcactctcagtgaaagagagagagagngtatataatgacacgagtgcgaaggtggggagccgctgacacaggagntnnnnn

SEQ ID NO: 94285 - DNA, 1333 bp, Zea mays
  misc_feature: Ceres CLONE 1583959
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (91)..(91): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (278)..(278): n is a, c, t, g, unknown, or other
  misc_feature (280)..(280): n is a, c, t, g, unknown, or other
  misc_feature (281)..(281): n is a, c, t, g, unknown, or other
  misc_feature (468)..(468): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (535)..(535): n is a, c, t, g, unknown, or other
  misc_feature (536)..(536): n is a, c, t, g, unknown, or other
  misc_feature (575)..(575): n is a, c, t, g, unknown, or other
  misc_feature (586)..(586): n is a, c, t, g, unknown, or other
  misc_feature (614)..(614): n is a, c, t, g, unknown, or other
  misc_feature (615)..(615): n is a, c, t, g, unknown, or other
  misc_feature (736)..(736): n is a, c, t, g, unknown, or other
  misc_feature (798)..(798): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (885)..(885): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (1219)..(1219): n is a, c, t, g, unknown, or other
  misc_feature (1280)..(1280): n is a, c, t, g, unknown, or other
gcgcggagcggcggcgcgggcggcgcggaggcgggtggcggcgggggggcgcgggggcgcgggcgggggggctggnnnggcaaaagctggnaactccaccgacggtggcgggccgctctagactagtggatcccccgggctgcaggaatcgtctcacccctagaaaatgaaaaaggggatggatcaaatatcttaagcagagctgttgctattcaattgcgggtgtggatgatgcccaaatgtttcaaactgtgacgcaagctatgaaannnnnnntnannttggtgaggtttgtgaggggaaaagtaataaaaaaagagaagcttaggctaaaggaagaagaaataagacgtgtgaatcgcacggtaacacgaggaggatgcagatccaaaaaatagagggatggtgttggctgggtgggagggggaagagggagtgtacgtggagagtactttgaggcggagaacngagagggggggatggcgaggannnaaaaatagggaggagagtggggcaggagactggagggcgccgnntcagtgcacggggggagggggggtggggcggggggggcnacagaaggagntagagaaaaagacaaaggaaagggggtnntcggagagggggggccgggggcccagaaggacagggcagagagtccgagccaacaacgaggggtcagaacatagagaggagaagaaaaaaaataagaaatgttttttttgagaggatgtgnaggaagggggagtagctgaaattttaggaaagagagagaaaggaaggatttgtgactaaatnaaaaagatacccggctcatggatcagtctagtcctctcctctatcnnnnnncgcccgctgtccactgaggaagagaagaaagggganacannnntggtgaggcttaacagatgatattatattattatggtaggagtggaagaaagtcgtgaataggcgtaggagagagcgtgacaaggtgaagagacagcgtttaaataagcgggtgggggtgcacactgactgacaacttgtgaggtgagtgggcacaagcaattgagagaggctagacacataatgccggaggtgtacgatatgttagtagttatatagaaaacattaaaaaacgttcaaccacgggccgtccgcgcatgtatattataagacaaataagacaaaaagagaaggaaataaagagagtgaattaagagttaaagtaganggaaaaggaacgcagggcagtaggggtttgatgctgatattcagacggaagatagagtggnttgaattgaaggtgaggtggatgtagaataataatcttttgtgagatctgtat

SEQ ID NO: 94286 - DNA, 1083 bp, Zea mays
  misc_feature: Ceres CLONE 1583963
  misc_feature: Encodes the peptide sequence at SEQ ID NO. 94287
cgagctggagctcaccgcggtggcggccgctctagaactagtggatcccccgggctgcaggaattcgtctcacccctagaaaaagttccgcttcgtcccagcctctagttcttcctttcctccagagtgatggccaaatgctactcagattggccaccgattccgcctttccatccatcgcgaagaacgccgccgcaatcccacgcctccccgatcacgatcaggcggcagctcgtgtccttcgtgctccagtgctccagatcctgcgctcccctcctcgagcccaagaacctgcccgatgagttcgaggccgtgccggcgacgacgacgccgccgctgccggacgccgccccgaagctggggatttctaacaggttcatcccgaggcctctgcggcggaccggcaaaccgagtagctggggcttcgagggctactaggagggcggctgctgcaagcccgagtttccggctggaaaaaaaaaacgggtcaactgcgcctgacccttgcaggcgtgatcaggggaaaaaggcagtgggggggctccggcgagaaaactgccttggtcgaaaggaacttttccagggccccccacaggccgggggcttgcgccgggaagaaaagcgaggaactgtggctgcacccaggaacctcgggtccgccccctgaccttggacatctcacagggcccggggggggcgcggtgtttttccaggaaatttccgccccgcaacaggccccgtgcgcccctccgcgggggggttcacaccccagaaggcgcgataagatataggtgggaaaccctccccccctcttgggccatgtggggaccctttccagaccgggctgggccaaggtggtagtgcggcgatacaaaaaggaggggggctgcgcatatgtgtaacgcgcgaagaaacacggagtgctttcttaggaacaggggtcaagggcgtgagagggggggtcccctgctccgggaccggttgaagccgcggtaaacacctatatcgtgtgccccgagatttgagtgagcacgggctcgtgctccattgtgtttatatattcgacaaagagggcgctctccc

SEQ ID NO: 94287 - protein, 102 aa, Zea mays
  misc_feature: Ceres CLONE 1583963
MAKCYSDWPPIPPFHPSRRTPPQSHASPITIRRQLVSFVLQCSRSCAPLLEPKNLPDEFEAVPATTTPPLPDAAPKLGISNRFIPRPLRRTGKPSSWGFEGY

SEQ ID NO: 94288 - DNA, 1300 bp, Zea mays
  misc_feature: Ceres CLONE 1583964
  misc_feature: Encodes the peptide sequence at SEQ ID NO. 94289
  misc_feature (6)..(6): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (90)..(90): n is a, c, t, g, unknown, or other
  misc_feature (968)..(968): n is a, c, t, g, unknown, or other
  misc_feature (972)..(972): n is a, c, t, g, unknown, or other
  misc_feature (1092)..(1092): n is a, c, t, g, unknown, or other
aaaacnaaaaaannnnannaaaaaaaaccgacatcacgcccccccattcccccctctgtgtattnnnttttttnnnnnccaaaagctggngctccccgcggtggcggccgctctagaactagtggatcccccgggctgcaggaattcgtctcacccctagaaaaagttccgcttcgtcccagcctctagttcttcctttcctccagagtgatggccaaatgctactcagattggccaccgattccgcctttccatccatcgcgaagaacgtcgccgcaatcccacgcctccccgatcacgatcaggcggcagctcgtgtccttcgtgctccagtgctccagatcctgcgctcccctcctcgagcccaagaacctgcccgatgagttcgaggccgtgccggaaactaccacaccgccgctgccggacgccgcccctaagctggggatttctaacaagttcatccgaggcctctgccgcgacccgcataccgagcagctggccttcgaggggctcaggagggggctgcctgcagcccgaagttccggcctgggaaaaaagaacggccaaacactctggacccttgtcagctgaatcaggggaagaagccaggggggggcttcccccgtgaacactaccttggttctaaggaaccttcccggggtcctcaccgggtccgtggcctctcctgggaggaaaagatcgggaatgattgccgcgccctcgggacaatagggtatcttacctgtgtcttgtgtcaaattatacaggggcttcggaggggggccggggtttatcccggcaaaacacatccggagacccggtgagatctcatccgggggggggcgttttcttggtgaggagattgtccggtctctctgaggaggggcgcacgataaaaaaaaaatatggggggaaatatcccccttccgccgtcgggctggtgaatgatgtgtggagggctctattantcgncgaggggagggacgagatacacaactatgtcttccatgtgccgctcgttgatactcactctacatgggggactcgtgactctaaacaattgttctacccccgccgccaacaataaaatgncgggtcgacacttttcccctatcgacacactcgagaggctaatggcggcgcacgaagggtggttgtgtgattcacccggcccccgtttccacaccagctgataaaaattgcggcgcgaacggcgacccatacactcctgtgtatcctcaaagtagatatgtatatatgtcgagatcgacgccagtgaggctcccctataagacccaca

SEQ ID NO: 94289 - protein, 126 aa, Zea mays
  misc_feature: Ceres CLONE 1583964
MAKCYSDWPPIPPFHPSRRTSPQSHASPITIRRQLVSFVLQCSRSCAPLLEPKNLPDEFEAVPETTTPPLPDAAPKLGISNKFIRGLCRDPHTEQLAFEGLRRGLPAARSSGLGKKNGQTLWTLVS

SEQ ID NO: 94290 - DNA, 843 bp, Zea mays
  misc_feature: Ceres CLONE 1583970
  misc_feature: Encodes the peptide sequence at SEQ ID NO. 94291
ctggagctccccgcggtggcggccgctctagaactagtggatcccccgggctgcaggaattcgtctcacccctagaaaaaaattccactctctcactctctctctaatcacactttcgacactgatcggtactctagtgtccgactcgtcacaattttagcgagaacgagcgagcgagcgagggagaggatgggttccacaggaccggcgagcgggttcgcggcgccggagcgggacatcgacgatctgccgcggaacgacgccaactacacggcgctcacgccgctctggttcctcgagcgcgcggcgctggcgcatccgggcagggcctccgtcgtgcacggccccgtgcgctacacctgggctgacacctatcgccgctgccgccgcctcgcatccgccctcgcgcgcctatccgtcgggcacggaagcacggttgctgtgatagctcctaatggtccggctgtctatggagctcacttcggtggtccaatgtcaggagctgttgtgaactgcgtcaatattcggcttaaccgcgagacaatagcatttctccttgaaacctccggtggcaaaagttgggattgggggaccaaaaattcttccccttagccaaagatcctttaaaaaaattggcaaaaaaaaaaaacttggttttaagggggcctcccattcttgattggtattcggggaacccaaccttggattccaaagttttttacgcattgttcttggggaaagggggcccctttaaggttttaaaaagtttttttaaaaactggtggacccccgaaatttactttgggaacccccccccaagagggtaaataggggcaaaacatc

SEQ ID NO: 94291 - protein, 140 aa, Zea mays
  misc_feature: Ceres CLONE 1583970
MGSTGPASGFAAPERDIDDLPRNDANYTALTPLWFLERAALAHPGRASVVHGPVRYTWADTYRRCRRLASALARLSVGHGSTVAVIAPNGPAVYGAHFGGPMSGAVVNCVNIRLNRETIAFLLETSGGKSWDWGTKNSSP

SEQ ID NO: 94292 - DNA, 865 bp, Zea mays
  misc_feature: Ceres CLONE 1583972
  misc_feature: Encodes the peptide sequence at SEQ ID NO. 94293
tggagctccccgcggtggcggccgctctagaactagtggatcccccgggctgcaggaattcgtctcacccctagaaaaaacgaccgcttggcgcttcatcactcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaatggcgaggccgccgcgcagggcgcgccatcgacgccgagggcgcaccagcagcaccgccaccccgccgcccccgccatcgccgtcagcgacagctccctcaagttcactcatgtgctcaacaacctctcgccagctgagctgtacgagcaagccatcaagtactagaaggggtcgttcatcaggtccaccgggcgcgctggcgacgctgatccgagcccaagaccgggcgggtctcccaagggacaagcgcgttcgtccaggaacgaggtcccccacccagggacctggtggggggggcaaggggcttccccccaaaatctagaattggacaaaaaaaaaccttccctgagtcaaccaggggaggaggggcc

SEQ ID NO: 94293 - protein, 163 aa, Zea mays
  misc_feature: Ceres CLONE 1583972
  misc_feature: SWISSPROT Homolog: EC 4.1.1.49 Phosphoenolpyruvate carboxykinase (ATP)
MATPNGLARIETTGKKKQDNGVWYDDSSAPVRAQTIDELHSLQRKRSAPSTPKRSAPTTPIKGGAHSPFAVAISEEERHTQQMQSISASLASLTRETGPKVVKGDPAANGEAAAQGAPSTPRAHQQHRHPAAPAIAVSDSSLKFTHVLNNLSPAELYEQAIKY

SEQ ID NO: 94294 - DNA, 838 bp, Zea mays
  misc_feature: Ceres CLONE 1583973
  misc_feature: Encodes the peptide sequence at SEQ ID NO. 94295
  misc_feature (429)..(429): n is a, c, t, g, unknown, or other
ctccccgcggtggcggccgctctagaactagtggatcccccgggctgcaggaattcgtctcacccctagaaaaaagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatagggtttccacatagcttcgtcgatttgatttgagtactaatggagtctagggtggcaaaagtctagcagtagtcgttccatgatgtatgaagctccccttggctacagcattgaggacgttcgacctgccggaagcgtgaagaangtccagtctgctgcttactccaactgcgcgaagaagccatcctgatatccctttttggctcctcattctagtaggtaaggatttcctttcctgaccctttgaatctggacaatctcttttggcctgctgcttcctgaaaatcgacccagtcccccagcctgggtccttggaatccctccctcccccttttccaggaatggggttccgattcccccggccccaagggggggttcttttcggcggcgggaggcttccccggggcccagcttttcggggtttaaagggcttaaaaaaaccccccttgggatacacttttctttgaggagcccttgtttttggggacccccctgggggggggggtttggggggccccctcccgggggccaaaatataacctcttgtttgagaa

SEQ ID NO: 94295 - protein, 36 aa, Zea mays
  misc_feature: Ceres CLONE 1583973
  misc_feature (1)..(36): Pfam Name: AdoMetDC_leader Pfam Description: S-adenosyl-l-methionine decarboxylase leader peptide
  misc_feature (22)..(22): Xaa is any aa, unknown, or other
MMYEAPLGYSIEDVRPAGSVKXVQSAAYSNCAKKPS

SEQ ID NO: 94296 - DNA, 856 bp, Zea mays
  misc_feature: Ceres CLONE 1583975
  misc_feature: SWISSPROT Homolog: EC 1.4.3.2 L-amino-acid oxidase
aagctggagctccccgcggtggcggccgctctagaactagtggatcccccgggctgcaggaattcgtctcacccctagaaaaacctccaccttatcatcgcccacgtacacacccaattcctcgcaactgggctcccccgcctccacgaaccacgacactgccccccgcctcaagttcgccgtctccattcctcagctctcctctcctctgcctagaatatcttcatcggtatttaccaacctggatcaatttactcacgatactctgaagcgtatacatatgccatatgggaaatgacttcatagctgtgggttgtcttatggctccttgaatttgcagtagtctgcctgtacctattggctgaagcagagctgacccccactttatcaagagttgctcaacaatggacactggctgcctgtcatctatgaatattactggagctagccaggcaagattttttgcggggcaacttcctcctcagagatgttttgcgagtagtcactatacaagctttgccgtgaaaaaacttgcctcgaggaataaaggaaggagatcacaccgtagacatcctgccttgcaggttgtctgcaaggattttccaagacctccactagaaagcacaataaactatttggaagctggacagctctcttcattttttagaaacagcgaacgccccagtaagccgttgcaggtcgtggttgctggtgcaggattggctggtctatcaacagcgaagtatctggcagatgctggccataaacccatattgcttgaggcaagagatgttttgggtggaaaagtagctgcttggaaggatgaagatggagattggtacgagactgggcttca

SEQ ID NO: 94297 - DNA, 760 bp, Zea mays
  misc_feature: Ceres CLONE 1583978
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
tggagctccccgcggtggcggccgctctagaactagtggatcccccgggctgcaggaattcgtctcacccctagaaaaagcactcggacggacgagcgaggcagacccgcaggtcgcagccacaacccaagcgcagcgctctgcctgcctccgctccggctcagctcccgccctgcctccgccttccattccaccgcgcggcgctgccgagtgccgacgtcgtccccgccgaagtttctggtttctgggttggatctctcggaagtcagaagctagccgaggatggggccggcggccaacgggggaaaaaccacccccaacctgggggggaaaacaccccaggtgggggggaaaaaaaaaaggggggaaggggggtatatctcccccccccataggttggccccccccaaaatttccccgggggggggggaaacaacccccctttttaaaatnnnnaaaaaaaggggggggggggggggggggggctccccccccccccaagaaaggaaagaagacaatttttttttaaaaaaaaaaggtggggggggggggggggggaaaaaaaaaaaaaaaaaaaaattatttgggggtgtcccccgcccccgggagggaaaaaaaaaaaaaaaaaaaaaaaaaaacgcggcgcctgccgttggtgggtcatcccctcccccccccccccccctggggtgggggggtgggtgtgcttttctcttccctcccccccaccccccaagaaagaaaagaaaaagaggaggtt

SEQ ID NO: 94298 - DNA, 1236 bp, Zea mays
  misc_feature: Ceres CLONE 1583986
  misc_feature: Encodes the peptide sequence at SEQ ID NO. 94299
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
ttttttttttttgttttttgtttagggtgttattattttatatatataaacacacgnnnnnnnnnttnnnnnnccatagctggagctcaccgcggtggcggccgctctagaactagtggatcccccgggctgcatgaattcgtctcacccctagaaaaaacacgccgtatatttctcacacgctcgtttccaagacactagactcgcagactcgaccagcgcgaggcggctgcccccccggtcggatcactctctctatagcttgagaccgatcctagagccaagacgatctccgcggcgatgatgatggacgccgtgacgatcgtcgagttctccaagggcaagtgcatcctcgtcagccggatcaacagggtttcttggaaaaatccatgcggagaacatactgcgggtgcagccagacgtgcgccagatatacctgctagtacacacgccacaataacccatttgcgaaaacggcgcacccaacaataggtgataatacacggaaccagttccgacctgctttacaaaataaaccacggcgagggctttcccagcacttcggagtaaggcacaaggcctttcacctttcttcccggaggaccgtcgggaaatacaaacggccttaaagggccctgggaagaccaagcctctttgtcaaaggaaaaacgtgcattgacccaaagtggaccgcggacataaagtatcagaataggttcaagagcgatttctaaacatgcgcaagacgcacaccctaatattctattccttccttccgtaaatgatctgattatccataagatatgtttttttcttaagctccttgaggtataaacattttgggagtaaaatccatggcgcccctggtgggcggagggccttgggaatgcgctacacagagtagagtgtgaaataatcggtaactcagcctccataaagagtccccgaatggaccgcgaatagacagaatcctcttctgaggtattatatactctttaggggatgacaatcaggtaacgttacccaacaatacgtcctctttgcgacttcgccaccaggaagacctatgcggaagtgcggtagggtgcgccctcttctgtgctcttgtacaaagaaatgatcccccctctcagaaagagtccccgctatcaaaaactctcacatgttatgaggtggagagtgtcccgcctaggttttctcttcgccgacgtgtgggtatcgccccctgatcaaacc

SEQ ID NO: 94299 - protein, 63 aa, Zea mays
  misc_feature: Ceres CLONE 1583986
MMMDAVTIVEFSKGKCILVSRINRVSWKNPCGEHTAGAARRAPDIPASTHATITHLRKRRTQQ

SEQ ID NO: 94300 - DNA, 850 bp, Zea mays
  misc_feature: Ceres CLONE 1583988
  misc_feature: Encodes the peptide sequence at SEQ ID NO. 94301
  misc_feature (722)..(722): n is a, c, t, g, unknown, or other
  misc_feature (833)..(833): n is a, c, t, g, unknown, or other
ggagctccccgcggtggcggccgctctagaactagtggatcccccgggctgcaggaattcgtctcacccctagaaaaatttaatgaacgcaatcttaaagatacaaaagtaaacaaagaaatattatactctaaatgttgtaaatatggaaaaataaaaataccaccatacaaagaaccaccatcgtttctatctatgttgattaataataaagacaacacattatcaagacattttctacaaaaaattcgacaatataattgccttttctcttttacatctatgggtgcaaagattaataaaaatataaacgatggtcaaggaccatatgttttccgtgtaaatggacaaatacaccaccgtattggttccctgcttcctcaaaaaaataatgatcctaaatttgcagaactatatatttttgatacaaaaaatgagatcgaaaatagaattcaagcattaaataaacaagagggtgaaacaagtaataatataaatccctatatagttgaagagcttaaaaaaatgctcgatgaatataatccattagttaaagtatttagacatgcacgtgacctactcgaagaacacaaaaatatagatattagcatccgcattgttggagcaaacaagggcgatcctatacaatatgaaataccacatacagaagaattagcaatgcttatagttggcgacttaaatctagaaaaatatagaagagnacatattgttagtacaaaaaataaagactacaacatataagtatatttcacccagcatatatggcactacaatatcctttactattcccatatggagaaaagagatttcanctaggaataaagtatca

SEQ ID NO: 94301 - protein, 253 aa, Zea mays
  misc_feature: Ceres CLONE 1583988
  misc_feature (241)..(241): Xaa is any aa, unknown, or other
GAPRGGGRSRTSGSPGLQEFVSPLEKFNERNLKDTKVNKEILYSKCCKYGKIKIPPYKEPPSFLSMLINNKDNTLSRHFLQKIRQYNCLFSFTSMGAKINKNINDGQGPYVFRVNGQIHHRIGSLLPQKNNDPKFAELYIFDTKNEIENRIQALNKQEGETSNNINPYIVEELKKMLDEYNPLVKVFRHARDLLEEHKNIDISIRIVGANKGDPIQYEIPHTEELAMLIVGDLNLEKYRRXHIVSTKNKDYNI

SEQ ID NO: 94302 - DNA, 847 bp, Zea mays
  misc_feature: Ceres CLONE 1583989
  misc_feature: Encodes the peptide sequence at SEQ ID NO. 94303
  misc_feature (450)..(450): n is a, c, t, g, unknown, or other
ggagctccccgcggtggcggccgctctagaactagtggatcccccgggctgcaggaattcgtctcacccctagaaaaagaacctttttaagctctcccatggagtctgacctcatagcttatatagcaaaacaatagaagtagaacaagcacagaactgttaagctccgcaggctgcagctcgtccccaatgtcgtctgcttctcttgcatcttctctcttgtgcagcagcagtgcttctactagtagaagcgcaaccgtgccaagagtaaccaggacccctcttttttccaagaaccagtacaaaccgcctcttcggcctcttaggagtagttcagtagtaaggcgatcgttgcagcaggagcaagaggagagggtgggcccggcgtcctctgtctctgtggcctccggcgagcgacaggaggaggcgacggcgtcgcatcatgttggnaggggtggatgaggccaaggcgtcgggccatgttggagaggcagataaaggaggccaaggagaagtcgacggcgaggagaagaggagcacagacgagcagcaggaggtggactggaagtcagacgaggagttcaagaagttcatgggcaatccctccatcgaggccgccatcaagttggagaagaagcgcgccgacaggaagctccgcgagctggaccgcgagcccgacgccaaccccgtcgccggcctgttccgggggcttggtgaaggaccagctggcccgcgagaagcagaggctggagctggcggagcagacctttcaggcactcgacctcaacagctgaagagctgtttcgggtacgacacgtcttcgccgtggacgtccggaagtcgggca

SEQ ID NO: 94303 - protein, 135 aa, Zea mays
  misc_feature: Ceres CLONE 1583989
  misc_feature (3)..(3): Xaa is any aa, unknown, or other
MLXGVDEAKASGHVGEADKGGQGEVDGEEKRSTDEQQEVDWKSDEEFKKFMGNPSIEAAIKLEKKRADRKLRELDREPDANPVAGLFRGLGEGPAGPREAEAGAGGADLSGTRPQQLKSCFGYDTSSPWTSGSRA

SEQ ID NO: 94304 - DNA, 935 bp, Zea mays
  misc_feature: Ceres CLONE 1583991
  misc_feature: Encodes the peptide sequence at SEQ ID NO. 94305
  misc_feature (703)..(703): n is a, c, t, g, unknown, or other
  misc_feature (706)..(706): n is a, c, t, g, unknown, or other
ctccccgcggtggcggccgctctagaactagtggatcccccgggctgcaggaattcgtctcacccctagaaaaaactttcgcaagcccccttccgaccttgcccctgcggtctcccgagtcccgaagcatccccttccaaaaccctcgccgcgccgcagccacccttgcttccgcacgctatcgcccgggaccagccatctatggcggcgtccctgctcctccgcgccgtgcgccgaagggagcttgcgtcccctctcggatccctgggtgccagcatacagtcaacatgtgttgccaacatatgctcaaaatggggaaggtttgcaagacctttcagtgcaaaagctgctggaaatgaggttatttggggattgatttggggacaacgaaactcatgtggtttctgttaatggaggggaaagaacccaaaagttatttgaggattgctgaaggggcgaggaacaaaccccctcttgttgtcggcatttactccgaaaagggtggaaaaactttttttggaaaactcccccccaagaggcccggggagtaaccccaaccgcccgcgaatacctttctttggggaaaaaagaaaggtagaatttgggggggcacccctttttggtggtccccccgacaccccaaaagggggaatttttaaaaaatgggggcccccaaaccaaacccggtgagggcggccccccncanaaaagggggcgtgctgggtccaacaagaaaagggagcggatccccccccaaattccggggggggggggctttttgggtgagcccaaaatagaaggaaaccgccttgaattttttccttgggcagattgttctctaagagggagggggtttacgggttccggcctttttcaaaagaagcctccccggccggggccccaaagggaagggcgccccctttttttgtggccct

SEQ ID NO: 94305 - protein, 69 aa, Zea mays
  misc_feature: Ceres CLONE 1583991
MAASLLLRAVRRRELASPLGSLGASIQSTCVANICSKWGRFARPFSAKAAGNEVIWGLIWGQRNSCGFC

SEQ ID NO: 94306 - DNA, 854 bp, Zea mays
  misc_feature: Ceres CLONE 1583997
  misc_feature: Encodes the peptide sequence at SEQ ID NO. 94307
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
ctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctccactcctccctcagctctcagagccgtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 94307 - protein, 49 aa, Zea mays; identical to SEQ ID NO: 71211
  misc_feature: Ceres CLONE 1583997

SEQ ID NO: 94308 - DNA, 840 bp, Zea mays
  misc_feature: Ceres CLONE 1583998
  misc_feature: Encodes the peptide sequence at SEQ ID NO. 94309
  misc_feature (710)..(710): n is a, c, t, g, unknown, or other
  misc_feature (711)..(711): n is a, c, t, g, unknown, or other
  misc_feature (726)..(726): n is a, c, t, g, unknown, or other
  misc_feature (727)..(727): n is a, c, t, g, unknown, or other
  misc_feature (729)..(729): n is a, c, t, g, unknown, or other
  misc_feature (730)..(730): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (737)..(737): n is a, c, t, g, unknown, or other
  misc_feature (740)..(740): n is a, c, t, g, unknown, or other
  misc_feature (741)..(741): n is a, c, t, g, unknown, or other
  misc_feature (747)..(747): n is a, c, t, g, unknown, or other
ctggagctccccgcggtggcggccgctctagaactagtggatcccccgggctgcaggaattcgtctcacccctagaaaaacccctttcccaacctcccatcccataccaccccccttcatgtcgtcgccttcctccccgcgcacttgcccctgcatctctccgctgcccaccactccctcgcattaacgacgaaggctcatcatctctgatggaggtaacagtcggctaacacaccgccccgccccgcccctgttgtctgtcccttcattttctagcttagaagagtattcttgttccggtttcttcgttccgtcgagcgcggcattctgtgggtcgtgtggattttggcccgggggacgaggaggaggctggtcaaagatctgtggtcaaaaattgatggtggggttcatggaatgggtgcatgactggttgctgtgggacgccttcctggagtgcggagggatcatgaggccaccgattagatagcggctggggagcgagggaccacaggaggcggaggccgccgttagcaccccccaccaccccgcgccgcgagcaagcagccatgggggaagacctcgtcaccaccctgtccatggagaacggcggcggcggccaccacggcccctgcacgctcctctccatggacccgtccggccacctctccgcgccggacgaccgcgccgtcggcgtcatggtgaaccatccnnaaaggaggggggggnntnnggnnncnggnnccccgncccaacgcggtgggtggcctccagggggcgcctccggcccgtactccatccaagccgtgggcagaacggaccctctgcgaacatggctgggac

SEQ ID NO: 94309 - protein, 91 aa, Zea mays
  misc_feature: Ceres CLONE 1583998
  misc_feature (49)..(49): Xaa is any aa, unknown, or other
  misc_feature (54)..(54): Xaa is any aa, unknown, or other
  misc_feature (55)..(55): Xaa is any aa, unknown, or other
  misc_feature (56)..(56): Xaa is any aa, unknown, or other
  misc_feature (57)..(57): Xaa is any aa, unknown, or other
  misc_feature (59)..(59): Xaa is any aa, unknown, or other
  misc_feature (61)..(61): Xaa is any aa, unknown, or other
MGEDLVTTLSMENGGGGHHGPCTLLSMDPSGHLSAPDDRAVGVMVNHPXRRGGXXXXGXPXQRGGWPPGGASGPYSIQAVGRTDPLRTWLG

SEQ ID NO: 94310 - DNA, 818 bp, Zea mays
  misc_feature: Ceres CLONE 1584001
  misc_feature: Encodes the peptide sequence at SEQ ID NO. 94311
aagctggagctccccgcggtggcggccgctctagaactagtggatcccccgggctgcaggaattcgtctcacccctagaaaaagtcgttctctcacaaactggcattcgatttcgcagcccaccagctccggtttcttccgactgcgagcttccaagtggcgactgcccgagtgcgagaagagggagagaagcggttgtcggaatccactccggccaggggtgcggaggtcggaatggggggaggattagatgaaggtggtgaaggtagtggatttggaggacggtgaaggggaggaagaggcagaagcggacggggtcgacggatcgggcgtgatcatggggaagcagacaaaggtcccagaacatgaggaggacaacaagagcataaactcctgcctctgccttcccaacacacaggatgggccagcgcaaggacaagccgtgctccgataccccctggtgggcacgcctgcggaaccataagccctcccaacctccacgtccaccctgcaaggcttcctccaagggcatggacccctgcgtcgagcgcttgaggagcgggttcccgaagttcaagacccaggtctatgactcgaagccggagctgttcgagcctctcacgtccggccagagccccacgtacgtggggttcacctgctcccacacccgcgtgtgcccgtcagtgaccctgagcctgcaggccggcgagggctcaccgtccgagaatcacctccatggtgcccgctacgagtacatcacgtaccccgggacaagatccgccatcaagtaatcaatgtgcgcactctggtgcaagtcg

SEQ ID NO: 94311 - protein, 123 aa, Zea mays
  misc_feature: Ceres CLONE 1584001
  misc_feature: SWISSPROT Homolog: EC 4.2.1.1 Carbonate dehydratase
MGQRKDKPCSDTPWWARLRNHKPSQPPRPPCKASSKGMDPCVERLRSGFPKFKTQVYDSKPELFEPLTSGQSPTYVGFTCSHTRVCPSVTLSLQAGEGSPSENHLHGARYEYITYPGTRSAIK

SEQ ID NO: 94312 - DNA, 1092 bp, Zea mays
  misc_feature: Ceres CLONE 1584002
  misc_feature (14)..(14): n is a, c, t, g, unknown, or other
  misc_feature (318)..(318): n is a, c, t, g, unknown, or other
  misc_feature (1006)..(1006): n is a, c, t, g, unknown, or other
aagtttatttatanatttagatttggtattagttgatgtaatgttatgaaagaagccttttttatagtggatattttaaagctggagctccccgcggtggcggccgctctagaactagtggatcccccgggctgcaggaattcgtctcacccctagaaaaaagccgcacgcttcttgttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgnaaggggagaaattcgtgagatctgttccggatcaggcgtgcgagctcgggaaacaggggtttcacacatagctttcgtcgatttgaatttgatgtactaatggagtctaagggggggaaaaaagctagcagtagtcgttcccatgatgtatgaagctccccttgggctaccgcatttgaggacgttcgaacctggccggagggcgtgaaaaaagtttcccagtcctgctggctttactccaaactgccgccgaaaaaagcccttcctggaaatccccctttttggggcttccccccaattctaagtaaagttttaagagaaatttccttttttcccgaaacccctttttgattttcctgaaaccaaaaccctctccctggggcccctgccttggccttttccctggaaaaaaatatccggaccccaggtttttcccccccacaagtcctatggggccccccccattgtgaaaagttctctttcccctttcccttcccaattctttcccagggacgattttggggggtcccctggaaaattccaccccgggctccccaaaaaggggcgcctgtttcccttttttcggccagcccgtaaaaggccttcccccccgggggtttacaagatttaatccgggggtttttaagagggcgctcttgaagataaaaccccccctgtgaggaataancaatttctccttgaaaggcacccccttgctttttgtgtggaaccctactatggggagcggggagtttttgtcgtgtcccacccccc

SEQ ID NO: 94313 - DNA, 900 bp, Zea mays
  misc_feature: Ceres CLONE 1584005
  misc_feature (900)..(900): n is a, c, t, g, unknown, or other
aaagctggagctccccgcggtggcggccgctctagaactagtggatcccccgggctgcaggaattcgtctcacccctagaaaaaaaattctaatcaaccgaggcaagccgacctgagaccaagacccgcaccacgcggctcgccgccgatggccaacggggacgccggacgaagcgccgctgctctctgtggaacacctccgtccacgatcctgcagccgccagctcgagctgcgggagttccgcgaccgctacgtgatccgttcgctcgaccgggccaccgctttcgccgtccttcgctcgagcggatccatccgccctctctccccagaggaaaccgcagctgagagcgactgcaaggtttcctgaatatacggggtggcaggcaccataagattgctcgccggaagctatgtactcgttatcacttctctgaaagatgctgggtctcatctgggactccctgtgtaccaagtgaaactcaatgaaattcttatgctgcaacgaggctgatcggacacttgactcacacggaaagaagggatgacggcgtactttcatgtctctccctgagaagtgccagaaacctccctgcgggactgtaatttagtcccaacacccgggaattgtgaccggtaaagcttgcaaagggccttcccacttcggctggccgggaaggggtactccaaacccaccatgggaagcgggccttatccaacgttgtttttctggggacaccaaaattctgggtagagagaaaaccggttggaaagccaacccatgtgaaggagtatacgtccagccccattggggctccggggaaaagtttttccagcccaagaacctattatattccttggtaagggaaaaaaaacacggtgggaggaaaaaaccctgggtn

SEQ ID NO: 94314 - DNA, 1050 bp, Zea mays
  misc_feature: Ceres CLONE 1584006
  misc_feature: Encodes the peptide sequence at SEQ ID NO. 94315
  misc_feature (1)..(1): n is a, c, t, g, unknown, or other
  misc_feature (18)..(18): n is a, c, t, g, unknown, or other
  misc_feature (80)..(80): n is a, c, t, g, unknown, or other
  misc_feature (733)..(733): n is a, c, t, g, unknown, or other
nttttggtttcttttggnctgtcgggggttagcagaaatattacatcatatgaggaaaggaaaagaatggtggtggtttngttcaagctggtgctccccgcggtggcggccgctctagaactagtggatcccccgggctgcaggaattcgtctcacccctagaaaaaattttccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcagccggccggacaccttcttcgccgccgccgactccgtaaggtctgtctgcacggaggtggccacggacctgcacatcctcgtggataactgcctctacccatctccaacaagattccccctgctctcgaaatgcatgctcctgcaagcgctgtgcgcccgaacccccggcgaacttcctccgtccagcctccccggggtttcccggggcggcccccaaaaggggtttcaaagggcccgtcccccaatttacctgggttaacgggcaatccaaccattcaaccgggtggaagcggcgggcaccaaaccttgggttcccccccccctgccgggtggaacctctgggggaggggctccaaccctctggggccacattttttccgagaaaagggcccncgcccccataaagagggggggggaaaaaaaccttccccccggggggccaaaaaatcttaggaaaacccggtttccccttagggaactccccggggcccacacccggggcgccccccttttgggaaaaaggaaaacccgccctgggggccatgggtttccaatttcccataggggacccaccccaggccccgcggtttttgtgagaggagaacccggggggccctctcctttcccccctttcggtctaaaacaccttgggcccacccccttatttccccaaaccccggaaaaccccccccaaagatccaacagtgggg

SEQ ID NO: 94315 - protein, 93 aa, Zea mays
  misc_feature: Ceres CLONE 1584006
MKFMRLGSRPDTFFAAADSVRSVCTEVATDLHILVDNCLYPSPTRFPLLSKCMLLQALCARTPGELPPSSLPGVSRGGPQKGFQRARPPIYLG

SEQ ID NO: 94316 - DNA, 834 bp, Zea mays
  misc_feature: Ceres CLONE 1584015
  misc_feature: Translation starting site: 262
  misc_feature (314)..(314): n is a, c, t, g, unknown, or other
  misc_feature (725)..(725): n is a, c, t, g, unknown, or other
ctggagctccccgcggtggcggccgctctagaatagtggatcccccgggctgcaggaattcgtctcacccctagaaaaatgttagtttgaggcgccgccttatggtagacccgcatcttccaaaggaggaggacagatcatccaaccttgttgttgacaacccgctctctcagaacccagatagcagctggggccgcttctttagaggggctgagttggagaagacagttgaccaagacttgtctcgattatatccagaagatggtagttactttcaaacgcctagttgccaggccatgctcaggagaatactngttgatgtggtgccttcagcacccagagtgtggatatcgccaaggaatgcacgaactactagctcctctagtgtatgttcttcaagttgacattgataaactatctcaagtaaggaagctccatgaggattgcttcaatgatgattttgatggagtggctttcccagatacagatatgcttttcagttataaacctagaaaggactcaaactggcattccagggctgacaatggcgatgattctgaaagcgcttccagagttaacactcttgatgagcttgacctggatacgaaagaaataatttcacttagtgatgcatatggagccgaaggtgaactaggcattgtattgtctgaaaggttcatggaacatgatgcttattcaaatgttgatggtttgatgggacgagnttagtggagtggtctgcatggcagagtttttctctacaccaaaggtggatctagctcaagtctagcacctgtcattgaagcctcagcatctttatttcatttgctttca

SEQ ID NO: 94317 - DNA, 822 bp, Zea mays
  misc_feature: Ceres CLONE 1584022
  misc_feature: Encodes the peptide sequence at SEQ ID NO. 94318
  misc_feature (588)..(588): n is a, c, t, g, unknown, or other
ccgcggtggcggccgctctagaactagtggatcccccgggctgcaggaattcgtctcacccctagaaaaagataatcgcaacatatccattcttgggaatgctccatatggaagacagcaatcagcctcattgttggaaggagctccaaggacaaacatcgacagcctctatggacaaggatcgtcaggcactggttttggtgcaggtcttcctcctggacgtgattatgcctcagtgaaaggcctgccccatccatcttcagaccctgatcaccgagatagcatcttaccccgtgtacatccagccgtctcaatggttgatgatcgtagagttgatcgaattggttatcgtcgtgaactggatctaagagatgaggaacgcagaagggacctaatactggaaagagagaaggaacttgaacgggaacgggaacgagaacgggaacgtgagttacgggactttcgagatcgtgaaagggaaagagaacgtgaaagggaaagggatcatgaaagactactaagagaacgtgaaagagaaagggaacgcgaacgcgaacgtgaaagagagcgcgaaagagaacgcctccntgagcgccgggagaaggagagagagcgggataggaagcacagaactgatccaaggcgggagcacactccacctagaggccctggtgatcggcggcggtcttcttctgttagatctgagaagcctgtacggcgaatttcccctcgacgtgatgctgtgcataggcatcgttcacctgttaagaaataaagagagatatatttgcaaggtttttccatttcgcttcgtggatgatt

SEQ ID NO: 94318 - protein, 257 aa, Zea mays
  misc_feature: Ceres CLONE 1584022
  misc_feature (196)..(196): Xaa is any aa, unknown, or other
RGGGRSRTSGSPGLQEFVSPLEKDNRNISILGNAPYGRQQSASLLEGAPRTNIDSLYGQGSSGTGFGAGLPPGRDYASVKGLPHPSSDPDHRDSILPRVHPAVSMVDDRRVDRIGYRRELDLRDEERRRDLILEREKELERERERERERELRDFRDRERERERERERDHERLLRERERERERERERERERERERLXERREKERERDRKHRTDPRREHTPPRGPGDRRRSSSVRSEKPVRRISPRRDAVHRHRSPVKK

SEQ ID NO: 94319 - DNA, 1203 bp, Zea mays
  misc_feature: Ceres CLONE 1584024
  misc_feature: Encodes the peptide sequence at SEQ ID NO. 94320
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (26)..(26): n is a, c, t, g, unknown, or other
  misc_feature (44)..(44): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (657)..(657): n is a, c, t, g, unknown, or other
  misc_feature (658)..(658): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (733)..(733): n is a, c, t, g, unknown, or other
  misc_feature (792)..(792): n is a, c, t, g, unknown, or other
  misc_feature (793)..(793): n is a, c, t, g, unknown, or other
  misc_feature (808)..(808): n is a, c, t, g, unknown, or other
  misc_feature (809)..(809): n is a, c, t, g, unknown, or other
  misc_feature (827)..(827): n is a, c, t, g, unknown, or other
  misc_feature (828)..(828): n is a, c, t, g, unknown, or other
  misc_feature (910)..(910): n is a, c, t, g, unknown, or other
  misc_feature (936)..(936): n is a, c, t, g, unknown, or other
  misc_feature (962)..(962): n is a, c, t, g, unknown, or other
  misc_feature (979)..(979): n is a, c, t, g, unknown, or other
  misc_feature (1045)..(1045): n is a, c, t, g, unknown, or other
  misc_feature (1203)..(1203): n is a, c, t, g, unknown, or other
nnnnnnaacggggnncnnnccccccnacacccccccatcagcanaggagaagaatgtgtnnnnagaagagggaggtccccccggtggcggccgctctagaatagtggatcccccgggctgcaggaattcgtctcacccctagaaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcagcgacgacgggcaggccgtcaacttccggggcaacccggcggacaagtcgaggaccggaggttggctgggcgccgggctgatcctgggcacagagctggcggagcgcgtgtgcgtgatgggcatctccataaactgggtgacgtacctcgtcagagaggcggcccgctccaaacgccaggtccgccacctaggtgaacaaacttctatgggcaaaacgcacacctgggcgggcccccggggggggggtttccatcggcgaagagccaaagtacgagccaggctcgtcttgtccattgtgtcatgcttctagcgcaaaaatagggnngcccaactaggcaggagcaagcttggcctaaaagcggtggggaaaatgcccgcgggggcacnnngaaaacatatnttcttctgctaccgtaacatagtcattccgaataaaaccaacctacccgagagacccanntaccgcgggcggagnncacaagacgcgaagtttnncacccaccaaccgttcagcatatacgtaagataaagcatattagaacgaagagacccgggaaaagagtacaactacaccggntcctatatcgacggcgcccttgtttnaaaaacaaagcaatacaataaagcgnattggtagcgaaccctncaccattgaggagaaatacgaataaaggtgtgccgcacgtatataaggcgggtgcggaagaattanttaaaaccagagcggaggggagagcggtttggggtggtgagagagaaaaaagaggaccggcacatatttcgggagctttgcgaccttctgtcaaggagctcgccgtcctaaaagtgtggcgaggtggcaaagtgcgcgacgaggcgggcactcgtgan

SEQ ID NO: 94320 - protein, 115 aa, Zea mays
  misc_feature: Ceres CLONE 1584024
MVSGAGHGGYGGSDDGQAVNFRGNPADKSRTGGWLGAGLILGTELAERVCVMGISINWVTYLVREAARSKRQVRHLGEQTSMGKTHTWAGPRGGGFHRRRAKVRARLVLSIVSCF

SEQ ID NO: 94321 - DNA, 843 bp, Zea mays
  misc_feature: Ceres CLONE 1584026
  misc_feature: Encodes the peptide sequence at SEQ ID NO. 94322
cggccgctctagaactagtggatcccccgggctgcaggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccgggcgacgagctcaaggtgtccaaagcggagttcatcgacctggcgcgcaagtccggcaaagtcgacgaggacagcctggcgttccagtcgcgtctgctggccaagtccggcatcggcgacgagtcgtacatgccgcgctgcgtgttcgagcccaacgccagctgggccaaccaggaaggaggggcgcggccgaggcgtcccacggccatggttcgcgggggcttggacaagctggttcaacaaatggccgccgtccggccaagggacgtggg

SEQ ID NO: 94322 - protein, 223 aa, Zea mays
  misc_feature: Ceres CLONE 1584026
  misc_feature (115)..(223): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPGDELKVSKAEFIDLARKSGKVDEDSLAFQSRLLAKSGIGDESYMPRCVFEPNASWANQEGGARPRRPTAMVRGGLDKLVQQMAAVRPRDV

SEQ ID NO: 94323 - DNA, 922 bp, Zea mays
  misc_feature: Ceres CLONE 1584035
  misc_feature: Encodes the peptide sequence at SEQ ID NO. 94324
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (372)..(372): n is a, c, t, g, unknown, or other
  misc_feature (432)..(432): n is a, c, t, g, unknown, or other
ctccccgcggtggcggccgctctagaactagtggatcccccgggctgcaggaattcgtctcacccctagaaaaaatcccgcagcccgccccgtccgcccgcccgagtcacactcacacagagccgagccgagcccaggcaggcaggcaggcggcccaggcgcccagcccacccccctacccccgcggcgccgccggagccagagcgagagcgatggacgcgctgccggaggcgtggtcgcaggtgcgcgcgccggtgatcgtgccgctgctgcggctggcggtggccgtgtgcctcaccatgtcggtgcttctgttccttgagcgcgtgtacatggccgtcgtcatctccgggggtgcgcctgnnntcgctncggcccgaacggcgctaccgctgcgaccccctccccgaggacgaccgggagctggctccntcccgttccccgtcgggcgtcgtccgatccccctgttcaacgagcgcgaggggtacaactgtccattcgcccccttgggcgggcttgtcggggcggcggaaccgcttgggggggcagggcctcaccaaccccccggacaaaagaattaaagaaaatggtcccaaagaagtccaaaccgggggctcccaaaggggaccaaaaaaccctccccaacccggggagcccccagggggaaacaaggccggccccctccgggggggggaaaaagacccccaaattggccccacctggaaaaagggggcctttttttaggcccaattttttcccgccgccgggaattctcgggggggttttttcctttttttgtataaaaaagagaaaaaactcctcttcaaaaccctctgtgtgggtttttgaaacccgagaaggcgtttttagaggggaggggggggggagtctccctaacaaccctctctccggcgggaggggg

SEQ ID NO: 94324 - protein, 122 aa, Zea mays
  misc_feature: Ceres CLONE 1584035
  misc_feature (51)..(51): Xaa is any aa, unknown, or other
  misc_feature (52)..(52): Xaa is any aa, unknown, or other
  misc_feature (54)..(54): Xaa is any aa, unknown, or other
  misc_feature (74)..(74): Xaa is any aa, unknown, or other
MDALPEAWSQVRAPVIVPLLRLAVAVCLTMSVLLFLERVYMAVVISGGAPXXAXARTALPLRPPPRGRPGAGSXPFPVGRRPIPLFNEREGYNCPFAPLGGLVGAAEPLGGAGPHQPPGQKN

SEQ ID NO: 94325 - DNA, 869 bp, Zea mays
  misc_feature: Ceres CLONE 1584036
  misc_feature: Encodes the peptide sequence at SEQ ID NO. 94326
  misc_feature (558)..(558): n is a, c, t, g, unknown, or other
ggagctccccgcggtggcggccgctctagaactagtggatcccccgggctgcaggaattcgtctcacccctagaaaaacttgatgttgatttggaaagacagataactgcagcaattgatccaaagctacttcaacatttggtgaatgctctcttcagaggtacattaagcataaatgattctgatctgtctgaaccatcagatgctgaagtggatgctgtaggatgtatttgtgcttttcttcatgtcacattcaatacattccctctagagcgaattatgactgtactggcctaccggactgaaattgttcctgcactgtggaacttcataaagcggtgccatgcaaaccgaagatggccatttttttcgaagtttgcatcttcattacctgctgatgctcctggttggctccttcccatgtctgtattctgtcccatatacaagcacatgttgaagatcatttgataatggggagttttatgagcaagagaaacccctttcccttaaagatttgaagtccttggttcttattttaaagcaggcattatggcaacnttttgtggattattccatcctcttctactcagaaagtgtcatcccaccccttcagccttaagaaagtgtcagtggagaatgtcagatcagagctaggggttgggttgtctgaattgctcacacagtgcaagactggaacaaccgacttccattcacttctgcaagtgatttctattcccaggagctacagcgaaaattttgtgtctcaggcaataacttggtatactcgagcatcgagatcaaaagcttgcccccttttggggtccctttacgggtcagtcaaaaattcccctcccaaataccagttccaa

SEQ ID NO: 94326 - protein, 155 aa, Zea mays
  misc_feature: Ceres CLONE 1584036
GAPRGGGRSRTSGSPGLQEFVSPLEKLDVDLERQITAAIDPKLLQHLVNALFRGTLSINDSDLSEPSDAEVDAVGCICAFLHVTFNTFPLERIMTVLAYRTEIVPALWNFIKRCHANRRWPFFSKFASSLPADAPGWLLPMSVFCPIYKHMLKII

SEQ ID NO: 94327 - DNA, 852 bp, Zea mays
  misc_feature: Ceres CLONE 1584042
  misc_feature: Encodes the peptide sequence at SEQ ID NO. 94328
aaagctggagctcaccgcggtggcggccgctctagaactagtggatcccccgggctgcaggaattcgtctcaccccctagaaaaaaggggtgcggcgctgcggtggcgcgagacgggctcggcacggcggcggtgtgacggcctcacgcggagtcgcggctgcgacgacggcgtgcatggactcgggtcagcacgggtccggtggagggccgtgcgcccgtgcctaggccgtgctgcccgtttcccatgtatcccttccccatatccatacctgtgttccatatgccatatccaaacgcctactcgcttctcccgtcgtcttccccgctcctacgacctgcgtttgtcgatgctctctccatggcaccctctcctctcccccgttgcacctcctgccatggagctacggtcaccgctgaactcacataactgctcccttacctcctccattagaccaccgccaccgcgctccttggcgcgggcgccccccacgctttccgccaccgcagcagccgtctcgtcgctgtccgccacctcagcggccatctcgtcgccttcctgtccaaagaagaaggtcaggtctccattcgccacccctgtcgccgaaagcacctcgatgttaaacttttcgtcgcgcctttctattgcgaaagttctcggggcccatcgccatggggtactgaggagatggaaggcggtcattcatcggccgggtgtcctttcgggcggggcttcccgctgtaggtgaaccctttcccttctggtgggaaggaccggccctctgagggtggaaggggggtccttggcgggctccccggcaatcatttgcgcgggacaacgcccaccatttgg

SEQ ID NO: 94328 - protein, 248 aa, Zea mays
  misc_feature: Ceres CLONE 1584042
KLELTAVAAALELVDPPGCRNSSHPLEKRGAALRWRETGSARRRCDGLTRSRGCDDGVHGLGSARVRWRAVRPCLGRAARFPCIPSPYPYLCSICHIQTPTRFSRRLPRSYDLRLSMLSPWHPLLSPVAPPAMELRSPLNSHNCSLTSSIRPPPPRSLARAPPTLSATAAAVSSLSATSAAISSPSCPKKKVRSPFATPVAESTSMLNFSSRLSIAKVLGAHRHGVLRRWKAVIHRPGVLSGGASRCR

SEQ ID NO: 94329 - DNA, 1246 bp, Zea mays
  misc_feature: Ceres CLONE 1584050
  misc_feature: Encodes the peptide sequence at SEQ ID NO. 94330
  misc_feature (7)..(7): n is a, c, t, g, unknown, or other
  misc_feature (8)..(8): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
gatgggnngggggggagggacggcgcgnnncgggggcacgccagcccagagaaaaaccaacagtgcaagttgggggtgacctcggtggcggccgctctagaatagtggatcccccgggctgcaggaattcgtctcacccctagaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcgggcgagcagggagaagacaccgagtgggtgacggtgaagttcggctggaaagaaccgtccgaggacgactggatcggcgtcttctctccgtctgaattcaactcgtcggctacatgtccgaacccatggccaggcagaagaaccctatctctgcacagcacccatcaaagtatcaggtcccccaacctactccggcgaaactaccatctaactgggggcaaaggggcaagcatcccgggtttgcaagcttccatccaacccaggcaccttccgaaactgttcttcccttgcgaccctgctgttcaaccgggggggggccttcatttcaaacccccgaaagggtttgaaaatccccgcggtgggctccgcctaacccccacattattcgcgattgcaagtggaaaacgccccgcccgggggcgcccgccgcgcgtggtgttgtatcgaccgggtaggacccgatggaggcgggcacataagggtgcgacccgtgtctcctaccctactaacacagaaaaataataatcactcgcgggtaaaaagatatggagaaccccggggcggggaggtgtaggagcacacgcatgggtggaattgggaagggggagacacacacccccatttttccactgaagaaagcgaggggcgagggcctcccccctttggtgtcctctaccccgcggaggaacgagagagatcctcacacataagaaaaaatttatgtactgtgagcgcggatatctttccccccgtgaggaggagaaaagatcttcgcccgctgtaaagaaacatcgcgagcgtataaaacatcatttttcccggcggcctaaaatacaagggggacgggaaagtgcgggtg

SEQ ID NO: 94330 - protein, 87 aa, Zea mays
  misc_feature: Ceres CLONE 1584050
MAVALLAALVASAAMLAGTASASPAEGIQPLSKIAVHRATVEMQPSAYVRATPSLLGRAGRRHRVGDGEVRLERTVRGRLDRRLLSV

SEQ ID NO: 94331 - DNA, 859 bp, Zea mays
  misc_feature: Ceres CLONE 1584053
  misc_feature: Encodes the peptide sequence at SEQ ID NO. 94332
cccgcggtggcggccgctctagaactagtggatcccccgggctgcaggaattcgtctcacccctagaaaaaatcccagcacgtctcgtctcccggccctcccacaaaaaaaaactgctcggttgctgctcctgctccgccgcgccggcatcatgtgtggcatcttagccgtgctcggttgctccgactggtctcaggcaaagagggctcgcatcctcgcctgctccagaaggttgaagcacaggggccccgactggtcgggcctttaccagcacgagggcaacttcctggcgcagcagcggctcgccgtcgtctccccgctgtccggcgaccagccgctgttcaacgaggaccgcaccgtcgtggtggtggccaatggagagatctacaaccacaagaacgtccggaagcagttcaccggcacacacaacttcagcacgggcagtgactgcgaggtcatcatgcccctgtacgagaagtacggcgagaacttcgtggacatgctggacggggtgttcgcgttcgtgctctacgacacccgcgacaggacctacgtggcggcgcgcgacgccatcggcgtcaacccgctctacatcggctggggcagtgacggttccgtctggatcgcgtccgagatgaaggcgctgaacgaggactgcgtgcgcttcgagatcttcccgccgggccacctctactccaagcgcggcggcgggttcccgcggtgggtacacccccgcacctggtttccaggaccaagtggcccgggaagcccttaaccagccggctcgtccttcagaaaaaggcctttccgaaaaaaggggggccattcaaggaaggcttcaatggaactgaacggtccc

SEQ ID NO: 94332 - protein, 207 aa, Zea mays
  misc_feature: Ceres CLONE 1584053
  misc_feature (2)..(162): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIMPLYEKYGENFVDMLDGVFAFVLYDTRDRTYVAARDAIGVNPLYIGWGSDGSVWIASEMKALNEDCVRFEIFPPGHLYSKRGGGFPRWVHPRTWFPGPSGPGSP

SEQ ID NO: 94333 - DNA, 829 bp, Zea mays
  misc_feature: Ceres CLONE 1584054
  misc_feature: Encodes the peptide sequence at SEQ ID NO. 94334
ctggagctccccgcggtggcggccgctctagaactagtggatcccccgggctgcaggaattcgtctcacccctagaaaaaatccatcgcgaagaacgccgccgcgatcccacgcctccccgatcacgatcaggcggcagctcgtgtccttcgtgctccagtgctccagatcctgcgctcccctcctcgagcccaagaacctgcccgatgagttcgaggccgtgccggcgacgacgacgccgccgctgccggacgccgccccgaagctggggatttctaacaagttcatccgaggcctctgcggcgacccgcagaccgagcagctggccttcgagggctacaggagggcgctgctgcagcccgagttccggctggagaagaagacggccaacgcgctgaccctgcagctgatcagggagaagcagtggggctcgctggagctgctggtcgaggacttcagggcccacggcgtgctcccggagaagcggacgtgcgcgcggctcgtcgcctgctgcatcagggcggggcggttcggactcgccgacgcggtgctcggggtcgtcgaggcgaagaagggagcccccgctgccatggccttcagcgcggccatgcaggcgtacaacaggctgcacatgtacccggagaacggtgcttctgtacgggcaaggcaaggggtggcccgcctgccgctgaacgccgacgcctaccgtgccgccaatggccggcttgcgggcccgccttgggcgaagccggacatgggggggcttcccctgttcaagcttgtacagggtcccaacaaattgggtacccccttccggaaaggcttgcga

SEQ ID NO: 94334 - protein, 80 aa, Zea mays
  misc_feature: Ceres CLONE 1584054
MAFSAAMQAYNRLHMYPENGASVRARQGVARLPLNADAYRAANGRLAGPPWAKPDMGGLPLFKLVQGPNKLGTPFRKGLR

SEQ ID NO: 94335 - DNA, 858 bp, Zea mays
  misc_feature: Ceres CLONE 1584060
  misc_feature: Encodes the peptide sequence at SEQ ID NO. 94336
  misc_feature (524)..(524): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
ctggagctccccgcggtggcggccgctctagaactagtggatcccccgggctgcaggaattcgtctcacccctagaaaaagctttcccacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaaagctgaaagcctcccagctatggttagtggggtttattcggatgataatacccttcagcttgagggccacacacagntccgcaaattgctctctatagagaagagtccccccatcgaaagagttatcaaaacaggtgtagttccaaggatttgtgcagtctctccacagagaggaatttcccccagctgcagtttgaaaactgcatgggcctctcaccaaaaattggttcctgggacctcagaaaaatccaaagggtggttattgaaccaggggaccggttcccaaattttggggaaaactttcttggggccggggaaaaaaaaaaaattttccccaaaaaaaccgctggttggggggccttttttggaaaaaaaaataannnnnnnggggaaaagagagtctctctacaa

SEQ ID NO: 94336 - protein, 203 aa, Zea mays
  misc_feature: Ceres CLONE 1584060
  misc_feature (4)..(92): Pfam Name: IBB Pfam Description: Importin beta binding domain
  misc_feature (93)..(93): Xaa is any aa, unknown, or other
  misc_feature (194)..(194): Xaa is any aa, unknown, or other
  misc_feature (195)..(195): Xaa is any aa, unknown, or other
  misc_feature (196)..(196): Xaa is any aa, unknown, or other
MSLRPSERVEVRRNRYKVAVDAEEGRRRREDNMVEIRKSRREESLLKRRREGLQAQVPAPPSGVEKKAESLPAMVSGVYSDDNTLQLEGHTQXRKLLSIEKSPPIERVIKTGVVPRICAVSPQRGISPSCSLKTAWASHQKLVPGTSEKSKGWLLNQGTGSQILGKTFLGPGKKKKFSPKKPLVGGPFLEKKIXXXGKRESLY

SEQ ID NO: 94337 - DNA, 831 bp, Zea mays
  misc_feature: Ceres CLONE 1584076
  misc_feature: Encodes the peptide sequence at SEQ ID NO. 94338
aaagctggagctccccgcggtggcggccgctctagaactagtggatcccccgggctgcaggaattcgtctcacccctagaaaaaatggccgcccccattatcctttccctgcgtcgaaggcgcatcttttcctagctctccccaacaaccctacccgtttcctggcctccgcctccgtccgggtcgcctatcctccccggtggcctctccgcgccgccgacggggagcgggacaaccgcgtgcaggagctgagggtgcccgattcttggctgacgcctgcaggagcaacgcaggaatctgaatggctgagggagacactgcgcaagtggctcgacgacgagtactgcccggagccggccaacgtggacatcagcagcaccgccgcgcggtcgtatcgcgaatccctgatagcgcggcagtctgatctgggagagatcttgctgaggatggtgggcgacctggacaagctgtcgtacagggagagcttccacggccccttctcggccgccaacgctgcagtccgtttgatcgctcagaggatggaggagtcactgcctgatgaatgacggtggtgcgcgacctggagtttctatatggcacgacttttgatgaagtcgtaggctatatgtacttttgatgaagaacaattcgatcaccattcctcaccgaggctgtcgctgacagaaaatggtgagaataggctcgagacttcatttttctgctgaaatcgccaacgtactattctgtttatgagcatgtctttgagacgagcggtgaaatgcccaacgagtgggtcttaagggagtgaaaaaaaaacacgcgtccacgcct

SEQ ID NO: 94338 - protein, 39 aa, Zea mays
  misc_feature: Ceres CLONE 1584076
MVGDLDKLSYRESFHGPFSAANAAVRLIAQRMEESLPDE

SEQ ID NO: 94339 - DNA, 918 bp, Zea mays
  misc_feature: Ceres CLONE 1584084
  misc_feature (324)..(324): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (918)..(918): n is a, c, t, g, unknown, or other
ctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgacaccgtccaacaactacgcagcaccaagcagctgaaggcggccaccgtatcttcctgcctgagcctcgtccccaccgtgcaccaccgggccggcgggttccccancagtgtggcactgacgaacacgcttcagcgccgtcgtcgttctcgccggctatcttgtcgtcgcctcggcgacgagagccgacaggtaggccgccccctgtgacaatccaagaccgtggacctcaggctctcatcaagcccgcgggcgaaaacgggggattttccccccccgtgggcgggagggcccacggaagcaaaaaaaattggggaggggtggtggagaccccttagaggggggggccctcccgggaagtcctccccctccgcggggatttccccccagggccccccccaagaaaaggttttttaaataaaaacggctttctccccccctatttgggggggggttttctcaaattcccccgcgagaaaaaatctttttnnntcttttctccccaaaaagggggggnnnnnnnnnnnggggcggccggggttttaataaagaaacccaccttctttccccccggcgggaggaaaaaggtcccccccctggggaagaagggggcccccaaaagagatggggggagggggggcggccccttcggggggggggggggggggggccccaccacaaaaaaaaagcgcccccgcctn

SEQ ID NO: 94340 - DNA, 932 bp, Zea mays
  misc_feature: Ceres CLONE 1584085
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (120)..(120): n is a, c, t, g, unknown, or other
  misc_feature (316)..(316): n is a, c, t, g, unknown, or other
  misc_feature (860)..(860): n is a, c, t, g, unknown, or other
  misc_feature (861)..(861): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaagctgggactcaccncggtggcggccgctctagaactagtggatcccccgggctgcaggaattcgtctcacccctagaaaaacccctcacctctcactaccaccaccactgccccggatccataccagctgcagcagcagcgcgcgctagctagcttcggtcggtcgatagatcgatcgatcgctcggccatcatgacgcaggaagagcangcgctgctgtcgacagagatcaatcagcgcgtgtagctgtcggacctagacgccggctcgcctgcctctcggtggaatggcccgccccctgccgaattactgcaatcggtgaacccaagtactggcccctggggtaacactaccttttccccccgggggggtaactgggaaccaaatcccggatattttcctggttggcgggcccccaattgggggacccccaggccccgccaaaatttttgggccaaaggttttgggggggagggccccccttttaaattctccccccgggggaggcgggttttttcccccgggggctggccctaaaaaaaaaactccgggggaaaaatttttttcccaaaacccacggggccgcggtggagaaaatcttaagaaatttttctataaaaaaaaaaacccccccccccaaaaaaatcctgggggggggtctccaggcgggggggggttttcttcccccccccggggggggccagttttttttccgggggggtttttccccaaaaaaaagaaacacacccggggnnacaaaacctcctccctctcccgggggggggggcgccccccccccccacttgtggggggaagaagaataact

SEQ ID NO: 94341 - DNA, 961 bp, Zea mays
  misc_feature: Ceres CLONE 1584086
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (386)..(386): n is a, c, t, g, unknown, or other
  misc_feature (387)..(387): n is a, c, t, g, unknown, or other
  misc_feature (394)..(394): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (426)..(426): n is a, c, t, g, unknown, or other
  misc_feature (427)..(427): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (479)..(479): n is a, c, t, g, unknown, or other
  misc_feature (525)..(525): n is a, c, t, g, unknown, or other
  misc_feature (527)..(527): n is a, c, t, g, unknown, or other
  misc_feature (536)..(536): n is a, c, t, g, unknown, or other
  misc_feature (552)..(552): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (563)..(563): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (594)..(594): n is a, c, t, g, unknown, or other
  misc_feature (626)..(626): n is a, c, t, g, unknown, or other
  misc_feature (627)..(627): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (673)..(673): n is a, c, t, g, unknown, or other
  misc_feature (677)..(677): n is a, c, t, g, unknown, or other
  misc_feature (679)..(679): n is a, c, t, g, unknown, or other
  misc_feature (686)..(686): n is a, c, t, g, unknown, or other
  misc_feature (688)..(688): n is a, c, t, g, unknown, or other
  misc_feature (689)..(689): n is a, c, t, g, unknown, or other
  misc_feature (695)..(695): n is a, c, t, g, unknown, or other
  misc_feature (696)..(696): n is a, c, t, g, unknown, or other
  misc_feature (698)..(698): n is a, c, t, g, unknown, or other
  misc_feature (699)..(699): n is a, c, t, g, unknown, or other
  misc_feature (702)..(702): n is a, c, t, g, unknown, or other
  misc_feature (708)..(708): n is a, c, t, g, unknown, or other
  misc_feature (709)..(709): n is a, c, t, g, unknown, or other
  misc_feature (724)..(724): n is a, c, t, g, unknown, or other
  misc_feature (726)..(726): n is a, c, t, g, unknown, or other
  misc_feature (730)..(730): n is a, c, t, g, unknown, or other
  misc_feature (731)..(731): n is a, c, t, g, unknown, or other
  misc_feature (734)..(734): n is a, c, t, g, unknown, or other
  misc_feature (738)..(738): n is a, c, t, g, unknown, or other
  misc_feature (739)..(739): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (751)..(751): n is a, c, t, g, unknown, or other
  misc_feature (783)..(783): n is a, c, t, g, unknown, or other
  misc_feature (786)..(786): n is a, c, t, g, unknown, or other
  misc_feature (787)..(787): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (807)..(807): n is a, c, t, g, unknown, or other
  misc_feature (817)..(817): n is a, c, t, g, unknown, or other
  misc_feature (818)..(818): n is a, c, t, g, unknown, or other
  misc_feature (828)..(828): n is a, c, t, g, unknown, or other
  misc_feature (839)..(839): n is a, c, t, g, unknown, or other
  misc_feature (852)..(852): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (901)..(901): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (938)..(938): n is a, c, t, g, unknown, or other
  misc_feature (960)..(960): n is a, c, t, g, unknown, or other
ctggagctccccgcggtggcggccgctctagaactagtggatcccccgggctgcaggaattcgtctcacccctagaaaaagcagtctgcacctttgcccatggcctaggcgcctagctcaggccgtagctcagcgtccgtccatgggccagggagtctgaaaccttgcttgccttgcctgcccgctcctctcacttctctctctcctcctcgctcgtgtccccggcgttctgctggtccctggggactgaagaaccaaagtcttccccctttgccctggcttgttttttaaaagtggggcccccggggggtttgggcctccccccccccccccnnnaaaaaaaaaaaaaaaaccccccccccccccccccnnnnnnntgtggtggnnttgttgntgaagggaaaagaaaaaannnaatataaaaannaaaaaaaaannnnntnnnnnnnttttttctctcctttgcctctcgcctttgnttttggtggagtggtgggggaaggagagggaaaagaggagaggggngngaaaaaganaaaagaagaatagganaaannnnnnanagacgggnnnnnnnnnnnaaagaggagaaangagaggagagaggggagaagggcgggaggatnnacctcggnnnnntannnnnnnnnnnnccccnnnnnnnnnnnttggnttgnanactaggngnnggcggnngnnggngggaanngggggggcgccgttnanaagnncancggnnannnnnncacanaaagaagaacgagggaaccactattatttttnttnntttatttnnnnnnngacagnaaaggcgtgnnccatctgtgngtacccggggntacaggccggggngtgaattggcagggtnnnttcatgtcctcttnnntgcgtggcctggcgnacagaagttgagggagatgagggagggnnnnnntgtnttgacgtatatcaaggagtctna

SEQ ID NO: 94342 - DNA, 842 bp, Zea mays
  misc_feature: Ceres CLONE 1584089
  misc_feature: Encodes the peptide sequence at SEQ ID NO. 94343
  misc_feature (749)..(749): n is a, c, t, g, unknown, or other
tggagctccccgcggtggcggccgctctagaactagtggatcccccgggctgcaggaattcgtctcacccctagaaaaaatcctcccctccgcccaccaacgcagcagcagccagcagccccgccacttcccccctcgccgcttgcgatggcggtcacgcgcgtcgccgtggccgccgccctctcggcggccccgctctcctcccgccgccaccgggttgccctcccctccgcctgccgccttctccccgcctcggccacctgctgcaacagccgcgcgccgatgtctctgcaggccgccgccgccgcacctgccgccggcgcggtcgacgaggagactcctgcctcctcccctccgtcagatgctagcaagggggtggagaacctggtgatcatcggctctggaccagccggttacaccgctgccatctacgccgcccgggcgaacctgaagcctgtcgtgtttgaagggtgccagatggggggtgtccccggcgggcagctgaccaccaccgaggtggagaatttccctggcttcccggacggtataaccgggcctgatctcatggacagaatgcgcaagcaagcggaacgctggggcgcagagctttaccaagaggatgttgagtttgtgaatgtaaagagcagcccgttttgtattcgtagcagcgaccgtgaggtgaaatgtcatagtctatttattgcaactggagctacggctaagcgccctccgtctgcctcgtgaagatnaatttttggagtagaggcatcagcgcatgtgcaatatggtgatggagcttcaccacttttcaagggcaagttctgcaattgtgtggggggggg

SEQ ID NO: 94343 - protein, 153 aa, Zea mays
  misc_feature: Ceres CLONE 1584089
  misc_feature (34)..(154): Pfam Name: Pyr_redox_2 Pfam Description: Pyridine nucleotide-disulphide oxidoreductase
  misc_feature: SWISSPROT Homolog: EC 1.8.1.9 Thioredoxin-disulfide reductase
MSLQAAAAAPAAGAVDEETPASSPPSDASKGVENLVIIGSGPAGYTAAIYAARANLKPVVFEGCQMGGVPGGQLTTTEVENFPGFPDGITGPDLMDRMRKQAERWGAELYQEDVEFVNVKSSPFCIRSSDREVKCHSLFIATGATAKRPPSAS

SEQ ID NO: 94344 - DNA, 838 bp, Zea mays
  misc_feature: Ceres CLONE 1584091
  misc_feature: Translation starting site: 199
  misc_feature: SWISSPROT Homolog: EC 1.4.1.2 Glutamate dehydrogenase
ctggagctccccgcggtggcggccgctctagaactagtggatcccccgggctgctggaattcgtctcacccctagaaaaaaaccatcattgcaaaagcgaagcatagcaatcggaattctctgcgatttctctagatctcgactaccccccactagttttggttcctcctttcgttcgagagagcgattctggtggctatggcgaagagcgagggtccggcgatcgggatcgacctcggcaccacctactcgtgcgtcggcgtgtggcagcacgaccgggtggagatcatcgcctacgaccaggggaaccgcaccacaccgtcctatgtcggcttcaccgacaccgagcggctcatcggcgacgctgccaagaaccaggtcgccatgaaccccacctacaccgtcttcgatgccaagcggttgatcggcaggaggttctctgacccgtcagtgcagagtgacatgaagctatggccgttcaaggtcatcccatggcctggtgacaaacccatgattgtagtcaactacaagggcgaggagaagcagtttgctgctgaggagatctcctccatggtcctcatcaagatgaaggagattgctgaagcctaccttggttccaccatcaagaacgcagtggtgacagtgccgggactatttcaacgactcgcagaggcaggacaccaaggacgccggtgtcattgcgggcctcatgtgatggcggatcatcaacgagcccactgctgctgctattgcctacggtcttgacaagaaggccacccgctccgggcgagaagaacgtgctcatcttccgaccttgggtgggtgacacctttgatgc

SEQ ID NO: 94345 - DNA, 1256 bp, Zea mays
  misc_feature: Ceres CLONE 1584092
  misc_feature: Encodes the peptide sequence at SEQ ID NO. 94346
  misc_feature (51)..(51): n is a, c, t, g, unknown, or other
  misc_feature (52)..(52): n is a, c, t, g, unknown, or other
  misc_feature (934)..(934): n is a, c, t, g, unknown, or other
  misc_feature (948)..(948): n is a, c, t, g, unknown, or other
  misc_feature (949)..(949): n is a, c, t, g, unknown, or other
  misc_feature (1138)..(1138): n is a, c, t, g, unknown, or other
  misc_feature (1181)..(1181): n is a, c, t, g, unknown, or other
  misc_feature (1205)..(1205): n is a, c, t, g, unknown, or other
ttttttttgggtgtgttgtgttttgtgatgtttttggggagggttatattnncccctgtattggaaagatgggggtttaaactggagctccccgcggtggcggccgctctagaactagtggatcccccgggctgcaagaattcgtctctccccttgaaaaaataagagagcagagggccagaggcgcagaaggcagtcgcggacaggaggaagaggaagaagaagcggcagcgagcgaggatgccgtgcctgaacgtgtcgaccaacgtgaacctggagggggtggacacctccgccatcctcgccgaagcctccaagtccgtcgccaacatcatcggcaagcccgaggcctacgtgatggttgttctcaagggttcggtgcctatggcatttggaggtacccaggaccccgccgctttcggtgagctggtttccatcgggagcctgaaccctgatgtgaacaaaaagcttagtgcctgcaccccctcctatcctggaagaccaaagcttgtctgtttcccaaaagtcccgcttccttacctcaagtttcctagaaaccccaaaaacccctccggaaacttcgggttggggaaacgccgcctccccccccccttccctaaaacccttgggggggccctggcccgcccttaaaaaattataaaagaaaaaatttccgggggggaaaaacccagtgggtgttccccccaaaagtggcccccccttgggggtctctttttgtggccccctatatttttaagaggagaacacaacatggggcgcccaccattaataagaaaatggtgtgtgtcttcacttttataaaacacccccgcgggtggggcctcttgcataaaacctcggagaaaaaaaaaaaccacagcgtaaaaaccccgcgctgtttgtttctcccgttgtggggaaaaaaccctgcggnaaaaaagtgggggnntggggtgggcgcctgtggcgcaccccttggtcaccaaaaaatagagggcgcctttgtggccttttccccccctaaaccctttaggaaacatttaattccaggtgcgcccccggggagccccaacatccacgtgggctttaaagtgtgggagaaaatattgtgcgcccttgtaaaatatattcacatatnccctataataatccccaaaaatacgcccccccatatgaataanctccatcttcttttcttatctccncccctcccaaatggaggaaaataaaaagtgagggcgtatgggcgacccccc

SEQ ID NO: 94346 - protein, 136 aa, Zea mays
  misc_feature: Ceres CLONE 1584092
  misc_feature (2)..(115): Pfam Name: MIF Pfam Description: Macrophage migration inhibitory factor (MIF)
  misc_feature: SWISSPROT Homolog: EC 5.3.2.1 Phenylpyruvate tautomerase
MPCLNVSTNVNLEGVDTSAILAEASKSVANIIGKPEAYVMVVLKGSVPMAFGGTQDPAAFGELVSIGSLNPDVNKKLSACTPSYPGRPKLVCFPKVPLPYLKFPRNPKNPSGNFGLGKRRLPPPFPKTLGGALARP

SEQ ID NO: 94347 - DNA, 899 bp, Zea mays
  misc_feature: Ceres CLONE 1584099
  misc_feature: Encodes the peptide sequence at SEQ ID NO. 94348
  misc_feature (899)..(899): n is a, c, t, g, unknown, or other
ctggagctcaccgcggtggcggccgctctagactagtggatcccccgggctgcaggaattcgtctcacccctagaaaaaggctgaaactagcttgagcaggacgaagggagcgacgttttataaccacgaataaattttaatattagcaatcgaccgtgttcagctgatgatgaataattacatctgtagttggcctgatatgggattgtagccggacgccgccttcatatagcggccgtcaggaaccccagcaagcaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacggcccacacaagcagcagcagtcctcggcgtcctcctcctcctcgccatccggctagccacggcggcgaggagctcgtccgcgacgtccccctaaatggaagcagcacaagcttgccgccgacgcctccgggggaagctccccatcatcgggcacctccaacctcatcggcttcccaccctgcacattctcactaccgagatcctcccacgccaagggtacggccacatacggggctagatgctgggggggggaggcggcgacccgttgcgcaaacaagtggagggtggtcgaacggcccgcgtggcccgccctaaggcccgtgtattcctcaaagattggaggcgaaggggtggggcggatagcggcccgaagtaaaaccccgttccgcccaaagatgctggcaggcggacaagcttcaaaagtgaaagtgaggaccttataacggctcctctgtggatagatgttctggttgcgcatgtgtggagaggtatgtggggggcn

SEQ ID NO: 94348 - protein, 45 aa, Zea mays
  misc_feature: Ceres CLONE 1584099
MLGGGGGDPLRKQVEGGRTARVARPKARVFLKDWRRRGGADSGPK

SEQ ID NO: 94349 - DNA, 874 bp, Zea mays
  misc_feature: Ceres CLONE 1584101
  misc_feature: Encodes the peptide sequence at SEQ ID NO. 94350
ctccccgcggtggcggccgctctagaactagtggatcccccgggctgcaggaattcgtctcacccctagaaaaagtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcccctcccgaccacgtcgctctacgtgggcgacctggagggggccgtctcggactcgcagctgtacgaactcttcagccaggcggggcaggtggtgtcggtgcacgtctgcagggatggtcactcgcgccgctcgctcggatacgcctacgtcgactacagcaatcccctgggatgctgccaaaacattgggaagtgcctgaactttgcctggtcttaaacacaaggcctatccgggggaatgtattccaatcccgggatccaagggaccgccagggaggggattcgggcaaacattttcctaaaaaaaatctgggccggagaattttgccatttaaccccttttaggagaactttttccttcttttggggcccctttctcccaatgaaagggacccccggggaaaaaaaggggccaaaccaagagggttggggtttttttttaaaaaaaaaaaaaaaaaagaaccgccaaaaaaaccccttaaaaaatgttttaggggggggttttttaaaaagagaaaa

SEQ ID NO: 94350 - protein, 101 aa, Zea mays
  misc_feature: Ceres CLONE 1584101
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVHVCRDGHSRRSLGYAYVDYSNPLGCCQNIGKCLNFAWS

SEQ ID NO: 94351 - DNA, 893 bp, Zea mays
  misc_feature: Ceres CLONE 1584103
  misc_feature: Encodes the peptide sequence at SEQ ID NO. 94352
ctggagctcaccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgaccctgggcctgcagcccggcgaggcccttcacgtccgcaacatcgcctccatggtcccaccctacgacaagatcaagtacgccggcacagggtccgccatcgagtacgccgtgtgcgcgctcagggtgcaggtcatcgtggtcattggccacagctgctgcggtggcatcagggcgctcctcttcctcaaggacgggcgcccgacaacttt

SEQ ID NO: 94352 - protein, 170 aa, Zea mays
  misc_feature: Ceres CLONE 1584103
  misc_feature (79)..(170): Pfam Name: Pro_CA Pfam Description: Carbonic anhydrase
  misc_feature: SWISSPROT Homolog: EC 4.2.1.1 Carbonate dehydratase
MSSCLCLPKKKEGPAKEKPSTDTPTSSLLQNQKPSQPPPPPSKASSKGMDPTVERLKSGFQKFKTEVYDKKPELFEPLKSGQSPRYMVFACSDSRVCPSVTLGLQPGEALHVRNIASMVPPYDKIKYAGTGSAIEYAVCALRVQVIVVIGHSCCGGIRALLFLKDGRPTT

SEQ ID NO: 94353 - DNA, 800 bp, Zea mays
  misc_feature: Ceres CLONE 1584106
  misc_feature: Encodes the peptide sequence at SEQ ID NO. 94354
acccgcggtggcggccgctctagaactagtggatcccccgggctgcaggaattcgtctcacccctagaaaaagctcactctcgctcgctcgctcttctactgcgggctggcggcggcggcggcggcgactgggcgagccgcgagcgcgccgcccttcgccaggtcttcgccggccacttcgcgggcgagggcgaccaccgacgagcatacaccaggccgctgaggaataacaaagatgtccgccggcggagtcctgagggcagagttatcttccaggacgccgccgttcggcctgaggctatggattgtgattggcatctgtatctgggcgctaatcctgttcatcctaggcttcatgtgcttctggtccctacaccggaggaagccgggcaagccctgcgacaaggttccgctgtcccaaatccccgacgtctccaaggagattgcggtggacgaggcgcgggagcaagccgttgtccacagcctccgtgtgcaggagagccacacgctggccgtgcaggagaagaagcactgcgaaaaggattcggggaaaatgctcgcacacctggttaggagcaagtcgagcgacgcagataatctgagccagtgcagctccgcgttccagtgcgaaagggctgggagctcgtattctggtgacgaaggcagctcgggcaatgctaggaggcagtactcctcagtccgtctccgcgttcgcccgttgggttgggcctccccgaaatctccgcatctggggtgggggggcattgggtttactttggaagggatttggagcatgccca

SEQ ID NO: 94354 - protein, 188 aa, Zea mays
  misc_feature: Ceres CLONE 1584106
MSAGGVLRAELSSRTPPFGLRLWIVIGICIWALILFILGFMCFWSLHRRKPGKPCDKVPLSQIPDVSKEIAVDEAREQAVVHSLRVQESHTLAVQEKKHCEKDSGKMLAHLVRSKSSDADNLSQCSSAFQCERAGSSYSGDEGSSGNARRQYSSVRLRVRPLGWASPKSPHLGWGGIGFTLEGIWSMP

SEQ ID NO: 94355 - DNA, 1031 bp, Zea mays
  misc_feature: Ceres CLONE 1584109
  misc_feature (5)..(5): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (77)..(77): n is a, c, t, g, unknown, or other
  misc_feature (78)..(78): n is a, c, t, g, unknown, or other
  misc_feature (80)..(80): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (846)..(846): n is a, c, t, g, unknown, or other
  misc_feature (847)..(847): n is a, c, t, g, unknown, or other
  misc_feature (879)..(879): n is a, c, t, g, unknown, or other
  misc_feature (881)..(881): n is a, c, t, g, unknown, or other
  misc_feature (882)..(882): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
ggtgngttttgtnttnnttntttcgctttgtctataagaaatgagttttggaaatataataggggaatttttttttnngntgtttnnntaagctggagctccccgcggtggcggccgctctagaactagtggatcccccgggctgcaggaattcgtctcacccctagaaaaaagtcgtccctgtccctccactcctcccgtcgagcacttggcactgccaatggcggctcccgcccacaccctcttcgatgcgcgcaagcccacgcttctttccccgtgagatcgacgcacctccccctctcgtgcttcattcccgctcgtcgttcgtttcttcggccccgagccgtcgcgcggtcgcctccccatctcgtcgtgctttagggctttggcctccccgttcttggacagggcacaccactggccaccggtggcccctaccccaaaatacaaatcccttcgtgccgctcccttaggggaaaaaaaaatccattagggggggccaactggaaagggcccggcctttccacctaaaaaccccaaaaggggaaagggggggggcatatttgggcgccccctgtgggaaaagggccccccccactctttgtaaaacaggggggggtctcttttgttcgggcccccccccggggtgcgtttttaaaatctctctcgtggcgcggcaatacattttggtgagtgnnngcttcgcttttcattaaaaaaaacaacccccccccacccggggcnnnaaagaaaagaaaaagatactttttttttttttgtagccgcccccgaataaggagggtggagaaaaaagaaacgccccccccctccttttagtgggggggnngggggcaaaatatattactcattctgttgggntnntggggggatagaagcttgnnnnntnnnattctttttttttaaacatatcggagagggtatatacaagtatgttgttttgagcccccccccctcccaaaaaaagaataatattgtgaggtttgatatctccccctcacaaaacaaaggag

SEQ ID NO: 94356 - DNA, 869 bp, Zea mays
  misc_feature: Ceres CLONE 1584111
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (843)..(843): n is a, c, t, g, unknown, or other
  misc_feature (844)..(844): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (869)..(869): n is a, c, t, g, unknown, or other
ctggagctccccgcggtggcggccgctctagaactagtggatcccccgggctgcaggaattcgtctcacccctagaaaaaacgcctctcacacattgtgcagtgcctggtgcctcagtgcctgccctgccctgccctttgatatggtttctggttatttttattattccctcccttctgctggcccggcgcgcgcgtctctctcccttgccatctgatcgatctcggcaaaaaaactgcgagatcttggcgtgctgccggcgataagattctccccggcgcaagcacatcaccagagcgaagatcgccgggagagagggacagatcatgctcggggaacggtgtgtggcgaggaatgttgactagttgtttaatacgagatcaagaaggacaaagcaattaaacaagcagcaggctttgtgctttgtgggtgtccctcctctggttcactgccccgctctccactccagctccatacattagtttactcctcctgaggtactttgtgctcctcccccttctggcccctcactgcctacgatagcagcagcaccggccgcataagtaggttgggcgctagagtgcgcttcaagcagcagcgctgttgctgcatcggaacccatccccactatttgtttgttttcgctgtacgagcgatctcctggccggctccggcacgttgcaatattcggtcttctcttctcggcgcagcagcaacttgttcttgtgcgctgcctcgctgctctgagccatttgccgttgctgcggtggacagtatgggaatagtgggttgtggtgctgtgcagttctgcttctacatgtggnnngnnnggggggggggggnntggggacnnncgggtctctgcgtgn

SEQ ID NO: 94357 - DNA, 1111 bp, Zea mays
  misc_feature: Ceres CLONE 1584114
  misc_feature: Encodes the peptide sequence at SEQ ID NO. 94358
aaagctggagctccccgcggtggcggccgctctagaactagtggatcccccgggctgcaggaattcgtctcacccctagaaaaaatccccaaccaaacaagtttagatataaaaatatagcatcgcccgcgctctggagagtctggatcctcctgaacctccaggcagcaagccatgaaaggagggacgcaagcagttagcctgatggtgcaccttgctgtgccatggctctgccttgcttcttgggcagctctgctaccagcgactagcatctggaaatgtgggcgcagcacctccgatactgagagcagataacataaaattgaacttcagcaccgcttcggggacccccgaaaagtacaagagcttccacccttctggttctgggtgggccagccaccccccccgggtgggaaaggagggggggatccccgtggctggccgacaaaaaaagaatttgttcccaatttatattcgttttttgaacaattcggcctcgcgcaataatgtggtgggcgcgttctgtgtgctttgcggtaatttgagaagaagcccaacaacataaactcccattgtttttacttcgatggttgtgggtgggtgcctcgaattctcgcttgccgtgaggaagggcaggggcgtgacgacggttactaacctcctatggacattgggctctggcttgtttgagtgggcaccctcgacgtggcgagactggcacaacatcacgcggggtcgacgtatattaactcatccatatacactctaggatggtgttattctgtattattataggtgacggcaagatcagggcaatattcggagctataaacatataggggacggggaacccgagaatctattgagatagtgttaataactgccccggccaccctgagcgtttactcgtgatatgagatatctgtaagagataccaatttcgtgggatggggaattgcaactccaagtctggtgaggtgaacttgcggtggcagcgcacccaagatatagatggttagggttctgtggcgtgagtgcaaagcggtcggccagagtagagatagggagtgaccgttgtggggttattgaaggaatagctgacaagagctcg

SEQ ID NO: 94358 - protein, 46 aa, Zea mays
  misc_feature: Ceres CLONE 1584114
MKGGTQAVSLMVHLAVPWLCLASWAALLPATSIWKCGRSTSDTESR

SEQ ID NO: 94359 - DNA, 844 bp, Zea mays
  misc_feature: Ceres CLONE 1584115
  misc_feature: Translation starting site: 214
ctggagctccccgcggtggcggccgctctagaactagtggatcccccgggctgcaggaattcgtctcacccctagaaaaagcggtccctacccagtacccacccccccaccgacccaccccctccgtgttccgccgcctccgccgaaatcaccaaatccccgcctccgatgcgccgccgacctcgatgcgacggagccgttgacccgcccagaatggcctctgggactccctcgccgtccggcaaaccctactcccgcaaatctcacgccagctccaagggtccgagcgtcccctccatcgacgcccacaacggacggctcctcccgaccgtcaacttcgcgctgccgtccactacagcctcccgccgggagctgcggcgccgcctctcctccgagctctcccaggtgcgcgccgcggccaagcgcctgagctccctcccggctcccgcaccttcctcggcgctctccgacaccgacgcgtccacgccgctcccgccgcacccgccggggtccaagcacaagtccaggaagcccgggggagccccgtacccgcagccgcacctctcggcggaggcgcggcgcaagctctacgagctcgtgtgcaagcacctgctgcgcgctgactccagaggctgatagagcacaagcacagctgggtgttcaacactcctgtagactccagctcgcttggactgcacgactaccatacgatcatcatcaagcccatggacgtcgagcctgtcaagatcaagctagctgctggacagtacacgtcagcacttggagtttgcaggcgatgtgcgtctcacgattcggaacgccatgacgtacaaccccaatgggg

SEQ ID NO: 94360 - DNA, 847 bp, Zea mays
  misc_feature: Ceres CLONE 1584117
  misc_feature: Encodes the peptide sequence at SEQ ID NO. 94361
tggagctccccgcggtggcggccgctctagaactagtggatcccccgggctgcaggaattcgtctcacccctagaaaaaatcggtcagcacgatgtcattgacccgatgagaggtcgaagaagggcggatgcttcaagctttctctgctcggttaggttgctgtcgctcgctctgagtctgaggcctcgacgcgctgctagctgagagccgaaagaaggaatcctcggccggcagcaggagaggagagccaccgtttgatcagcgaccgggcaagagcaggccgcggccggccaccccgcccgtctctgtccgaccccgcaccagcgactcgccgagcgcaggcacaagaggggggctccatccatgaggcagccatgctggtgctcatcaacaggtatttcaccaccaggaacagcagcccggccggaggaggcggcgaagagatggcgccggcggcggtctccagcgaccacctctgtttgccgggctgcgtgcccgtgcgcgccaagcgggcctcctcctccgccgccgccgcggccacggccaccacggcgcgggcgtcgcggcacaacttcgtcagggccgcggcgtcgggcctgctggcgggggcgcacttcaccaaccacgagtcgctgccgccgcttccccacgcgtacgccgagttcgtcgccgcgtttcccgcagtacgcccacggcgcgctggcgcgggccggagccgatccgggggcgaggagtaccagcacctggaacccccccgtgtggcctggaactcacccgggcataaacctccttcctcgcacgcccaagatgaagcgccctccccttggccggtccaaccttcttccg

SEQ ID NO: 94361 - protein, 157 aa, Zea mays
  misc_feature: Ceres CLONE 1584117
MLVLINRYFTTRNSSPAGGGGEEMAPAAVSSDHLCLPGCVPVRAKRASSSAAAAATATTARASRHNFVRAAASGLLAGAHFTNHESLPPLPHAYAEFVAAFPAVRPRRAGAGRSRSGGEEYQHLEPPRVAWNSPGHKPPSSHAQDEAPSPWPVQPSS

SEQ ID NO: 94362 - DNA, 837 bp, Zea mays
  misc_feature: Ceres CLONE 1584120
  misc_feature: Encodes the peptide sequence at SEQ ID NO. 94363
  misc_feature (486)..(486): n is a, c, t, g, unknown, or other
aaagctggagctccccgcggtggcggccgctctagaactagtggatcccccgggctgcaggaattcgtctcacccctagaaaaaacactcacacagcaaatcccccacaaggccactccaaagagctagtagtggaaccgaagatgttcgggaacatcggaaagatccccatcatcggcaacctgactggcaggaacaaaaatgcgcacctcaagggcaacgtggtgctcgtgcgctagaccatgctcggattggacgtcaccacgcatctccggctccctcctcgactgcgtcagcgagttcctcggtcgcggcgtctcctgccagcttatcagctccaccgtcgtggatcctaacaacagataccgcttgaagttgggcgccgaggcgagcctggagcagtggctgctgaacccgccgccgcttctgtccagcgagaaccaattacgcgtcaccttctactgggaggtggacaagcaagtcatnccgggcgccatcttctgagataacaaccacgcctctgagttcttcctcaggacatctacctaatcgacatccccgggccaaggtaccatcgtgttggggaccacttctgggatctcctccgcaaccaattacggaatcaacgggtgcttggttttcaagaatgttaccttccaggcttttttccggggggctttaaagccctacccgggcaaaaaatttcggaaacttggggggggaaaacccaaaggttccgtaaaagggagcctttcggggttcccttttaaaaagaataataaacccgggcaaaactaaaaggggaacctccccccctctcccggggggaaaaaaagg

SEQ ID NO: 94363 - protein, 100 aa, Zea mays
  misc_feature: Ceres CLONE 1584120
  misc_feature: SWISSPROT Homolog: EC 1.13.11.12 Lipoxygenase
  misc_feature (95)..(95): Xaa is any aa, unknown, or other
MRTSRATWCSCARPCSDWTSPRISGSLLDCVSEFLGRGVSCQLISSTVVDPNNRYRLKLGAEASLEQWLLNPPPLLSSENQLRVTFYWEVDKQVXPGAIF

SEQ ID NO: 94364 - DNA, 1061 bp, Zea mays
  misc_feature: Ceres CLONE 1584121
  misc_feature: SWISSPROT Homolog: EC 2.4.1.15 Alpha,alpha-trehalose-phosphate synthase (UDP-forming)
  misc_feature (971)..(971): n is a, c, t, g, unknown, or other
  misc_feature (1016)..(1016): n is a, c, t, g, unknown, or other
  misc_feature (1017)..(1017): n is a, c, t, g, unknown, or other
aaagctggagctccccgcggtggcggccgctctagaactagtggatcccccgggctgcaggaattcgtctcacccctagaaaaattttaagaaagaaactgcaccggatcaaagttggtttcttcctccacagcccatttccctcgtctgagatctataggacactgccagtgcgggatgaaattctaaaatcacttcttaatgctgacctcattggctttcaaacttttgactatgcccgccacttcctttcatgttgcagcaggcttttaggccttaattatgagtccaaacgtggccacataggtatagagtacttcggccgaacagtgagcctcaagattcttgctgcaggtgtacatgttggccggcttgaggctacattgaggttgcctgccccccctaaaaaggttcaagaaattgagagtagatatagtggcaagttgggtaataattagggtgtagatggaacatgggacatcttttaaagggtttcggtctaaaaactgcttgggctttggaaaccttctttctgggaaaaaaaaacccctaagcctttctaagggcaaaggatttggtccctttggttagaaaattggtttaattccctggccaacaaaagccattccgggaaaaaggaaactttctcgaatgtaaaccccggagatataattttaaacacccttgaaaatatctgtgttgagcctctctctcaaagggagtaataataattgctctcacaacattttgggggagttccggtgcgggatatttgccacaagggccgcgaggggtgtgaccgtctccacattgtgcagggcccaacaccgcgataacgctttattttttctataaagaaaagataaaccagggtgtgtgttattgaggaggcgaagaagagcaagggtggtttattattagaaagaaacgtttgggaggggatgattgctttcacgctgtataccgtcagntaaagaaaattactcctcatcatattatcctgttcagtttgaatnnggatgttccgagcgacaccgcgagattatgtctgagggggcgcg

SEQ ID NO: 94365 - DNA, 884 bp, Zea mays
  misc_feature: Ceres CLONE 1584123
  misc_feature: Encodes the peptide sequence at SEQ ID NO. 94366
tggagctccccgcggtggcggccgctctagaactagtggatcccccgggctgcaggaattcgtctcacccctagaaaaagacaccacacgacactccccgagcacacacgccgcaatagcaccacccccagacccaagtcctgtcaaggcctcaagcacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcagaccaagccgtggcgcgtgcgcgccgtcgcgtcgcccgcgcgcaccccccgcgccccgtcgtccaccggctcggtgaagaccgcgatgactatgacggagaagatcctggcgagggcgtcagagcgcgcggcgctggagcccggggagaacgtgtggggggacatcgacgtgctcatgacgcacgacttctgcgggcccgggaccatcggcatcttcaaaaaggagttccggggaggaatgcctaggtctgggaacgcgagaaaagtccgtcatcattccccaaccaacaacatcttcaccaaggaacgagcggccccgaccgcaaacgtcggatatccctcagggaacctcctgtcttgggaagcaataacctccaaggtaccttctatagtatttccaaaggtaccttccagctgagtttccagcgagcctatcccccgaattttcgaaaggggggggttcgggcccaagaattgtcaactatggcctacagggaaaggggcccatcggactcgtaaccagaaag

SEQ ID NO: 94366 - protein, 172 aa, Zea mays
  misc_feature: Ceres CLONE 1584123
  misc_feature: SWISSPROT Homolog: EC 4.2.1.33 3-isopropylmalate dehydratase
MASSISAAAKASAAFAQKKELAAPAPHRAGSSRQTKPWRVRAVASPARTPRAPSSTGSVKTAMTMTEKILARASERAALEPGENVWGDIDVLMTHDFCGPGTIGIFKKEFRGGMPRSGNARKVRHHSPTNNIFTKERAAPTANVGYPSGNLLSWEAITSKVPSIVFPKVPSS

SEQ ID NO: 94367 - DNA, 845 bp, Zea mays
  misc_feature: Ceres CLONE 1584124
  misc_feature: Encodes the peptide sequence at SEQ ID NO. 94368
ggagctccccgcggtggcggccgctctagaactagtggatcccccgggctgcaggaattcgtctcacccctagaaaaactagaaaaaagtcgtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggtgagtgggaggggcggcgtccacacaaccggaggggaggggggcaatggcggccgtggcaggcccactctgcacgtggctcgtcgccgcgtgcttatctgcggcatgcgacgctgaagagcacaagcagaagcatttctgcgcaggcggaagccgcgctgggggcggtgtcatgctcggccagcgccgccgcctcggcgcgcggcgtcgcggcttggcgcgctctggaatgactatggctgttgccttacaagctgaaagaagtgtcattgaaaagaagaaacccgatatcaaacaaagggaggtggttgtcactgggcatgggtgtagtgacaccattgggcccatgatcctgacgtgttttacaacaatctttcttgatggtgttagcggaaatagtgaagattgaaaaggtttgactggtccaacttccccccc

SEQ ID NO: 94368 - protein, 120 aa, Zea mays
  misc_feature: Ceres CLONE 1584124
MAAVAGPLCTWLVAACLSAACDAEEHKQKHFCAGGSRAGGGVMLGQRRRLGARRRGLARSGMTMAVALQAERSVIEKKKPDIKQREVVVTGHGCSDTIGPMILTCFTTIFLDGVSGNSED

SEQ ID NO: 94369 - DNA, 897 bp, Zea mays
  misc_feature: Ceres CLONE 1584130
  misc_feature (744)..(744): n is a, c, t, g, unknown, or other
  misc_feature (785)..(785): n is a, c, t, g, unknown, or other
  misc_feature (799)..(799): n is a, c, t, g, unknown, or other
aaagctggagctcaccgcggtggcggccgctctagaactagtggatcccccgggctgcaggaattcgtctcacccctagaaaaaacctcgtgtgtctgtttctccggcctgggctctgggctcgggcgtagtccagttgccaccaaccgagccagagagagaacaaagaacgggtgaaagaaatctcggaaaggttccagatttcctcgaggtggaggcctccttttcctcggccgaatcgctcgttcgctttctctctctctttcctcccatcgagcatgcattcttttctgctgctgcgaccgtaggatcggcgtccagcagcctcgccgcgtcggtatggttttcccttggcccacacatcctagctcttccgcattcttgaatttcgtggtcgaggattagggggtttctcgtgcgctggtccaatttcgcgctaatcgtcctgttcctgcctcggattactcgccttctcgtggtccccatctgttcttggcgttcgcacgcttgccgtgcggcgggcagggctgcagcagcagccggcagcgcgtgcatcttgcgaccccctttccaagaaccagctgcaagctttggccttttccgcctgccgtacccgaaatcccgcaagaaactccacccaagaaaaaagcggcgcccttttggctggctggctgccattcctcacgccccacgagtttggtgaggctttcaaacgagcacagttcacaagacagtgaggctgcngtggggtgtttcctcgtcggagatggagggaaaatttgccngcggcaaccatggntccagggcggagggccccttcgatctggggcagccgtttcactttcgccgtccaacccaggcgctcccggttttaccaggatgtcttcgctgccccca

SEQ ID NO: 94370 - DNA, 788 bp, Zea mays
  misc_feature: Ceres CLONE 1584132
  misc_feature: Encodes the peptide sequence at SEQ ID NO. 94371
  misc_feature (580)..(580): n is a, c, t, g, unknown, or other
ctcaccgcggtggcggccgctctagaactagtggatcccccgggctgcaggaattcgtctcacccctagaaaaagtgctcctctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaataccttctcgtactatgatcaggtccttgacaccactgccatgctcggcgctgtccccgaacgctactcatggaccccacgagagattgggtttgacacctacttctccatggccaggggcaacgccactgtccctgctatggagatgaccaagtggtttgacaccaactaccactttattgtcccggaattgggcccaaacaccaagttctcctatgcttctcacaaggctgttaacgaatataaggaggctaaggcgcntcggtgttgataccgtgccagtacttgttggaccagtctcgtacctgtttgctctcaaagcctggccaagggggtggaaaaaggggatttccctctttctttcccctttcttagcaagcatcctttcccagtcctaaaagggagggtcatttgccctaaatttgaaaaggcagcccggggggcccttccatgggaaatccagtttttg

SEQ ID NO: 94371 - protein, 149 aa, Zea mays
  misc_feature: Ceres CLONE 1584132
  misc_feature (2)..(150): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (147)..(147): Xaa is any aa, unknown, or other
MASHIVGYPRMGPKRELKFALESFWDGKSTAEDLEKVATDLRASIWKQMADAGIKYIPSNTFSYYDQVLDTTAMLGAVPERYSWTPREIGFDTYFSMARGNATVPAMEMTKWFDTNYHFIVPELGPNTKFSYASHKAVNEYKEAKAXRC

SEQ ID NO: 94372 - DNA, 841 bp, Zea mays
  misc_feature: Ceres CLONE 1584137
  misc_feature: Encodes the peptide sequence at SEQ ID NO. 94373
  misc_feature (749)..(749): n is a, c, t, g, unknown, or other
ctggagctccccgcggtggcggccgctctagaactagtggatcccccgggctgcaggaattcgtctcacccctagaaaaagcagctgctctggttttggttctcttccagccagccaccgtagagcgcgcagcaaagctggcgtcagtcagtctgacagctcagctcctcccgacctccctatatctctgctcccccaaaccctaatccctggcataacacaacaatctctctcccctcactccctctctgcagcgcgcagctttcaaagcgttgggagagatggcagaggagacgcaaccagaggccgccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgccgccctcgccgcaggtgagttcaacctgcctcccccgccgccgccgccgaaggccaaggagacaaaggtggaggaagccaaggccgaggagcccgccaaagaagagccagcggccgaggcggaggctacggcggaagagctcaaggcccaggtggctgcggatgccccggttgaggaggtcaagacggangtgccgccggccgaggaggccaaggctgagacactggctgaagaagccaagcttccgagcccgagccgcaggagaagaccgtcgtggtcact

SEQ ID NO: 94373 - protein, 186 aa, Zea mays
  misc_feature: Ceres CLONE 1584137
  misc_feature (156)..(156): Xaa is any aa, unknown, or other
MAEETQPEAAAAAAAPAAAEVVVTEAAPAEAEVPAAAEAEAEAKDEKKGDEAELTADDAGVGTGSFKEESNLVEDLPDPEKKALDEFKQLIAAALAAGEFNLPPPPPPPKAKETKVEEAKAEEPAKEEPAAEAEATAEELKAQVAADAPVEEVKTXVPPAEEAKAETLAEEAKLPSPSRRRRPSWS

SEQ ID NO: 94374 - DNA, 1145 bp, Zea mays
  misc_feature: Ceres CLONE 1584139
  misc_feature: Encodes the peptide sequence at SEQ ID NO. 94375
  misc_feature (8)..(8): n is a, c, t, g, unknown, or other
  misc_feature (12)..(12): n is a, c, t, g, unknown, or other
  misc_feature (46)..(46): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (60)..(60): n is a, c, t, g, unknown, or other
  misc_feature (62)..(62): n is a, c, t, g, unknown, or other
  misc_feature (64)..(64): n is a, c, t, g, unknown, or other
tttttttntttnttgtttgggggaggtggggggggggggtgtgggnggacgtnnnccacnantnataatgccgccaaactggaactccccgcggtggcggccgctctagaactagtggatcccccgggctgcaggaattcgtctcacccctagaaaaaccctctccacttccgtttccggatcccgtttccagctccgatccaacccagcatctgtaccgcgccgcgcgagcacgtccggcgccggtgcggcaggcgaaatccgagagcactcctcccccgctacgccgcaccgcccatggccgcagctagccgcagatagagagaggcgcaggcgagggcgtgccgatccagatccggtgggcgggaaggacttgatcgccccccccaccatggccggcgcggtgtccgcgctcttcctggcgggaactgaaggggccgcgttctccctcggggggcaacataccccggggaagttccccccgctcccagggccgaagcgctttcttcccccaaggtttcctccaaccaagggaggggcggattccggaaatggccccctccacccgggggggtcttaccaaacaaaagcctggggcgcgcccccctttacaatggttcccactccccgggccaccaaaccattggggttttttcctctctcaacaacgacggcctgatttgtgccacaaaaaaaccttgttataaacgcgcggggccccaaggaaaattaccgccccccttctcttttctctccacacccacacgccggatgaataaaaaaagaaaaaggtggggggtgttttatagaataacacttatacttctttcttcaaaggagaaagccccttggggagaagagaaaggagtattctcccccctccaaaaaagaaataaaacatttcctcccactagtgttagaggatgtaagtgcacaatagggccgcccactttgaagaaatagattcgtggcgcgtatatctgtgggcgtgctcccccgcaaaatttataaccgggaagagggccaacaataaaataattctcggggtggtagttctttctattgcgagagaacagaagtggcccattccctgggaggtggggagtgggggacgcgccgtgtggtgtcctccgcacagtggggac

SEQ ID NO: 94375 - protein, 95 aa, Zea mays
  misc_feature: Ceres CLONE 1584139
MAGAVSALFLAGTEGAAFSLGGQHTPGKFPPLPGPKRFLPPRFPPTKGGADSGNGPLHPGGSYQTKAWGAPPFTMVPTPRATKPLGFFPLSTTTA

SEQ ID NO: 94376 - DNA, 829 bp, Zea mays
  misc_feature: Ceres CLONE 1584140
  misc_feature: Translation starting site: 317
  misc_feature: SWISSPROT Homolog: EC 1.1.1.86 Ketol-acid reductoisomerase
ctccccgcggtggcggccgctctagaactagtggatcccccgggctgcaggaattcgtctcacccctagaaaaactctctttccagccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgagggggtgggagggatctgttcccgctgttaccggaggccttcaagggaatcaaacagatcggtgtaatcggctggggctcgcagggtcctgcacaagctcagaacttgagagactcacttgttgaggcaaagtcagatattgttgttaagattggtctccggaaaggttctaaatcttttgaagaagcccgagcagcaggattcaccgaagagagtgggacgctgggtgatatatgggagactgtatcaaacagtgatcttgttttgctactgatatctgattctgctcaggctgataactacgagaaaattttctcgcacatgaaaaccaacagtatttcttggtttgtcacatgggatttcttcctgggaattttgcaatctccggggttttggattcccctaaaaacatcaaggggggttgccgtaaggca

SEQ ID NO: 94377 - DNA, 912 bp, Zea mays
  misc_feature: Ceres CLONE 1584142
  misc_feature: Encodes the peptide sequence at SEQ ID NO. 94378
  misc_feature (369)..(369): n is a, c, t, g, unknown, or other
gctggagctcaccgcggtggcggccgctctagaactagtggatcccccgggctgcaggaattcgtctcacccctagaaaaagagcataaaattacccacacacccagcagccagcaccgatcgagtcatccttaattaccgtaataatacgaaggcggccatgattgttgttgcagtagtactggcgctgctactgctgttctatggggcgggacacgccgactgcgcaacggcgaccatcccccagaacagcagcagcacggccgacatgctctccctgctcgacttgagaaaggaaatcagcagtgatccaggaggttttctcacatccttgaaacactaattataacagttagcggcgggcgccgnccaactaactgcgggcttggaaaggggcttccccattgcagcaaaaaaaagcacccccaggggggcggttcatttttgaaattcaaacccctcaagccaagcccaaaaagactttttggaaagggggcccaaaaattcttttctcccatttttttttggggggggaaaaccctaaaaaccccttttccctttttaaaaaaaaaaaaacggggaggaccaccttgttttttccccttccaccaaaaaaaattgggttctataaacctgtggggggggcccccaataaaaaaccccgccgcccccaaaaaaaagatatctgcggggtgtctcccccccctccttttttttccacccccttttaaaaaaaaaatttctccccgcacaccccctttttagattattttattaaaaaaaacaaatatttctctcacgcgggtgggggggagcattattttctccgctatgtcaaaagagaggacgtgggggggaaaaaaaaaattattctttctctccaataatgattggaggaaccgcccccccccc

SEQ ID NO: 94378 - protein, 60 aa, Zea mays
  misc_feature: Ceres CLONE 1584142
MIVVAVVLALLLLFYGAGHADCATATIPQNSSSTADMLSLLDLRKEISSDPGGFLTSLKH

SEQ ID NO: 94379 - DNA, 1091 bp, Zea mays
  misc_feature: Ceres CLONE 1584143
  misc_feature: Encodes the peptide sequence at SEQ ID NO. 94380
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (27)..(27): n is a, c, t, g, unknown, or other
  misc_feature (41)..(41): n is a, c, t, g, unknown, or other
  misc_feature (42)..(42): n is a, c, t, g, unknown, or other
  misc_feature (425)..(425): n is a, c, t, g, unknown, or other
  misc_feature (441)..(441): n is a, c, t, g, unknown, or other
  misc_feature (443)..(443): n is a, c, t, g, unknown, or other
  misc_feature (544)..(544): n is a, c, t, g, unknown, or other
  misc_feature (558)..(558): n is a, c, t, g, unknown, or other
  misc_feature (659)..(659): n is a, c, t, g, unknown, or other
  misc_feature (697)..(697): n is a, c, t, g, unknown, or other
  misc_feature (698)..(698): n is a, c, t, g, unknown, or other
  misc_feature (718)..(718): n is a, c, t, g, unknown, or other
  misc_feature (719)..(719): n is a, c, t, g, unknown, or other
  misc_feature (741)..(741): n is a, c, t, g, unknown, or other
  misc_feature (764)..(764): n is a, c, t, g, unknown, or other
  misc_feature (789)..(789): n is a, c, t, g, unknown, or other
  misc_feature (790)..(790): n is a, c, t, g, unknown, or other
  misc_feature (823)..(823): n is a, c, t, g, unknown, or other
  misc_feature (826)..(826): n is a, c, t, g, unknown, or other
  misc_feature (853)..(853): n is a, c, t, g, unknown, or other
  misc_feature (896)..(896): n is a, c, t, g, unknown, or other
  misc_feature (897)..(897): n is a, c, t, g, unknown, or other
  misc_feature (923)..(923): n is a, c, t, g, unknown, or other
  misc_feature (924)..(924): n is a, c, t, g, unknown, or other
  misc_feature (956)..(956): n is a, c, t, g, unknown, or other
  misc_feature (958)..(958): n is a, c, t, g, unknown, or other
  misc_feature (1001)..(1001): n is a, c, t, g, unknown, or other
  misc_feature (1028)..(1028): n is a, c, t, g, unknown, or other
  misc_feature (1066)..(1066): n is a, c, t, g, unknown, or other
  misc_feature (1076)..(1076): n is a, c, t, g, unknown, or other
nnnnnnnnttttnnnaaagcttcgccngctgggttactggnngcttatgcgctggttgtggggtgttgtagggtttaaaaactggactccccgcggtggcggccgctctatactagtggatcccccgggctgcaggaattcgtctcacccctagaaaaaattagcaatttttgactcgtgcgtgcgtgactacagttgcatgctatggccatggtcaccacttcgccggcaactgtgcagccatcatcatgcaagcacacgagccgcggcgcggcgcggtgctgccctcctcctctgctgtcctggaagacacgaagctttgggcagcaggtgacgacaagggccacggcggcaagctcccgtgggcagcccgcgggggtggcacaggccaggggagaagagggcgacagtatcatgcggctgcngaacaggtcagacatncngggcgtctcgctggaaggcgagaaaggatggggcagagaaactcacaccggctgggcggtcaagggccatccccaaaaaaccttcggggaattggacttcnagaaagaaagaaantcccgggttcccggaggcccgggaacccccaaaaacaacatgcgtcggtgtccagataagggccggcgaaacccacaaggccttgtttaaggggaaccggncggagacaaaaaaaaaaaggggagggcccttccttttnnataaaagatagaactttatnnccaataagaatcaggcaggagncctggacacaacccgcagacctnttgcccaaacacaattgaggggggnngtttgtgttacaaatcccagacggtaaaggagngtncgtggaccacttaaaatcatggaggtntcactataataaattaataaaacgggtctttttaaagaattgnntggcacagcaacattcccccctcttnnacagcgccaagaggaaaacacaaaaatttatntncggccaacctattaaaccggatttgcgcccctcacgagctttnggctgttagatatataccagtccacanttaccatagaacaagcggaataatacaccctagaacanattgccgccncgcgtctcacaaatc

SEQ ID NO: 94380 - protein, 147 aa, Zea mays
  misc_feature: Ceres CLONE 1584143
  misc_feature (74)..(74): Xaa is any aa, unknown, or other
  misc_feature (79)..(79): Xaa is any aa, unknown, or other
  misc_feature (80)..(80): Xaa is any aa, unknown, or other
  misc_feature (114)..(114): Xaa is any aa, unknown, or other
  misc_feature (118)..(118): Xaa is any aa, unknown, or other
MAMVTTSPATVQPSSCKHTSRGAARCCPPPLLSWKTRSFGQQVTTRATAASSRGQPAGVAQARGEEGDSIMRLXNRSDXXGVSLEGEKGWGRETHTGWAVKGHPQKTFGELDFXKERXSRVPGGPGTPKNNMRRCPDKGRRNPQGLV

SEQ ID NO: 94381 - DNA, 836 bp, Zea mays
  misc_feature: Ceres CLONE 1584146
  misc_feature: Encodes the peptide sequence at SEQ ID NO. 94382
  misc_feature (623)..(623): n is a, c, t, g, unknown, or other
  misc_feature (662)..(662): n is a, c, t, g, unknown, or other
  misc_feature (697)..(697): n is a, c, t, g, unknown, or other
ctccccgcggtggcggccgctctagaactagtggatcccccgggctgcaggaattcgtctcacccctagaaaaaacccatggcggcggcggcggttcatgagccggaggtgatccgcgacaaggcggcgatgcgcgcgtggtcgcgccgccgccgcgcggagggaaaggccgtcgctttagtccccacgatgggcttcctccacgagggacacctctcgctcatctccgcggccgtggcggcctccgccgaccccatcgccgtcgtcgtctccatctacgtcaaccccagccagttcgcccccaccgaggacctcgccacctacccctccgactgcgccggcgacctccgcaagctggctgcctacggggtcgtcgacgcagtattttgccccccgggactctacgtccgctggagcgctgatcgccccctcgcctcctgcgcgtccggtgggcgcggtgtcttgcctggaggatgcaggtgggcatgcccacgagacgtggattcgggtgggacggctggataaggggctgtgccggaacaacaggcccgtctccctcccggggtggccaccgtgggtcggccagctgttgcattacctgggagccggtactcctcctgttncgggaagaaagattatcaggcattgcggcgtcatttgtncggaagggttcccgactctccattttgccctatcnatgtttggttccgaggtagtgccgaaaaactgatagtccttcccatgggctctcccaatgtaaatctggccggagggggattgaaaaaaggcggtatccattccgtggatcaccgggggggagctaaaaaccgccgccc

SEQ ID NO: 94382 - protein, 148 aa, Zea mays
  misc_feature: Ceres CLONE 1584146
  misc_feature (9)..(149): Pfam Name: Pantoate_ligase Pfam Description: Pantoate-beta-alanine ligase
  misc_feature: SWISSPROT Homolog: EC 6.3.2.1 Pantoate--beta-alanine ligase
MAAAAVHEPEVIRDKAAMRAWSRRRRAEGKAVALVPTMGFLHEGHLSLISAAVAASADPIAVVVSIYVNPSQFAPTEDLATYPSDCAGDLRKLAAYGVVDAVFCPPGLYVRWSADRPLASCASGGRGVLPGGCRWACPRDVDSGGTAG

SEQ ID NO: 94383 - DNA, 815 bp, Zea mays
  misc_feature: Ceres CLONE 1584147
  misc_feature: Encodes the peptide sequence at SEQ ID NO. 94384
  misc_feature (805)..(805): n is a, c, t, g, unknown, or other
  misc_feature (815)..(815): n is a, c, t, g, unknown, or other
ctccccgcggtggcggccgctctagaactagtggatcccccgggctgcaggaattcgtctcacccctagaaaaagcctctgcctctcttattccctctcttcttttttttatagtacaacacaatccacccgcgtcggcacgagcacccacagcagttggcgcgcaccaaaaccctaccctccctctgctctcagccgccaacgccatgggctccaccgccgctgcctccgtgctcccggtgtccgccggctccggcgagaacctcgtcctcatcctcgactacggctcgcagtacacgcacctcatcacccgccgcgtgcgccagctcggcgtcctctccctctgcgtgtccggcacggcgccgctcgcctccctggagggcctccgcccacgcgccgtcatcctctccggcgggccccactcagtccacgcccccggggcgcccgccttccccgagggattcctgggcttcgcggctgccgcgggcgcgcacgtgctcggcgtctgctatgggatgcagctcctcgtgcagtccctcggaggcgccgttgtgtccggggagcgccaggagtacgggaaaatggacgttgaggtgacggcggcctcctccgcgctctacgggcaggcggagaccgggaagcgccagacggtgtggatgagccatggcgacgaggtggttaggctgccggaagggttcgaagtggttgctcgcagcgtgcagggagccgtcgcggccattgagaaccgggagaatcgcttttatgggctccaataccaccccgaggttacacattcagcccaggnaatggaaacn

SEQ ID NO: 94384 - protein, 203 aa, Zea mays
  misc_feature: Ceres CLONE 1584147
  misc_feature (22)..(203): Pfam Name: GATase Pfam Description: Glutamine amidotransferase class-I
  misc_feature: SWISSPROT Homolog: EC 6.3.5.2 GMP synthase (glutamine-hydrolyzing)
  misc_feature (200)..(200): Xaa is any aa, unknown, or other
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGGAVVSGERQEYGKMDVEVTAASSALYGQAETGKRQTVWMSHGDEVVRLPEGFEVVARSVQGAVAAIENRENRFYGLQYHPEVTHSAQXMET

SEQ ID NO: 94385 - DNA, 2119 bp, Zea mays
  misc_feature: Ceres CLONE 1584152
  misc_feature: Encodes the peptide sequence at SEQ ID NO. 94386
agccacagttcaacgccccaatcctgcctcttagtccaacccggcaaccccaacctcttggtgcttcccaaattccaactcccaagcccttgttgctcaccaagattcatcttctccccccaatctcctccgcagggaaatagttgttttggtttccgactcccctgctgcatagcataggcactcattcctccctttcgacagcaagcaattttgtgttctcagttgtagattgggcgagattttccttccatccgtgggtgattcaggcattaggattcaatcggcacaatttgttcctgtatccgctcttgccaagaatttcccatctccctatttgctttctgatccatcttcgatgcgctaagaggcgagatgaatacgaattactcggctctcccattgacttccccctccatcgagctccaacccaacggggccaaatctagcgccgccgccaatggcgtcctcaacggccacgctaaaatctccaggcaggattcgttcttgggcgaggtggaggacgacggcggcggggccggtgagcacgacgagctgccgctcatcggcgacggccctgccgggccgccagaggggtccgacgtgaccgccgccgtgttcaacctcgcgacatccatcatcggggccggcattatggcgctcccggctaccatgaaggtgctcggagtcgccgctgggctcgtctcgatcctggtcatgggggtcctgtccgagatcaccgtcgagctgctcgtgagattctcggcccactgccgcgcgctatcgtacggcgaggtcgtgcacagggcgatgggccgcccggcgagcatcgtggcgcagatgtgcgtcatcatcaacaacgcaggggtcctggtggtgtatctgatcatcatcggagacgtgatgtcagggtcactgaagcacatcggcgtcatggatcagctggttggccatggcgagtgggataaccggaagctgctgatcttggtggtccttgtcatcttcctcgcaccattgtgtgcgcttgagaagattgactcactgagcatgtcatctgccgcgtcggttgcccttgccgttgtgtttgtggtggtgtccagcatcattgctttgatcaagatcgccgagggcaagatcagtatgccgaggatgggtccagatttcagctcccgtgcagcaatgctggacctgctcgtcgtgatacccatcatgactaatgccttcatctgccatttcaatgtgcagccgatctacaacgagctcaaggagaagacaccacagaacatgtacaaggttggcaggatcagcaccgtgctatgcgtggcggtgtatgccctgactgccctctcggggtacctcttgttcggcgaggacaccgagtccgacgtgctcaccaacttcgacaaggatctcgggataagattcagctctctgctcaactacattgtcaggatagggtatgtcatccacctggtcctcgtcttcccagttgtccacttctcgctgaggcagacagtggaggcgctgatcttcggggagctggcaacccctagcaggaagagaacattcacattgacagtggtgcttctagcactcatctaccttggctcgacaatgatacccaacatctggatagccttcaagttcaccggagctaccacagggctggcgttgggtttcatgttcccggccctggtggcattgaggctggacaaggaagggagtcgcttgggacatggggagaggctccttgcgcttggtttgctggggctatcaattcttgttagcgtcatcggagtcgttggaaatgtatacaccttgaagagtaagtctgaatgacctccccaagatggcaagttgatagctagggttagaggaacctttgcatcatgaagacacatggtgtgttgctacaactggcatacagatcgtgtaaacatggtgactatacactaggtcaaaatgtattacattcgagagagcctcagcatcctatatccgttttttacttcagaggtttaactgtggaccattctcgagggaattctttttgtacttcggaccagattgttttcgatgtatcgatttcattgtgttcttacaaaaaaaaaaaaaaaaa

SEQ ID NO: 94386 - protein, 487 aa, Zea mays
  misc_feature: Ceres CLONE 1584152
  misc_feature (73)..(480): Pfam Name: Aa_trans Pfam Description: Transmembrane amino acid transporter protein
MNTNYSALPLTSPSIELQPNGAKSSAAANGVLNGHAKISRQDSFLGEVEDDGGGAGEHDELPLIGDGPAGPPEGSDVTAAVFNLATSIIGAGIMALPATMKVLGVAAGLVSILVMGVLSEITVELLVRFSAHCRALSYGEVVHRAMGRPASIVAQMCVIINNAGVLVVYLIIIGDVMSGSLKHIGVMDQLVGHGEWDNRKLLILVVLVIFLAPLCALEKIDSLSMSSAASVALAVVFVVVSSIIALIKIAEGKISMPRMGPDFSSRAAMLDLLVVIPIMTNAFICHFNVQPIYNELKEKTPQNMYKVGRISTVLCVAVYALTALSGYLLFGEDTESDVLTNFDKDLGIRFSSLLNYIVRIGYVIHLVLVFPVVHFSLRQTVEALIFGELATPSRKRTFTLTVVLLALIYLGSTMIPNIWIAFKFTGATTGLALGFMFPALVALRLDKEGSRLGHGERLLALGLLGLSILVSVIGVVGNVYTLKSKSE

SEQ ID NO: 94387 - DNA, 819 bp, Zea mays
  misc_feature: Ceres CLONE 1584153
  misc_feature: Encodes the peptide sequence at SEQ ID NO. 94388
  misc_feature (713)..(713): n is a, c, t, g, unknown, or other
  misc_feature (788)..(788): n is a, c, t, g, unknown, or other
gcggccgctctagaactagtggatcccccgggctgcaggaattcgtctcacccctagaaaaaatcatcgagtcatccatctaaacatccgatccgaccatggcggcagacgcacttcggggccttctccccggcgtttacgccgtgctgatggtaatcgccgtcgcaagcgctgcctccagcgacgtgtcctcggtggtcgtcggcctcgccaaatgcgccgactgcaccaggaagaacttgaaggccgagggcggcattcaagggtcttgaggtggcgatcaagtgcaagaacagcaaaggcgagtacgagagcaaggccatgggcaagcttgatggcttcggcgccttcagcatcccacttagcacggacctccacggcgctgactgcgttgcacagctccacagcgctgcggggaacccgtgccccggtcaagaaccttccagaattgtgccacaatcgtcaaagggcaacttcgtcgtggtccctggaaagacagactacccatcgaaggaatgtgcgtccgcaaccctgtgtgggtcgatcaagaagcacctactagaccatttccacaagaaacctgtgccaccaaagccaaagccagaacctaagccagagccggagccgaaagcagaaccctagcccagagcagagaaaccaccacctacaccaacatacggatcctcaactccgatctaccatcctcccatcangcagttgtttgacaagaacacatgtttgatcacttccacaagcaccacgactaccatcactttctttgacacttnccacagaaacccagttcaccaaaagccaaac

SEQ ID NO: 94388 - protein, 106 aa, Zea mays
  misc_feature: Ceres CLONE 1584153
  misc_feature (1)..(106): Pfam Name: DUF1210 Pfam Description: Protein of unknown function (DUF1210)
MGKLDGFGAFSIPLSTDLHGADCVAQLHSAAGNPCPGQEPSRIVPQSSKGNFVVVPGKTDYPSKECASATLCGSIKKHLLDHFHKKPVPPKPKPEPKPEPEPKAEP

SEQ ID NO: 94389 - DNA, 840 bp, Zea mays
  misc_feature: Ceres CLONE 1584155
  misc_feature: Encodes the peptide sequence at SEQ ID NO. 94390
  misc_feature (823)..(823): n is a, c, t, g, unknown, or other
agctccccgcggtggcggccgctctagaactagtggatcccccgggctgcaggaattcgtctcacccctagaaaaaacagactcctcacactccctactgggctggctacgtacggtacgtgctagtactgttagccaggaacaagccccagcagcagcagcaatggccgtggagaacggcagcgcctacgaggcggcggcggtgaccgtgaccggcgcccgcaccgtggcgccggccaagaacagctgcacgctcgccaccttcgacctcccctacatcaccttctactacaaccagaagttgctcctgtaccgcgccgcccccgactttccggacgccgtggcgcgcatgacggccgcgctcgccgacgcgctccgcgtcttctacccgctcgccgggcgcatccgccaggacgacgacggcggcgcgctggcagtcgagggcgacgagggcgcctaggtcttcgaggccgaggcccagggcgtcgccgtcgacgacctcgccggaggggactgcaacgactaggcggagaaggtcttgcagcacctcgtgccctacaccggcgtcatgaacctcgagggcctccgccgcccgcttctcgccgtccaattcacagagctcaaggacggtctggtcggtggggtgctccttctaccaagcggtgctggacggcacctccacgtggcacttcatgtcctcatgggccgagctctgccgcgtcgataccctgtcctgagccacccaacagggggggcccgcgtgttccctcctcccgtgcgcgtgccggctggaaactgcccggcgttccgccgaggcccacgncgaagacgggacccgaa

SEQ ID NO: 94390 - protein, 98 aa, Zea mays
  misc_feature: Ceres CLONE 1584155
MAVENGSAYEAAAVTVTGARTVAPAKNSCTLATFDLPYITFYYNQKLLLYRAAPDFPDAVARMTAALADALRVFYPLAGRIRQDDDGGALAVEGDEGA

SEQ ID NO: 94391 - DNA, 831 bp, Zea mays
  misc_feature: Ceres CLONE 1584158
  misc_feature: Translation starting site: 223
  misc_feature (381)..(381): n is a, c, t, g, unknown, or other
ctccccgcggtggcggccgctctagaactagtggatcccccgggctgcaggaattcgtctcacccctagaaaaagtcctgccccacaccacagtggtggaaggaaaggaaacgggagggagagaaaaacccaggccccccgatctcctcctcccactccgatcgcccgaccgatcgccgagcttccccgttccctccccgccccccgcgacgccgcgacgccatggagctgccgcacgccgagcaggccgtcgccgctgtagcagcaggaggagagggcggcaccgcaagcccgggcaccgtcctcgaagggccggtgcttaggcgggggctggacggcggtggggaaggggaggacggggagctgggggcggggcaggangcggactcactgctccccccaccggcctggcgaggcggactgtggctactacctccgcacgggcgcctgcggcttcggggagcgttgccgctacaaccagccccgcgatcgtggtggcaccgagtttgggggagggacccagaatggtggcagcgcaggactttccttaacgacagggccaaacctgggtggggagattttttgaagactgggacctggaagattgggggccaatggccgattcccccagcccaagcaagaggggtccggcggcggctgggtatttggaacaacccggggattcccccccagccctggggggaaaaaaaagcccccacacattataaaagccggggcaagggaaaaagggtgcggcacgggaaagttccaccccccccaattttggggggactcccaggtgaaccccgggagaatgtcgccccctttcca

SEQ ID NO: 94392 - DNA, 893 bp, Zea mays
  misc_feature: Ceres CLONE 1584159
  misc_feature: Encodes the peptide sequence at SEQ ID NO. 94393
aagctggagctccccgcggtggcggccgctctagaactagtggatcccccgggctgcaggaattcgtctcacccctagaaaaaatcatcgagtcatccatctaaacatccgatccgaccatggcggcagacgcacttcggggccttctccccggcgtttacgccgtgctgatggtaatcgccgtcgcaagcgctgcctccagcgacgtgtcctcggtggtcgtcggcctcgccaaatgcgccgactgcaccaggaagaacttgaaggccgaggcggcattcaagggtcttgaggtggcgatcaagtgcaagaacagcaaaggcgagtaccagagcaaggccatgggcaagcttgatggcttcggcgccttcagcatcccacttagcacggacctccacggcgctgactgcgttgcacagctccacagcgctgcagggaacccgtgccccggtcaagaaccttccagaattgtgccacaatcgtcaaagggcaacttcgtcgtggtccctggaaagacagactacccatcgaaggaatgtgcgtccgcaaccctgtgtgggtcgatcaagaagcacctactagaccatttccacaagaaacctgtgccaccaaagccaaagccagaacctaaagcagagacggagccgaagccgaaacctaagcccagagccaggagaaccaccccaccctacaaccaacattacgggaatccttccacttccgaattctaaccatccttcccttcccaggcaagttttgttttggaccaagaaaaaccacaatggttttggaatcaacctttcccacaagggggacccgcgggaaccttaccccaatccccttttcctcttttgggagacaacgtctgtcccgaccagaggaagagcccccga

SEQ ID NO: 94393 - protein, 203 aa, Zea mays
  misc_feature: Ceres CLONE 1584159
  misc_feature (34)..(198): Pfam Name: DUF1210 Pfam Description: Protein of unknown function (DUF1210)
MAADALRGLLPGVYAVLMVIAVASAASSDVSSVVVGLAKCADCTRKNLKAEAAFKGLEVAIKCKNSKGEYQSKAMGKLDGFGAFSIPLSTDLHGADCVAQLHSAAGNPCPGQEPSRIVPQSSKGNFVVVPGKTDYPSKECASATLCGSIKKHLLDHFHKKPVPPKPKPEPKAETEPKPKPKPRARRTTPPYNQHYGNPSTSEF

SEQ ID NO: 94394 - DNA, 2528 bp, Zea mays
  misc_feature: Ceres CLONE 1584160
  misc_feature: Encodes the peptide sequence at SEQ ID NO. 94395
agccatttgttaaaagcccccccaaaccccgttgcctgcacatgctccggtcgggctgccctcctgctctcgatcgaacaagaggtgtccgtccaccgacaactcggcacaagaactgtccagatatctccaactagtgttaggttatcttatcgattcagattcgtcttagcttcctgccaaatccgttgatctcagcttaatcagccatcatccagcagggcactgacacttctgcaggacttgaggtctgacggtcaatcaagtcgtctgagtgagccatggcggaggccaaccgcaggacgacgccccggccccgcgcggtgccgccgctgctcgccgaggtggaggtctccaacctgcccggcttcgacgtcaccccaacgccgagcccgcacggccaggacgccaccaccccgagcccgcgcccgcccacgaagccgtcgtcccgccccggggtgccgccgctggaccgcgtgccgtgccgcagcgaggtggtgttcccgccgctggactcgccgttccaggcgccgggctaccgctccgtgcagcccgtctccataagcctcccggcgtcgcccatcggcttcggcttcggcgtgcccgccatccccgcgccggccaacgccgccgactcggacgacgacggcctccaggccaacgccgcggccggcgagccacagcaggcgccggcgcaggcgccgacgccgacgccgccgcccgcgcgggagaatggaggaggagggggcgtccggttcatgcaccagccggacaagctggtgttccgctcgcagcccattcccggcggccagccacagcgcgccggcagcagagccgcccgagcctgcagggccatcagccgggacaggcgctatgacacgttcaagaccttctccgggaagctggagcgccagctcacccacctggccggcgccccggaggtccaagaggtgcgaggagatgacgccgtcgaagacgccacctcccgcaccacgtccatgcccaaagtcgatcgcttcttcgccgcactggaaggccccgaactcgacaagctcaagacgtctgaggaactggtgctgccgtcggacaagacgtggccgttcctgctccggttccccgtgtcggcgttcggtatctgcctgggcgtgagcagccaggcgatcctgtggaagacgatcgcgtcgtcgtcgccgaccacgttcctgcacgtatcccacaaggtgaacctggtgctctggtgcatctccgtgctgctcatgtgcgccatcacggccgtctacgcgctcaagctcgccttcttcttcgaggccgtgcggcgcgagtactaccaccccatccggatcaacttcttcttcgcgccgtggatcgcctgcctcttcctcgccatcggcgtgccgccgtccgtggccactgagcccctgccgcagtggctctggtacgcgctcatggcgcccgtgctcttcatggagctcaagatctacggccagtggatgtccggcggccagaggcgcctgtccaaggtggccaacccgtccaaccacctgtccgtggtgggcaacttcgtgggcgcgctgctgggcgccaacatggggctcagggagggccccgtcttcttcttctccgtggggctggcgcactacagcgtgctgttcgtcacgttgtaccagcggctccccaccaacgagacgctgcctaaggagctccacccggtgttcttcctcttcgtggcggcgcccagcgttgcgagcatggcgtgggccaagatcacgggcgagttcggctacgggcccagggtggcctacttcatcgccatgttcctgtacgcgtcgctggcggtgcggatcaacttcttccgggggttccgcttctcgctggcgtggtgggcgtacacgttcccgatgaccggcgccgccatcgcctccatccgctactccaccgaggtggacaacaccttcaccaaggcgctctgcgtggcgctgtccgtgatcgccgtgctcacggtgacggcgctgttcgtcaccacgctggtgcacgcgttcgtgctccggaagctcttccccaacgacatctgcatcgccatcacggaccacaagatgaagcccatcatggagctgcacgagagccatggcgaggacagcagcaccaacagcaacgacatcgaggccggcgccggtggcaaacagtgagggacgcgacgcctagctaggaagcatgcataagcaatgcacgcgcgcgcacacacccaagtcgccgagcttcacgcacgccaagcgtggggggatgacgcgaccgagttcttgcttggattggattggatctttctataggattgcctacttggttcgatggcgcacgctgaggacctttgatggattgcatctattagttactctatctactactagtcagtagagaactacttgaatgtacagagtgggctacgttgtatgaaacgcggctgcttatttatcgtggaaaacattatgcatgcagagtggctttaacttaagctaaaaaaaaaaaaaaaa

SEQ ID NO: 94395 - protein, 634 aa, Zea mays
  misc_feature: Ceres CLONE 1584160
  misc_feature (280)..(546): Pfam Name: C4dic_mal_tran Pfam Description: C4-dicarboxylate transporter/malic acid transport protein
MAEANRRTTPRPRAVPPLLAEVEVSNLPGFDVTPTPSPHGQDATTPSPRPPTKPSSRPGVPPLDRVPCRSEVVFPPLDSPFQAPGYRSVQPVSISLPASPIGFGFGVPAIPAPANAADSDDDGLQANAAAGEPQQAPAQAPTPTPPPARENGGGGGVRFMHQPDKLVFRSQPIPGGQPQRAGSRAARACRAISRDRRYDTFKTFSGKLERQLTHLAGAPEVQEVRGDDAVEDATSRTTSMPKVDRFFAALEGPELDKLKTSEELVLPSDKTWPFLLRFPVSAFGICLGVSSQAILWKTIASSSPTTFLHVSHKVNLVLWCISVLLMCAITAVYALKLAFFFEAVRREYYHPIRINFFFAPWIACLFLAIGVPPSVATEPLPQWLWYALMAPVLFMELKIYGQWMSGGQRRLSKVANPSNHLSVVGNFVGALLGANMGLREGPVFFFSVGLAHYSVLFVTLYQRLPTNETLPKELHPVFFLFVAAPSVASMAWAKITGEFGYGPRVAYFIAMFLYASLAVRINFFRGFRFSLAWWAYTFPMTGAAIASIRYSTEVDNTFTKALCVALSVIAVLTVTALFVTTLVHAFVLRKLFPNDICIAITDHKMKPIMELHESHGEDSSTNSNDIEAGAGGKQ

SEQ ID NO: 94396 - DNA, 804 bp, Zea mays
  misc_feature: Ceres CLONE 1584161
gcggtggcggccgctctagaactagtggatcccccgggctgcaggaattcgtctcacccctagaaaaaccgtttcttcgtttgattccctcccgccgccgctcgccgccgctggagacgctgaaccacgacagcgccccagggttggtcctcccgctggaatagtaagtgaccggagtataaagcaggacaagagagatgtggtacctatgcagtcttctaccacaggctcctggactaccggcgaccggaggtggagtccctcgccgagctctttgcacggtccaggcgcccgtgaatacgtcgagtggcgcatgccggagaaccacgacgtagactccgccttgcaactgcgttcgtctccatggagacgagcgcctcgccgctcatgtcgccaaccgcagcttgttggtgaaggggatctactagctcaggggctatggcactacctacgaggagctggagaagtcggtcagggagtactccgacgagaggaagcttccgttgctggtcccggaaagcagcttcaaaatcgttatcgacagcttcagcaaggtgatcagctcccaagagcagaacgagatcatacagagcctcgcttacatacctttcaagggaggtgttaatttgaagaagcctgatcacacattctttgtcatggagaccgatgactatgggtcgaacaatggtctcccaccggttggtgaagagtcgatattctttgggccggaaggtttggagcagcttgatagggatcttcttgcccaaattccaggctccaggagaagggaggtaaatttggccc

SEQ ID NO: 94397 - DNA, 849 bp, Zea mays
  misc_feature: Ceres CLONE 1584165
  misc_feature: Encodes the peptide sequence at SEQ ID NO. 94398
  misc_feature (701)..(701): n is a, c, t, g, unknown, or other
  misc_feature (849)..(849): n is a, c, t, g, unknown, or other
ctcaccgcggtggcggccgctctagaactagtggatcccccgggctgcaggaattcgtctcacccctagaaaaagatggagctgtgagctgagctgagctgagctcaccaccaccacacacgggagatagctatagctagcatagcaagccagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcccgcccaccttccccttcttcgtgggcgtggacccgcgcgtggtcgccatcgtggacgccgccgccttcaccgcgctcttcgacccggacctcgtggacaagcgcgacatcctcatcgggccctataacccgggcgccggcttcaccggcgggacgcgcgtcggcgtgtacctcgacacgcaggaggaggagcacgcgcgcgtcaagaccttcgccatggacctcctccaccgttccgcccgcacctgggccgcccgacttccgccccgagccgtcggcgccatgctggaaccccggggaaccccccgatttcgngcaaagaacaaagggcatccaacaaagaaagcccttcccgcccaggctaccctcgggccccccctggcaaggagtggccaatccttcccggggttcccccttggcaaggggtgttttccttgggggcgccccgaaaccccctctcccn

SEQ ID NO: 94398 - protein, 221 aa, Zea mays
  misc_feature: Ceres CLONE 1584165
  misc_feature: SWISSPROT Homolog: EC 4.2.1.92 Hydroperoxide dehydratase
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWAARLPPRAVGAMLEPRGTPRFRAKNKGHPTKKALPAQATLGPPLARSGQSFPGFPLGKGCFPWGRPETPSP

SEQ ID NO: 94399 - DNA, 812 bp, Zea mays
  misc_feature: Ceres CLONE 1584172
  misc_feature: SWISSPROT Homolog: EC 1.11.1.6 Catalase
tggagctccccgcggtggcggccgctctagaactagtggatcccccgggctgcaggaattcgtctcacccctagaaaaaatgtaaaccacactctactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgccgtcccatcctgctgtgaggactaccaccgtgatcgagaaggtggcgcacttcgcgcgcgagcacatcccggagcgcgtggtgcacgcacgcggggcctccgccaagggcttcttccagtgcacccacgacgtgacgtctctgacgtgcgccgacttcctgcgcgcgcccggcgtgcggacacccgtgatcgtgcgcttctcgacggtgatccatcgagcggggttccccggatacgatctcgcgacccgcgcgggttcgccgtgaagttctacacccgcgagggcaactgggacctgctgggcaacaactgtccccgtcttcttcatccgcgacggcatcgagttccccgacgtgatccacgcgttcaagcccaacccgcggtcgcacgtgcaggagtactggcgggtgttcgacttcctgtcacacctcctcgagagcctgcacaccttcttcttcctcttcgacgacgtgagagtgccgtccgactaccgccacatggaaaggttcagcgtgaacacgagcacgttcgtgagcgcggcggagtaagcg

SEQ ID NO: 94400 - DNA, 885 bp, Zea mays
  misc_feature: Ceres CLONE 1584174
  misc_feature: Encodes the peptide sequence at SEQ ID NO. 94401
  misc_feature (67)..(67): n is a, c, t, g, unknown, or other
  misc_feature (885)..(885): n is a, c, t, g, unknown, or other
ctggagctccccgcggtggcggccgctctagaactagtggatcccccgggctgcaggaattcgtctnccccctagaaaaaatcctcccctccgcccaccaatgttccttcgcttccgtcaggtcgggtccgcagcctccccctctcgaagatccccacctgctccgccgccggccaccgcgttgttcccctcggcagccaggatgacagaagtaccatttctgccacgtgagaggctcttcaagcagcaacattacttccagaacttgaccaagcacacctacctgaaagggcgctacgacgtgatcacctccgtcgccatcccccttgaactcgatgcctccagcatgttcatgattgggcatggagtttacaacatgtctcatggggttgggaagaaagagtgatcttccactggttaactattgtttctgcttggcatggaagtcataccgtcgagactgcgaagtcctcttcgcatgcaaaataatacggccaaataacaattcgactacattttcggatcaatttttcctgttgcattttgcgggtgtgaaagggcaataacttgaaaatcagcactgtcaaaacggaaaagctggggggcaaaactttttacaaaaagaaaggccaaaaatttcttttggttatcccacaggggggggtccccaacccttccccccctcccggaaacccaaaaggtgcttctcccccgggcacccagttttgttccccctgtggaagcccgtggtaaaaaaatcccctttttggcccctcggggaggggttttataggggaaaattttttttttgaaagggtgtcccaacacccctctctcgggagaggggcctctaaaggataaaacacggggggagaacaacccctn

SEQ ID NO: 94401 - protein, 67 aa, Zea mays
  misc_feature: Ceres CLONE 1584174
  misc_feature (9)..(62): Pfam Name: COX7a Pfam Description: Cytochrome c oxidase subunit VIIa
MTEVPFLPRERLFKQQHYFQNLTKHTYLKGRYDVITSVAIPLELDASSMFMIGHGVYNMSHGVGKKE

SEQ ID NO: 94402 - DNA, 863 bp, Zea mays
  misc_feature: Ceres CLONE 1584183
agctccccgcggtggcggccgctctagaactagtggatcccccgggctgcaggaattcgtctcacccctagaaaaaacgacccggcccaggctgccatcgaggagggacgagggagggatccagcgagcggagcggagcggacgccaccctcgcgcgcacacctacgcgcaggcgcatacaccaacgacgcccacccccttccagggtagggagggagggaaacacacaactcggacccgacccgacgccccgaggcgagggctaaggcgaaggcgagcggtcagccggccggggcggggaccagggggggatcccctcggcggcgtccgcgtcggccggcatgggcgcgggcttcccgggcgatgttgggcggggctgggtcctgtggggggtattggccgcatccggccccgacgtttggcggggctgcctaggtttcccgaaggcgcccgaatacaggaaacggggacgggtgccccaacccccgtgaacggggcggggggtcttcgaaccgggccttgtgggccattgccatggagctttgaaaggcactaaactctggggggtccctgggcgggcaacttatttgctggttaaagagggccttcctggcccgggggccatcttttttcaccttactcgcgcgggaagggggggggggggggcccggcccccttgcaaaaaaacccggggggcccctggggggcctcctttctcgggcgtgggggttttgaggaaaaaacccgttttgcgcgcaccaaagggggtccgggggaaatttattgcggtccctggggggccgggggttttagggggggcgccatatatttggggggggaaacacctttttgggaaagggttt

SEQ ID NO: 94403 - DNA, 876 bp, Zea mays
  misc_feature: Ceres CLONE 1584184
  misc_feature: Encodes the peptide sequence at SEQ ID NO. 94404
aaagctggagctccccgcggtggcggccgctctagaactagtggatcccccgggctgcaggaattcgtctcacccctagaaaaaacgacccggcccaggctgccatcgaggagggacgagggagggatccagcgagcggagcggagcggacgccaccctcgcgcgcacatctacgcgcaggcgcatacaccaaccacgcccaccccttccagggagggagggagggaaacacactatcggatccgacccgacgccccgaggcgagggagagggcgagggcgagcggtcagccagcaggggcggggaccaggggggatcccctcggcggcgtctgcgtcggccgacatggacgcggcctcccctgcgatgtgggacgggcaggtcctggtggtgttattggccgcatccggccccgaggctgcggggactgccaagttcgccgaggcgcccgactacaagaacggggacgggtgcccagccctggtgacggaagcgggggtctgcgaaacctgcctgacgcacgataacatgaccttcaacgagcactacatctgggggtccatgacggccatgtacgcgatgctaaagtagcgtctcctgccgcggagtacatctttttccagttcctcacctgggaaggggggaaggcccacaagcccgcgcacaaaataccgggccgccgagggccgcaggctttcccggaacgagctctgcgaccaactaaccatttccgacgcccaagggggaggatggggtaaaaataaggtggcccccgggccccgaaagctccaaggtggcagcatctggttggcggggagacctccccttccctaaccctgagtcccccaagaataagaaaccctcgggggttatttg

SEQ ID NO: 94404 - protein, 81 aa, Zea mays
  misc_feature: Ceres CLONE 1584184
MDAASPAMWDGQVLVVLLAASGPEAAGTAKFAEAPDYKNGDGCPALVTEAGVCETCLTHDNMTFNEHYIWGSMTAMYAMLK

SEQ ID NO: 94405 - DNA, 820 bp, Zea mays
  misc_feature: Ceres CLONE 1584185
  misc_feature: SWISSPROT Homolog: EC 1.10.3.2 Laccase
  misc_feature (149)..(149): n is a, c, t, g, unknown, or other
  misc_feature (165)..(165): n is a, c, t, g, unknown, or other
  misc_feature (191)..(191): n is a, c, t, g, unknown, or other
  misc_feature (197)..(197): n is a, c, t, g, unknown, or other
  misc_feature (485)..(485): n is a, c, t, g, unknown, or other
tggagctccccgcggtggcggccgctctagaactagtggatcccccgggctgcaggaattcgtctcacccctagaaaaaatcgcaaactcggaaaccttgagaggaaagccaccagcagcaagcgaagaccaccagcagcagcgcagcnggcgacgtgtttcgcntctcgccatgggcgtcgtcgtcctcngtcccnggctggctgctcctcctcctcccgtgcctcgcgctcacgctgctcggcgcggcagacgccgaagtgcaccaccacgagttcgttatccaagagacgccggtgaaagagctgtgcaagacgcacaacatcatcacggtgaacgggcagtacccggggccgacgctggaggtcagggagggtgacacgctcgtcatcaacgtcgtcaaccggggcgcagtacaacgccacccattccacgggcacgggattccgcccagattaaggactgggttgggccggaacgggccnggaaatttcctggaaccacatggccccccatttagggccccgggcgggggaggcttaaaaagttaccccggttttccccctcccccagggggggcaaaggaggggggccccccctgtgggggtggggacagcggggccaaagagtttccctggggggtttaggggggggccccccctttttttttggggggggggggcgttttttttatttccccgccccccccgggggggggaaaaaaaaaaaaaaacccctctccccccctttttttcccccaaaaaaacaccccctctgcgggaggaaaaaaaaaaccccccccgtggttaattttttctcg

SEQ ID NO: 94406 - DNA, 799 bp, Zea mays
  misc_feature: Ceres CLONE 1584186
  misc_feature: Encodes the peptide sequence at SEQ ID NO. 94407
ctggagctccccgcggtggcggccgctctagaactagtggatcccccgggctgcaggaattcgtctcacccctagaaaaaacacctattccgccacccgcctctcacctctccagtccccacccccgcccccgtccgctcccctatcctgttcgttcccctcctctccacacgatcccctcccttgtcggcttccgcgcgggcgggagtggccgcggccacgactccaccgcctcctgctcgcgccaccacccctcggcccctcgcggcgccgcgcgaccggcgcgtggtgcgcgtttgcctgcccgtcgtcggccctttcttattagttattattaggcggaggagaggctagctctgcggggggtcgccgcgcgccgccgaatcggatcacacgcctccccttcccgccaggccagggggccatggccacgctcccgcgcgccgcgccgcccacgcccgccgcgctgctcccgctgccccgcgccgcgccgccgctgctgctcgccgggagggccgccgccgcgcgccgctctcggctgcgcgcgcggggcccgtccgcggcggcgcgccggagctgggtcgtcgcctccgccgcttcctcctcctcacgggccgtggtcggcggcgtcgcccgccgggaggcccctcccgcgccgcagaagcccacgcagcatgctgcggacttgaaccatatcttgtctgaacgtggagcttgatggtgttggatttgtcgcaaactttgaaaatatgtcttcatttgacattgttcgtgatgactctatgggctctgggtgcag

SEQ ID NO: 94407 - protein, 97 aa, Zea mays
  misc_feature: Ceres CLONE 1584186
  misc_feature: SWISSPROT Homolog: EC 1.4.7.1 Glutamate synthase (ferredoxin)
MATLPRAAPPTPAALLPLPRAAPPLLLAGRAAAARRSRLRARGPSAAARRSWVVASAASSSSRAVVGGVARREAPPAPQKPTQHAADLNHILSERGA

SEQ ID NO: 94408 - DNA, 1037 bp, Zea mays
  misc_feature: Ceres CLONE 1584189
  misc_feature: SWISSPROT Homolog: EC 1.1.1.22 UDP-glucose 6-dehydrogenase
  misc_feature (1037)..(1037): n is a, c, t, g, unknown, or other
caagctggagctcaccgcggtggcggccgctctagactagtggatcccccgggctgcaggaattcgtctcactcgtgagacaacgcagacaaataagccgagtcgtcgtgagcagggagagtctctcctttaccacggcatcacgccaaggaagagagagagatcgccgctccccttctcggcgtcgggggtgcgggtgccctcactcctcaagcgagatctgtctggtcacagatctatttgacaaaatggtgaagatatgatgcatcggcgctggctatgtcggtggcccaaccatggccgtcattgccctcaagtggccagaccttgaggtcgtcgtagttgacatctccaagcccctcattaatggctgaaacagggggaccctgccaatctacgagcccggtctctatgatgttgtgacgcaatgtaggggaaggaacctcttctgcaccactgactgttgaaaagggcgtagcttaagggttgacatttatattttgtcgtcggagaaccacccctcaccaaataccccttggggccttggaagcttggccaaggggtgtcctaagccttaccctacctggggaaaaaagcgcttgccccggccatttaattggcgggaattgttattcccaaggtttctggaaaagaggaccttgtcctggatatgaagaaaagtatccaggattggggctctgtggggacaatataacccgcctgtgaaggggggtactgggagcgaaagaatctctttgatcacccggcacaccctcgcaaggggggctatctcaagcttagcaaaagaaatcccttgtgccaaacacccgatagagtatccctttgatcctgaagggccccctccctcgtttttgagccaacctgtgtatataggcccctgtgaaaaaacacgctctttatgtgcgtgcgccttgggggaaacaccccccgaatgcgctgggggaaggggcggcatccgggcctccttataagtatagtatgatgcgtcttaaccagtgggtttccgccatgccatn

SEQ ID NO: 94409 - DNA, 1185 bp, Zea mays
  misc_feature: Ceres CLONE 1584191
  misc_feature: Encodes the peptide sequence at SEQ ID NO. 94410
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (1166)..(1166): n is a, c, t, g, unknown, or other
naattttnnnnnnnaaaattcgacacttctatccccctactttttttttttcnnnnnccccnnnnnnnnaaagcggagctccccgcggtggcggccgctctagaactagtggatcccccgggctgcaggaattcgtctcacccctagaaaaagctccttacgccgccgccgttgcccacgagccgggatgctctgcggcgccatctcccgcctcggtgctcgcctccgcctccacgccgaaccctcttcggcctctcctcgcctccgcgtcctctccacccgccgcggtaaaacgctccgtcccccaccctgtcggccccggtggacttgcaatgaccgagggaaccccgtgccgcgggcctccttcggcgccttatcccggcgaacccccgaaagtgccccccccggcgagcctgacctgggcggggtttgcaaagtctgccggatcttcccgcccccccgggtaaaaggccttcccactcgagaggccccccatgggtttggcgtgtgggggggcgccccctactttcctctctcgaatcaatacatttccccttcacgcggcttcccgggcggccccccacaccgtgggcttgggggggcgcgcatcgatcccccccggtgttcgcgggggactccccacagcagggtggcggtcgtctattgttcctgtgaggacccgcctgataatgtgcgcgtgcggccggagggaatcgcctcacggtgtggtgttgttcgacctgtgaggggagggttttcgcctcccccctatcatccctagtgggtgtaggttatattccaccctgccccggacattttggtgatgaactcgtgtgcgagacgtcacgtcgaagcgtcgccgccgcgtaccctgcctcggcgtacagcacaccttatcgtgtgcctattggagcaggggtgtgggcgtccgttattccatcgctcggtcgattctgtcctccctatacatcgcgcgctgtctcatacctcccctgagcagctggggcggcggcggcgcgcgaggtgttattcgccccgcggacttcactccttccgctcaacactcctatgtgtcttctaagaccgtaatgtgactctctcgtcccgctatacagtacgacgcgcgaagactcgatgtgggtggggggggcccagcccgctaacgntgccggctcactcccccat

SEQ ID NO: 94410 - protein, 197 aa, Zea mays
  misc_feature: Ceres CLONE 1584191
MLCGAISRLGARLRLHAEPSSASPRLRVLSTRRGKTLRPPPCRPRWTCNDRGNPVPRASFGALSRRTPESAPPGEPDLGGVCKVCRIFPPPRVKGLPTREAPHGFGVWGGAPYFPLSNQYISPSRGFPGGPPHRGLGGARIDPPRCSRGTPHSRVAVVYCSCEDPPDNVRVRPEGIASRCGVVRPVRGGFSPPPYHP

SEQ ID NO: 94411 - DNA, 843 bp, Zea mays
  misc_feature: Ceres CLONE 1584192
  misc_feature: Translation starting site: 166
  misc_feature: SWISSPROT Homolog: EC 2.3.1.162 Taxadien-5-alpha-ol O-acetyltransferase
  misc_feature (833)..(833): n is a, c, t, g, unknown, or other
  misc_feature (843)..(843): n is a, c, t, g, unknown, or other
ggagctccccgcggtggcggccgctctagaactagtggatcccccgggctgcaggaattcgtctcacccctagaaaaaacagactcctcacactccctactgggctggctacgtacggtacgtgctagtactgttagccaggaacaagccccagcagcagcagcaatggccgtggagaacggcagcgccgacgaggcggcggcggtgaccgtgaccggcgcccgcaccgtggcgccggccaagaaccgctgcacgctcgccaccttcgacctcccctacatcaccttctactacaaccagaagttgctcctgtaccgcgccgcccccgactttccggacgccgtggcgcgcatgacggccgcgctcgccgacgcgctccgcgtcttctacccgctcgccggccgcatccgccaggacgacgacggcggcgcgctggcagtcgagggcgacgagggcgccgaggtcttcgaggccgaggcccagggcgtcgccgtcgacgacctcgccggaggggactgcagcgacgaggcggagaaggtcttgcagcacctcgtgccctacaccggcgtcatgaacctcgagggcctccgccgcccgcttctcgccgtccaattcacaaagctcaaggacggtctgggcggtggggtgcgccttcaaccacgcggtgctggacggcacctccacgtggcacttcatgtcctcatgggccgagctctgccgcggcgtacccctgtcgctgcagcccatccacgaccggtccctggtccgctccgtgcgcgtgcggctggagctgccggcgtccgccgagggccacgcgaagacggacccgaacngggcgaagan

SEQ ID NO: 94412 - DNA, 881 bp, Zea mays
  misc_feature: Ceres CLONE 1584195
  misc_feature: Encodes the peptide sequence at SEQ ID NO. 94413
  misc_feature (479)..(479): n is a, c, t, g, unknown, or other
  misc_feature (521)..(521): n is a, c, t, g, unknown, or other
  misc_feature (547)..(547): n is a, c, t, g, unknown, or other
  misc_feature (648)..(648): n is a, c, t, g, unknown, or other
aaagctggagctccccgcggtggcggccgctctagaactagtggatcccccgggctgcaggaattcgtctcacccctagaaaaaagctccccccactcgcgttgtctcttgtcgctgcctcgtcccgtccaatccttccaagcctctcttcttgctgcagctgccccaagaccgccccgcgccggctcaatccggcgggacgaggagacggcattgctcgcatcgcctgccctagcctgcgctgcccccccatgcgtgttgtgcgcatgaacagaggctaggctaccaacacatagcacgacagccatggatcccgagttcggcgtcggcacggcgccacaaaaggggcggcaggcgtggcggacgacactgctgctggcgtaccagagcctcggggtggtgtacggcgacctcagcatctcgccgctgtacgtgtacaagagcaccttcgccgaggacatcacgcactcggagacaanccaggagatcttcggcgcgctctccttcgtcttctggacgcntcacctcgtccggctcctcaagtacngccacatcgtcctgcgcgccgacgacagcggcgagggcggcacgttcgcgctctactccctcatctgccgccacgccaatgtcagcctcctccccaaacgncaggtcgccgaccagaagctctccacctacagggctgagacgcccgcgcgagggccgccgggaggtcgggcttgctcagggcgtgggttggagaagccaccagactgccaccgcgctgctcgtcaatgggcatgatcggcacctggatgggtcattggggacggggtcctccggcccgcccaattccggtttcttcgccgtttcagggctcgaggcctttcccgttccaagaa

SEQ ID NO: 94413 - protein, 158 aa, Zea mays
  misc_feature: Ceres CLONE 1584195
  misc_feature (58)..(58): Xaa is any aa, unknown, or other
  misc_feature (72)..(72): Xaa is any aa, unknown, or other
  misc_feature (81)..(81): Xaa is any aa, unknown, or other
MDPEFGVGTAPQKGRQAWRTTLLLAYQSLGVVYGDLSISPLYVYKSTFAEDITHSETXQEIFGALSFVFWTXHLVRLLKYXHIVLRADDSGEGGTFALYSLICRHANVSLLPKRQVADQKLSTYRAETPARGPPGGRACSGRGLEKPPDCHRAARQWA

SEQ ID NO: 94414 - DNA, 955 bp, Zea mays
  misc_feature: Ceres CLONE 1584196
  misc_feature: Encodes the peptide sequence at SEQ ID NO. 94415
  misc_feature (1)..(1): n is a, c, t, g, unknown, or other
  misc_feature (2)..(2): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (74)..(74): n is a, c, t, g, unknown, or other
  misc_feature (76)..(76): n is a, c, t, g, unknown, or other
nnaaattaaaaataacaaaagagagttcatcggtcccccccgtgtttttattataggcgnnngggaataaaaantncaaaactggagctccccgcggtggcggccgctctagaactagtggatcccccgggctgcaggaattcgtctcacccctagaaaaaattatcgccttcaacacattgaaatggctctaaagtatgtcaaccgtgcactatatctgcttcagttctcgtgtgggctttcacacccgaattcagctgccacctacataaatgtggctatgatggaagaaggcatgggaaatgttcatgttgctcttcgatacttgcatgaagccctgaagtgcaacaagaggttgttaggagctgatcacatccagactgctgcaagctaccatgccatagccattgccctttcaatgatggacgcgtactccctaagcgtgcaacatgaacaaacaaccttgcagatacttcaggagaaactagggcaagatgacctccgaactcaggatgctgctgcatggctagaatattttgagtcaaaagcattagaacaacaagaggcagctcgaagaggcatgccaaaacctgattcatctattgcaagtaaaggacatcttagtgtatcagatcttcttgacttcataagcccagaccaggaaagaaaagaaagggatatgcaaaggaaatgcaggcgtgcaaagaataatatcagagctcatcacggttgaatcagtttgaagaagaaggagaaattttcagctttgtttcaggaatcttcctcttgaaagcaaagcaagagacagttttttcaaagaaagaaaaaaactgggaatggtgaaaatcccttcccctgccttgtaatttaagaaaagaaaaaattaatgtgcctggccccccagtggaattgaagcccaggaaaagccccaaattggtgggaatttggtttttta

SEQ ID NO: 94415 - protein, 182 aa, Zea mays
  misc_feature: Ceres CLONE 1584196
MALKYVNRALYLLQFSCGLSHPNSAATYINVAMMEEGMGNVHVALRYLHEALKCNKRLLGADHIQTAASYHAIAIALSMMDAYSLSVQHEQTTLQILQEKLGQDDLRTQDAAAWLEYFESKALEQQEAARRGMPKPDSSIASKGHLSVSDLLDFISPDQERKERDMQRKCRRAKNNIRAHHG

SEQ ID NO: 94416 - DNA, 811 bp, Zea mays
  misc_feature: Ceres CLONE 1584200
  misc_feature: Encodes the peptide sequence at SEQ ID NO. 94417
gcggtggcggccgctctagaactagtggatcccccgggctgcaggaattcgtctcacccctagaaaaagccagaacccagcacagctctacccaccaattctgattctggaagacagacagtagtcgatcgcatcgcatcgcatggcgacgaggccggcagcggaggagaagccgtgggagctggcggcgcacccgcggctgcccaagggcaggacggtggccgtggtggtgctggacggctggggcgaggcggcgcccgaccccttcaactgcatccacgtcgccgacacgcccacgctcgacgccctcaagaaggcagctccggagagatggaggctcatcaaggcgcacgggacggcggtggggctgccgacggacgacgacatggggaacagcgaggtcggccacaatgcgctcggagcgggacagatatacgcgcagggcgcgaaactggtcgatctggcgctgggttccgggaagatatacgagggcgaaggtttcaagtacatccagcagtccttccaggacggcactctgcacctcatcggcctgctcagcgacggaggcgtgcactccaggttcgaccagctgcagctgctgctccaaggtgctagcgagcgcggggcgaagaggatacgtgtgcacgtcctcacggatgggcgggacgtggcggacggcagcagcgtcaggttcgtggagatgcttgaggaggacctcgctaggcttcgggagaagggcgtcgatgcgagaatagcgtctggcggtggcaggatgtatgtgacgatggaccgttacgagaacgactggcac

SEQ ID NO: 94417 - protein, 223 aa, Zea mays
  misc_feature: Ceres CLONE 1584200
  misc_feature (22)..(223): Pfam Name: iPGM_N Pfam Description: BPG-independent PGAM N-terminus (iPGM_N)
  misc_feature: SWISSPROT Homolog: EC 5.4.2.1 Phosphoglycerate mutase
MATRPAAEEKPWELAAHPRLPKGRTVAVVVLDGWGEAAPDPFNCIHVADTPTLDALKKAAPERWRLIKAHGTAVGLPTDDDMGNSEVGHNALGAGQIYAQGAKLVDLALGSGKIYEGEGFKYIQQSFQDGTLHLIGLLSDGGVHSRFDQLQLLLQGASERGAKRIRVHVLTDGRDVADGSSVRFVEMLEEDLARLREKGVDARIASGGGRMYVTMDRYENDWH

SEQ ID NO: 94418 - DNA, 1033 bp, Zea mays
  misc_feature: Ceres CLONE 1584202
  misc_feature (17)..(17): n is a, c, t, g, unknown, or other
  misc_feature (62)..(62): n is a, c, t, g, unknown, or other
  misc_feature (63)..(63): n is a, c, t, g, unknown, or other
tttattttttatttatnattatattttcattttttttccaatatattttttatattctttgnnacgagagagataaaaaactggagctccccgcggtggcggccgctctagaactagtggatcccccgggctgcaggaattcgtctcaccccctaaaaaataccgctttcccagggggtccccgccgcttatgctcctgcataaatagcccgagggagggcggatgctgctgaatcgtgctcggtgttccttccctcgccgcacgcgggatccatttgacggacggaccgaccgagcgactcacccgtccaccgagagccatggggcagaggcagagccacagcaagcgggacgggagcagccacgggcggcggtcgcgctcctttcagcagcagccgtctgcgcaatggggcgccggaggaggagggtactactagcaggacccaagcaccggctactacggcgcgccggtgccacaacaaggaggagggtactaccaacaggacccaggcaccggctactacggcgcgccggtgccacagcatggaggagggtacgccgcgccgtaccgggacaagcccgccgctgtcgccgttgctgctccagcgccgcaggctgcgaagccgcggcagctggatcggcctgtactccgcggatcgccgacaagtattacttccgggggaccaaggttactgaatgcttctttctccaagcccggaacttgaaatcattccaattccttatttgttgggggattgaatttccacaaaagaagctcaccgaagtgggaccagggcaaatttcatctttttccaatgggactccagtcctaaaaggcaaatttttgggcgaacaaaaacacaaaatcccgttgtttgaaaccaagaacactatcttcccccttttatttgggggccaaaaaccccctaattgcgaaaaaaatttccggagtgaaaagagaataaaaaacttcttggactatccccccagggtgtttttcacagaaatattttgtgggaaggatattgtcaaa

SEQ ID NO: 94419 - DNA, 803 bp, Zea mays
  misc_feature: Ceres CLONE 1584203
  misc_feature: Encodes the peptide sequence at SEQ ID NO. 94420
ctccccgcggtggcggccgctctagaactagtggatcccccgggctgcaggaattcgtctcacccctagaaaaaatctccgcccacacaacacaacaaagcacaccaccccaccccccgaaacggacgctacccctccccgcctcgtctcgctccgctccgctccggcccgttccggctctcgccaccccagccgagatgcggtcgccgccgcccccaccgtggcgcgccgggcgcctccattccccgctccccatgctcctgctcttcgtcgcggcgctggcggcgcgggcgggggccgacgacctcgcgagcgacgcgcgggcgctcctggcgttccgcgacgccgtggggcggcgcctgacgtggaacgcctcggacgtcgcgggggcgtgctcgtggacgggggtctcctgcgagaacggccgcgtggcggtgctgcggctccccggggcgacgctctcgggggcagtccccgcggggacgctcgggaacctgacggcgctccacacgctcagcctccgcctcaacgggctctccggcgcgctcccggccgacctcgcctccgccgccgcgcttcggaacgtcttcctcaacgggaacaggctgtccggcgggttcccgcaggcgattctcgcgctcccggcgctcgtcaggctctcgctcggcgggaacgacctgtcggggcccatccctgcggagctcggcagcctcacgcacctcagggtccttctcctggagaacaatcgcttttccggcgagatttcggatgtcaagctaccgccgctgcagcagttcaatgtc

SEQ ID NO: 94420 - protein, 202 aa, Zea mays
  misc_feature: Ceres CLONE 1584203
  misc_feature (37)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
MRSPPPPPWRAGRLHSPLPMLLLFVAALAARAGADDLASDARALLAFRDAVGRRLTWNASDVAGACSWTGVSCENGRVAVLRLPGATLSGAVPAGTLGNLTALHTLSLRLNGLSGALPADLASAAALRNVFLNGNRLSGGFPQAILALPALVRLSLGGNDLSGPIPAELGSLTHLRVLLLENNRFSGEISDVKLPPLQQFNV

SEQ ID NO: 94421 - DNA, 1015 bp, Zea mays
  misc_feature: Ceres CLONE 1584209
  misc_feature: Encodes the peptide sequence at SEQ ID NO. 94422
  misc_feature (1)..(1): n is a, c, t, g, unknown, or other
  misc_feature (17)..(17): n is a, c, t, g, unknown, or other
  misc_feature (1015)..(1015): n is a, c, t, g, unknown, or other
naaaaattaaaaaaaanacaaaaaaacatattatatgtttatttttttttttatgttattgttgttatttatttaaaattggatctccccgcggtggcggccgctctagaatagtggatcccccgggctgcaggaattcgtctcacccctagaaaaaatctccgcccacacaacacaacaaagcacaccaccccaccccccgaaacggacgctacccctccccgcctcgtctcgctccgctccgctccggcccgttccggctctcgccaccccagccgagatgcggtcgccgccgcccccaccgtggcgcgccgggcgcctccattccccgctccccatgctcctgctcttcgtcgcggcgctggcggcgcgggcgggggccgacgacctcgcgagcgacgcgcgggcgctcctggcgttccgcgacgccgtggggcggcgcctgacgtggaacgcctcggacgtcgcgggggcgtgctcgtggacgggggtctcctgcgagaacggccgcgtggcggtgctgcggctccccggggcgacgctctcgggggcagtccccgcggggacgctcgggaacctgacggcgctccacacgctcaacctccgcctcaacaggctctccggcgcgctcccggccgaacatcgcctcccgccgccgcgccttcgggaaacgtcttccctccaatcgggaaaacaggctggtcccgggcgggggttcccccgccaggccggaatttcttcggcgggcttccccgggcgcctcagacaaggggttcttcgcatccggcgggggaaacccaaccctgttccggggggccccatccccctgtcgggaagcttccgggcaaaacccttcaacgcaaccatcaagggggtgccctttctccccggggaagaaacaaatttcccccttttttccaccgggcgaaaaattttttcgggaaatggttcaaaggccctaccccggccacccccttgctggggccatcgtattacaatgtgggccctcaggtan

SEQ ID NO: 94422 - protein, 225 aa, Zea mays
  misc_feature: Ceres CLONE 1584209
  misc_feature (18)..(55): Pfam Name: LRRNT_2 Pfam Description: Leucine rich repeat N-terminal domain
  misc_feature: SWISSPROT Homolog: EC 2.7.11.1 Non-specific serine/threonine protein kinase
MLLLFVAALAARAGADDLASDARALLAFRDAVGRRLTWNASDVAGACSWTGVSCENGRVAVLRLPGATLSGAVPAGTLGNLTALHTLNLRLNRLSGALPAEHRLPPPRLRETSSLQSGKQAGPGRGFPRQAGISSAGFPGRLRQGVLRIRRGKPNPVPGGPIPLSGSFRAKPFNATIKGVPFLPGEETNFPLFSTGRKIFSGNGSKALPRPPPCWGHRITMWALR

SEQ ID NO: 94423 - DNA, 803 bp, Zea mays
  misc_feature: Ceres CLONE 1584210
  misc_feature: Translation starting site: 249
  misc_feature: SWISSPROT Homolog: EC 2.7.11.1 Non-specific serine/threonine protein kinase
ggagctcaccgcggtggcggccgctctagaactagtggatcccccgggctgcaggaattcgtctcacccctagaaaaagtcgagcacacaacacatcctcctccaagactcgcttcgcttctcccccagctcggacggagctcctcgcagtcgcagcagccgccgatcaacctgcgctcgggctcagcgctggaaggtgttggaagagaatagcctgaaggttcacagtaaccttcatctgttggaagatgtatcgggctaagagggctgcattgtcaccgaaggtgaagcgccgcgtcggcaagtacgagctcgggcgcaccattggggaagggacctttgccaaggtccggtttgctaagaacaccgaaaacggggaacctgttgctatcaaaatccttgacaaggagaaggttaagaggcacagattggttgagcagattaagcgtgaaatttgcatcatgaaattagtaaggcaccctaatgttgttcgactgtttgaggtgatgggaagtaaagcaagaattttcatcgttctggaatatgttaccggcggagagctttttgaaatcattgctactaatggaagattgaaggaagacgaagcacgtaaatacttccagcaactgattaatgctgttgattactggccacagtaggggagtgtatcacagagacttgaagctcgagaatttgctgcttgatgctgcaggaaatctcaaagtttctgacttttggtttaagtgctttaaccgagcaagtgaaggctgatggtctgcttcatacaacatgtggaaccccca

SEQ ID NO: 94424 - DNA, 798 bp, Zea mays
  misc_feature: Ceres CLONE 1584212
  misc_feature: Translation starting site: 251
  misc_feature: SWISSPROT Homolog: EC 2.7.11.1 Non-specific serine/threonine protein kinase
ctggagctccccgcggtggcggccgctctagaactagtggatcccccgggctgcaggaattcgtctcacccctagaaaaagtcgagcacacacaaatcctcctccaagactcgcttcgcttctcccccagctcggacggagctcctcccaggcgcagcagccaccgatacaacctgcgctcgggctcagcactggaaggtgttggaagagaatagcctgaacgttcacagtaaccttcatctgttggaacatgtatcgggctacgacggctgcattgtccccgaaagtgaagcgccgcgatcaggctagtacgagctcgggcgctccattgcgggaacggacctttgccaacgtccggtttgctaagaacgcccaaaaccgggtacacctgttgctatcagaatcctctgacaaggacaaggttaacatgcacagattggttgagcccattaagcgtgaaagttagcatcagtagaaattaggaaggccccctaatgtggtccgactggttgaggagatgggaagtcaagcaagaattctcatctgtctggaatatgttaccagcgagatagcttgttgacatcattgctactaaaggaagattgcatgaagacgaagcacgtaaatacttccagccactgattaatgctgctgattacggccacagcatgggagtggctcacagatacttgaagctcgagaagtcgctgctctgagctgcatgaaatctcatagtctctgagttcgggtcaagagcttttaccaagccagtgaatgctgatggtctgcgtgcgacga

SEQ ID NO: 94425 - DNA, 967 bp, Zea mays
  misc_feature: Ceres CLONE 1584218
  misc_feature: Encodes the peptide sequence at SEQ ID NO. 94426
tagctggagctcaccgcggtggcggccgctctagactagtggatcccccgggctgcaggaattcgtctcacccctagaaaaagcttcttctaatcctcttgtcccgcgaaccccagtcgctaccgagagcacaccaatcctcatcacctccgagattttcatcgcctgccgcgcaatctcgggatcctagccgtccgcacatcgccgcggacttcctccgcgccacgaatggtgttctctggccgctgtcttttcccgaggacctaacccaaggcggtaggtaccagctaaaagtctaaaggcgaccaccggaccgggcggcaatgacgaccgccgcgagggagaggcgcctgccgccgacgctgcccctggccacgcttatcggtcgcgagctccgtgcggggggctccgagcgcccggtcctgcgcttcggccacgccggcttcgccaagcggcggcaaagacttctttcccgcgtcaaagccacaaacgggcctcccgcgttccccgggggggcccccccccccccgggtgcttcctgcgcagtctttcccgccagggttttcaaaatgggcgcccataaacgggtagtctaataacaacgaaggggaagggatttatataactctcgagcagagacggtacacgctgggcgtccgctaattacacgcttctagttggtgggggcgggggttggcaccgtccaccccccggggaaaaacccgccggggcccccttccgtatcttgctcctgcgcttgcggtggtgggttgtgccccacccgcccccccgtgaggcgcaacaaggcatgttgacggtgctgaccaccagggtggtgacccccaccactatacatgaaagttatgtttgtgtggcccccaccccccccctcgggtccccctctcgaggcccccccctatgccccgcgggtctcgtcgccgcggtggctcaaagtggtgggaggcaa

SEQ ID NO: 94426 - protein, 90 aa, Zea mays
  misc_feature: Ceres CLONE 1584218
MTTAARERRLPPTLPLATLIGRELRAGGSERPVLRFGHAGFAKRRQRLLSRVKATNGPPAFPGGAPPPPGASCAVFPARVFKMGAHKRVV

SEQ ID NO: 94427 - DNA, 1060 bp, Zea mays
  misc_feature: Ceres CLONE 1584219
  misc_feature: Encodes the peptide sequence at SEQ ID NO. 94428
ccccgcggtggcggccgctctagaactagtggatcccccgggctgcaggaattcgtctcacccctagaaaaggccgcattgaccaatctgctccgggcaccctggagaggatcagtggcccgcgcctcgctgtcctgctcgctctcgccgtcctcaccgccgtcgccgcagcgaccacggactaggtgcacgcacagtccaactacatcatccacctcgccccaggccacccggcgctgtccgcagcgcgcgacaacggcggcgacgaggcggccctccgccgcctcctcccgcgccgcctgccggcgccaaggacgcacgtgctcttttcctattagcacgctgccaaggggtatcggcgaggcggcttaagcccccagcaaggaaccgcacacccccccccccggggaagggcgtacctgtggccctggtacccccaaaccagatctactggagaactggcaaagcctagccaaacacgcccggggggagtttgccccccgccctttaacaggacaggcctcccccaggggtgggccccccaccggcttagccacaaactggggggggagcaacggatccaaaccaattattagcccccaatctatatccggtgacattgatcttattggataaaaacgcgggggagccccctgtaccccacctccttacctaggcacagagttgctctcttctcgagttatacgtcggggctagtaaaatacaaatgagtgttttcatatgtgggcgccagcggaggaagacaaccggggtttgcccactcccttcctgtgggggtggagacaaatcgataaccacacctttcaaggagtcccaccagatattatacatgaggggaggacgcgcccgataaagctggggcggaacagaccaccacgtctttttgttgcggggtccccctatggttatctccttactagacactgtgggtggtgggttccaaaacaggggtgcttcaccatgaggcccaacgcgcactctgtccgatagagactacacccacggggagtcgtatcaaaagtaacaccccgacctggag

SEQ ID NO: 94428 - protein, 89 aa, Zea mays
  misc_feature: Ceres CLONE 1584219
MWAPAEEDNRGLPTPFLWGWRQIDNHTFQGVPPDIIHEGRTRPIKLGRNRPPRLFVAGSPYGYLLTRHCGWWVPKQGCFTMRPNAHSVR

SEQ ID NO: 94429 - DNA, 1068 bp, Zea mays
  misc_feature: Ceres CLONE 1584223
  misc_feature: Encodes the peptide sequence at SEQ ID NO. 94430
  misc_feature (405)..(405): n is a, c, t, g, unknown, or other
cagagctggagctccccgcggtggcggccgctctagaactagtggatcccccgggctgcaggaattcgtctcacccctagaaaaaatcccgcagcccgccccgtccgcccgcccgagtcacactcacacagagccgagccgagcccaggcaggcaggcaggcggcccaggcgcccagcccacccccctacccccgcggcgccgccggagccggagcgagagcgatggacgcgctgccggaggcgtggtcgcaggtgcgcgcgccggtgatcgtgccgctgctgcggctggcggtggccgtgtgcctcaccatgtcggtgcttctgttccttgagcgcgtgtacatggccgtcatcatctccggggtgcgcctggtccgcctccgccccgaccgcccccaccgctncgaaccccctccccggaggacgaacccggagctgggctccctccgcgttcccccgtcgtgccccgcccaaatcccccatggttcaaccaaggcgggagggggtaccaacctgttcccatcgcccccccttggtgcacggcctgttcatgggccccggccggaacccggcttgggtgggtggcaagggggccccgaaactaactccccccgggaaccgaaacggggttttaagggaaaaaagggtggcccgaaatgtggagtggccgaaacgcggggggggggcctccgggaaaagggggtgaatcaacaacaaaaacgcggtacccaagaaatcccccggagagggaacacgccaaaggggggggtaaaaaaaggggccgggtgccccctcctcccgcggcgggggaaaaaagaggggaaaccgcttaaatgggggcgccgaactgggcggaagaacacttgggcccagttttttgtgaggcccccgatatttctgtatccccgaccacgggaacataccctcaagagggcggaccgattcccgcataagctcggtggccacaaaacccgcgagaaaattgcccccccctcccacagtgcgcgccttgagagggtttctggaaagagcccgcaaagaagtcgcttatataacaagagagaggg

SEQ ID NO: 94430 - protein, 281 aa, Zea mays
  misc_feature: Ceres CLONE 1584223
  misc_feature (61)..(61): Xaa is any aa, unknown, or other
MDALPEAWSQVRAPVIVPLLRLAVAVCLTMSVLLFLERVYMAVIISGVRLVRLRPDRPHRXEPPPRRTNPELGSLRVPPSCPAQIPHGSTKAGGGTNLFPSPPLGARPVHGPRPEPGLGGWQGGPETNSPREPKRGFKGKKGGPKCGVAETRGGGLREKGVNQQQKRGTQEIPRRGNTPKGGVKKGAGCPLLPRRGKKEGKPLKWGRRTGRKNTWAQFFVRPPIFLYPRPREHTLKRADRFPHKLGGHKTREKIAPPSHSARLERVSGKSPQRSRLYNKRE

SEQ ID NO: 94431 - DNA, 923 bp, Zea mays
  misc_feature: Ceres CLONE 1584232
  misc_feature: Translation starting site: 161
  misc_feature (399)..(399): n is a, c, t, g, unknown, or other
  misc_feature (405)..(405): n is a, c, t, g, unknown, or other
  misc_feature (419)..(419): n is a, c, t, g, unknown, or other
ctccccgcggtggcggccgctctagaactagtggatcccccgggctgcaggaattcgtctcacccctagaaaaatctcctcccgatccatccgagcccaaaccctagtccagccagatctccaccgccgccggcgagagcacggcatcagatccgccgcgatggcgttccgccgcatcttatccacagcggtgcgccgccgctcggccatcgccgcggcagcgtccgggaacgcgcgcgaggcctccacggccgtcgccgcggcgcccggcgtgctagcccccgacgcgaccccggtgcgcgctcccgtgatgccgtacgatcgcatcgccgaagccgttaacgccaggctccgggcggcttgagcacccagaaccggcgctttcctccgctatgcaancccccntttccgtccccacncccgaaccacaaggggccatttccttggcgggcggcccgggagaccccggggggtcacccacccgctgccccccaacggggcccgggcgccggtggggcccaccgggaagttgggttccccttttggccggggggagggaaaagggggctttacccgggtgggggggttggttttttgtgggaattctcaaaagcgcgggggggcccccgcagggggttccccaaaaaaaaaaccgagagggaaggggcggggggccccgggggggtcttccccgcccatatttttttgtggcgcgaaggacaaccaatgggttggttttccaaggggggggccccacgggggggaaaaaaaccgttttgacgcccccccgcgcccccaaacctttggtgggccccgggggggaaaattttttgggggggaacacttgggggtggggggggggcgcccacccctcaaaaagagggtttttttaacacacctttccgggggggaggagaaaaaat

SEQ ID NO: 94432 - DNA, 1271 bp, Zea mays
  misc_feature: Ceres CLONE 1584233
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (1060)..(1060): n is a, c, t, g, unknown, or other
  misc_feature (1159)..(1159): n is a, c, t, g, unknown, or other
gagggggtgggtcgctcgcgggtgtagaggagtttgtgtattgtagggtgtaggatttgatcannnnnnnaacaagctggagctccccgcggtggcggccgctctagactagtggatcccccgggctgcaggaattcgtctcacccctagaaaaaccaccaccactcgcaagtctcttcgccgtctcgccgagttattagaaggcggggaaaaaaatcaactcgaacgggcgggtggcaaccaaccaccaagcggcgagggcgatggcggcgtccccgccgcggaagcggctccctgatgcgcgcctcatcgtcgccctccattctccggaatgaccttccgatggctgccagaagggacatccggggtcggattgaaatgggggattaaaggttgccctttcagttcctgggggaacgtggctacttaatttttggcctagggtaaggtttggaatgggtacatatcaatgaaagaacgtgttcacgacaagcagccgttgtaaacaaaggtgtccccaccctcggttcatatgagccggtcgggtagagagggcaccccgagggtacgccccaggtgtttcccggtggacgggccgaatgaataaaaacgggcccgccggtggtgcgtttttttttattgataaaaaaaacaaaagaggtgtccttctccgctaaaatcggggagagcggttcagaagaggatatatccgtgtgggtgtgagatacccccgggcctttaggtcaggtggattatacccctcacttgatgccaatgtattgtgtgtgcgacaggagatgtatggtcgcacgaccgttatgattaatcctctttgcgaatcgatgtctatcttacagaaagagtagaaatacattcgtagcttgttgtatgtcgaccgcaatgtacaacattataggactgtaagcggtggaggtagatctcgtgtcgatcgctagtgccgtatattctcggtgtgtcaagcaatacttgatgttgtttggtgtgaggtgtggggaacacccactctgtatatgtaacactgtacgtaattaagacatanatcagtgggtcgggcgcccccctctcgtaagacggttttgttgtgcgctacggccgcggggtggagggtgttcgaaagtccgcgtctctgcttgtctcntgccgtccccgtttctctctacactataatatagcaacacggcgtcctcctttctactcgaatatcctcatgctatatattatttaaagacgtttttgtgggtggggtgtaa

SEQ ID NO: 94433 - DNA, 1062 bp, Zea mays
  misc_feature: Ceres CLONE 1584235
  misc_feature: Encodes the peptide sequence at SEQ ID NO. 94434
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (24)..(24): n is a, c, t, g, unknown, or other
  misc_feature (26)..(26): n is a, c, t, g, unknown, or other
  misc_feature (68)..(68): n is a, c, t, g, unknown, or other
  misc_feature (91)..(91): n is a, c, t, g, unknown, or other
  misc_feature (92)..(92): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (107)..(107): n is a, c, t, g, unknown, or other
  misc_feature (108)..(108): n is a, c, t, g, unknown, or other
  misc_feature (133)..(133): n is a, c, t, g, unknown, or other
  misc_feature (140)..(140): n is a, c, t, g, unknown, or other
  misc_feature (158)..(158): n is a, c, t, g, unknown, or other
  misc_feature (166)..(166): n is a, c, t, g, unknown, or other
  misc_feature (679)..(679): n is a, c, t, g, unknown, or other
  misc_feature (695)..(695): n is a, c, t, g, unknown, or other
  misc_feature (696)..(696): n is a, c, t, g, unknown, or other
gctgttttttcnccccnnnncncncnccccccccacacggcacaggcgcgacgacaaagcaaaaaaancacacaacacccggaaaatctannactcccnnnnnnggnncaaaaactggaagcttcacctcggntggcgangccgctctagaaactagntggaatcnccccgaggctgcaggaattcgtctcacccctagaaaaaactccccaagcgtcacaccgaaatcactacagtcgagctcgagcaggaacaatccttgagcgccttcctccccggtcctcagtatctattccacacctcatggcgccggcgctgagcaggaccctgggcccgtcgtctgtggccgcgctgcgcccgagcccgtcgtgccggggtctgctacgggccgcgctcttgccgcagggaaggggcccctcgccaggtgcccggaaggggtgaaaaaggaaggaccccagccaaaaaaaaatgcccgggttaaagttggaaccccccccttccctaaagaaccccgcccgcccaagaagaaaacccccccgggttggttttttgtggccccccccccccgaagggttaccccccttttaaagggaaattaaaaatggggaaccacccgtttttttttccccccccccccaagggaaagattttttttttaacacgccccccccctcccccnaaaaaaaaaaaggggnnaaattggaaaagagaccacccggggaaaaaaaaaaaggggggagaaatttcctccccaccaccggggaaaaaaaaaaaaaataactcttttatatgtgtttatagactctataaattggggggggggaaaaatcatcttccaaaaatatatagggagggtgtaaaaaccccccccccccccttctatataggggggggggggggaaaaaaaaacacttttttctccaaaaaaaaacagcgggggcggtttggtggggagaatccccacaaaaaaataagagggcgccccacaaaaaaaactccttcctttgtaaagacaaactttgtgcgcaaaaaagagtgggcgccccccccaccataattttt

SEQ ID NO: 94434 - protein, 45 aa, Zea mays
  misc_feature: Ceres CLONE 1584235
MAPALSRTLGPSSVAALRPSPSCRGLLRAALLPQGRGPSPGARKG

SEQ ID NO: 94435 - DNA, 801 bp, Zea mays
  misc_feature: Ceres CLONE 1584237
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
ctccccgcggtggcggccgctctagaactagtggatcccccgggctgcaggaattcgtctcacccctagaaaaaactgggcaatggcagcagtcgcagaaagagaggacgactgaggagcagcgatccagcggctgcagctcttcctccctgccctgaagctgaagctgctgagaataaatgccctctccttccctccctccctccctccatctccatgagttgagcagcctgagcagatgaggtgaagtgagttggctgccagcgcgtgctgtatcttgtatggctgtactgtatcccccctcctctcgctaaccctttgtctccttcccccacaaaaccacctccgccccctcctcccaccagtacctgtgagttgtgagctccttgctgcggctgcttgctcccctcatctctagcctgtacactggttggagtggttgccagtgttctccccacctgctcctctcgatccactccatcccctttggccatgggtgtgcaagcatacatctacggtaattgcatgcttctcctgccttgaagcggaagccttagccttagcctgccgcctgggggaaaccttctgtttcgccgctgccgctgctgtggtataaaggtggaaggctgatccgtcgacggacggagtcccggcggagggaagattgctccgtcgccgcggtttcgcggcagctcgacggcgaatgccactcatggtgctaagaccgagannnnnnnnnnnnnnnnnnnnnnnnnnnnnnnnnnnnnnnnnnnnnnnnnnnnnnnnnnnnnnnnnnnnnnt

SEQ ID NO: 94436 - DNA, 862 bp, Zea mays
  misc_feature: Ceres CLONE 1584238
  misc_feature: Encodes the peptide sequence at SEQ ID NO. 94437
aaagctggagctccccgcggtggcggccgctctagaactagtggatcccccgggctgcaggaattcgtctcacccctagaaaaagttccgctcgctcgcccgccaccgagagactacactctacgtgtgtgcctgcgagagcgagagcgcaccagcagccagcttcctctgcgcgcggcctgctggtcgcttcgcttcgctccagtccagggcggcacatggcggggggcgggggcggccgggacctcccgtcgacgccgacgtgggcggtggccctggtgtgcgccgtcatcgtgctcgtctccgtcgccatggagcacggcctccacaagctcggccactggttccatacgcggcagaagaaggccatgcgggaggccctggagaagatcaaagcagagttgatgctgatgggcttcatctcgctgctcctcgccgtggggcagacgcccatctccaagatatgcatcccggccaaggctggcagcatcatgctgccgtgcaagccgccgaaagccgccgccgccgacgacgacgacaagagcgacggccgccggagactcctctggtacccgccgtaccctggatacgatgagcccggccaccaccgccgtttcctcgccggcgcggctccggacgacaactactgcagtgaccaagtgaggccgcgccccggccaccattccaattgcgcgacgcgtgctcggtgcgagtgcgatggcgatgatgggtaacgctgcttctttgtttgtttcccgcgtgcagggcaaggtgtccctcatctcctcgggcggcgtcaccagctgcacatcttcatcttcgtgctcgcggtggtccatatcgtctacagcgtcgccacctg

SEQ ID NO: 94437 - protein, 171 aa, Zea mays
  misc_feature: Ceres CLONE 1584238
  misc_feature (5)..(163): Pfam Name: Mlo Pfam Description: Mlo family
MAGGGGGRDLPSTPTWAVALVCAVIVLVSVAMEHGLHKLGHWFHTRQKKAMREALEKIKAELMLMGFISLLLAVGQTPISKICIPAKAGSIMLPCKPPKAAAADDDDKSDGRRRLLWYPPYPGYDEPGHHRRFLAGAAPDDNYCSDQVRPRPGHHSNCATRARCECDGDDG

SEQ ID NO: 94438 - DNA, 861 bp, Zea mays
  misc_feature: Ceres CLONE 1584239
  misc_feature: Encodes the peptide sequence at SEQ ID NO. 94439
  misc_feature (847)..(847): n is a, c, t, g, unknown, or other
tccccgcggtggcggccgctctagactagtggatcccccgggctgcaggaattcgtctcacccctagaaaaaagaatcctgcctttccaactccaagggggagttgccattcctgtcatccggtgtggcctttgggagagggagagagaaggaaggggaggcttcttccgttccggcagcggctccctccgctttcggttctttgcaagatcgagcgagcgcaatcatcgatcgctgccatcatcaccaggcaagcatggcattagcggatggagaggcggattattcttcttgggacagtgacgacgagtaccagaaattcatccaaaacatgaaccctccaagggtcaccatcgacaacacatcatgtccaaatgctacagtcatccatgtggacaccccccaccaccatgggatactgttggaggtagtgcaggtcctcaccgacctcaagctcatagtcaagaaggcatacatatcctcagacggggggatggttcatggacctcttccctgtgacgaaacccaagtgggccccaagattacggacgaatctgttgctggccaggaataaaaaaactcccttttccaagttctatcgggggccgaactccctggcttccttcccctcgccgggaaggaaaaacccgttcgggggtgggaggccggtcctcccaacccccaccctggattataagcttaaggggggaaccgaacagggccgggcccctcctttttcggaagggggaaagccccggttgcttcaccaagccctgggaactggcaacctgtgtggatgcccccggacctttggggacgccccaatagggggaaaaacccccggcgncgtagatgcagggg

SEQ ID NO: 94439 - protein, 105 aa, Zea mays
  misc_feature: Ceres CLONE 1584239
  misc_feature: SWISSPROT Homolog: EC 2.7.7.59 [Protein-PII] uridylyltransferase
MALADGEADYSSWDSDDEYQKFIQNMNPPRVTIDNTSCPNATVIHVDTPHHHGILLEVVQVLTDLKLIVKKAYISSDGGMVHGPLPCDETQVGPKITDESVAGQE

SEQ ID NO: 94440 - DNA, 875 bp, Zea mays
  misc_feature: Ceres CLONE 1584240
ctggagctccccgcggtggcggccgctctagaactagtggatcccccgggctgcaggaattcgtctcacccctagaaaaaactgggcaatggcagcagtcgcagaaagagaggacgactgaggagcagcgatccagcggctgcagctcttcctccctgccctgaagctgaagctgctgagaataaatgccctctccttccctccctccctccctccatctccatgagttgagcagcctgagcagatgaggtgaagtgagttggctgccagcgcgtgctgtatcttgtatggctgtactgtatcccccctcctctcgctaaccctttgtctccttcccccacaaaatcacctccgccccctcctcccaccagtacctgtgagttgtgagctctttgctgcggctgcttgctcccctcatctctagcctgtacactggtttggagtggtttgcagtgttctccccaactgctcctctcgatccactccatccccctttggccaggggggtgcaagcctacctcttacggaaatgcatgcttcctccgtccttggaaccggaagcccttaccctttagcctgccggcctgggggaaaactttctggtttccccccctgccccctgctgggggtataaaaggggggaaagggctgaataccgcccaaacgggaaggaattccccgggggggaaggggaaaaaattgtcccccccctccccccccggtgttttccccgggggcccaaaaaaagggtggggccccctccccccgggggggaaaaaaaagggggcccggggggcccaggggcccccccctaaaaaaaagaaatatttttgtgtggcctccaaaaaacccaaataattccccctcctcctcct

SEQ ID NO: 94441 - DNA, 865 bp, Zea mays
  misc_feature: Ceres CLONE 1584242
  misc_feature: Translation starting site: 185
  misc_feature: SWISSPROT Homolog: EC 2.4.1.207 Xyloglucan:xyloglucosyl transferase
  misc_feature (686)..(686): n is a, c, t, g, unknown, or other
  misc_feature (836)..(836): n is a, c, t, g, unknown, or other
ctccccgcggtggcggccgctctagaactagtggatcccccgggctgcaggaattcgtctcacccctagaaaaacaggagcttcatccaacagcccaagtgtccctgctacccccactggatcagcaagctagctacccaggccagtgccagagccacagcggaagctagctagctagcaagcaatggctgcggcggctcctcctgctcgtcctagcagcagctgctgccgctgcatctcgcggcgcgccgccgtcgtcgtgccggcactgctgctgctggcggcgatggccgcctcctccggcgacgcgcagccttccccggggtactacccgagctccaggttcaggccggtgccgttcaaccgagcgtacaccaacaagtggggcccgcagcaccagacgctctccggcgaccattccgccctcaccatctggctcgacaagacctgcgggagtggtttcaagtcgaagcacgcgtacaggaacggctacttctccactcgcatcaagctccccgccggatacaccgccggcaccaacaccgccttctatctctccaacaacgaggcgcaccctggtttccacgacgagatcgacatggagttcctgggcaccatcccgggggagccctacacgctgcagacgaacgtgtacgtgcgcggcagcggcgacgggcgcatcgtgnggcgggagatgcggttccacctctggttcgacccacggcggcctaccacacctacgccatcctgtggaaccccgacgccatcaccttcttcgtggacgacgtgcccgtccgccgctacgagcgccgcaccgagctcaccttcccggacgnccccatgtgggtctacgggctcatctggg

SEQ ID NO: 94442 - DNA, 834 bp, Zea mays
  misc_feature: Ceres CLONE 1584246
  misc_feature: Encodes the peptide sequence at SEQ ID NO. 94443
  misc_feature (752)..(752): n is a, c, t, g, unknown, or other
  misc_feature (774)..(774): n is a, c, t, g, unknown, or other
  misc_feature (834)..(834): n is a, c, t, g, unknown, or other
ctggagctcaccgcggtggcggccgctctagaactagtggatcccccgggctgcaggaattcgtctcacccctagaaaaaagagccaccgtttgatcagcgaccgggcaagagcaggccgcggccggccaccccgcccgtctctgtccgaccccgcaccagcgactcgccgagcgcaggcacaagaggggggctccatccatgaggcagccatgctggtgctcatcaacaggtatttcaggagcaggaacagcagcccggccggaggaggcggcgaagagatggcgccggcggcggtctccagcgaccacctctgtttgccgggctgcgtgcccgtgcgcgccaagcgggcctcctcctccgccgccgccgcggccacggccaccacggcgcgggcgtcgcggcacaacttcgtcagggccgcggcgtcgggcctgctggcgggggcgcacttcaccaaccacgagtcgctgccgccgcttccccacgcgtacgccgagttcgtcgcggcgttcccgcagtacgcccacggcgcgctggcgcgggcggacgcgatccggggcgaggagtaccagcacctggaccgccacgtgtgcctggactacaccggcatcaacctcttctcgcacgcgcagatgagcgcctccctgccgtccacctcctccgcgccgcccgcctggcagccgcccttcttcgacatcgcgtacaagtccacgagcctgcgcgcgcaggtgcaatgcggggacaacgccncgggcgcggaaggcgggcgtcngcgccgccgtcacccggcgcatcatggcgtcgctcaagatccccggggacgagtacgccn

SEQ ID NO: 94443 - protein, 207 aa, Zea mays
  misc_feature: Ceres CLONE 1584246
  misc_feature (181)..(181): Xaa is any aa, unknown, or other
  misc_feature (188)..(188): Xaa is any aa, unknown, or other
MLVLINRYFRSRNSSPAGGGGEEMAPAAVSSDHLCLPGCVPVRAKRASSSAAAAATATTARASRHNFVRAAASGLLAGAHFTNHESLPPLPHAYAEFVAAFPQYAHGALARADAIRGEEYQHLDRHVCLDYTGINLFSHAQMSASLPSTSSAPPAWQPPFFDIAYKSTSLRAQVQCGDNAXGAEGGRXRRRHPAHHGVAQDPRGRVR

SEQ ID NO: 94444 - DNA, 1263 bp, Zea mays
  misc_feature: Ceres CLONE 1584251
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (13)..(13): n is a, c, t, g, unknown, or other
  misc_feature (14)..(14): n is a, c, t, g, unknown, or other
  misc_feature (52)..(52): n is a, c, t, g, unknown, or other
  misc_feature (61)..(61): n is a, c, t, g, unknown, or other
  misc_feature (63)..(63): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (979)..(979): n is a, c, t, g, unknown, or other
  misc_feature (1118)..(1118): n is a, c, t, g, unknown, or other
nnnnttttttttnnttttgctacactaaacttcccccccccccaccaacatntgggggttntntttnnnnnnnnnaaagctggagctcaccgcggtggcggccgctctagaactagtggatcccccgggctgcaggaattcgtctcacccctagaaaaactcctccctttctgcttcctgggatcctctctgcctccccgcgccgatctcgagcacctggggagaccgcgagacgtgcgcctgatttttctcatcgcagcagccctcaagttccccacctcttttttcttggcactttcaattaatcctgggtatttaagctacaacctctattttacctgtcatgttacccttaacacggtttgaggtcgcctggaggctgctcgcgggtgccggggcgaaatagccgtcatctcgactcctcgctatcacgggcgcacgctttccccccccccccccagccctggggggtcgccgcctcccccccaagcaacgaaacacaatcgtgagttctacggaacgcggccccccctttctctgcggcagggcaacgagtaacctttcattcatcgtggcgctgccattacaggaactgctgacataaacgacgttctctcatactatagtccctcctctcgcgtgccatccgtatatccagaacaactcccaccctactgccagaaacaatctaaagtatattatttagcccgctacctcaccacgtccagctccaccagcgattaccaaagtgttagtcggcttctccacttccaacaacaatcagccctctactgagtatcggcgctcaccctgcataccatcaatagtagactaccgcgcagacccatctactctcgctcgagacaccgagaaagcgcaccacccaacaagtcgacagggcgagactcccgccgtggttagccgcggcggcacactctcgctagagtaatcaacctcataatatcacgtcaatgttcantctaactaatcctcgctaacatattctaccgtgcacttgtacacatatcgcaacaacggactctacgtagtacctactggcactgagcggacgacattcacagaatccacaaggccgatacacatctgatacgcgacanagcgatggcacgagggcgatcgacaccgtggcgctagtgtctctacaagacactgcacgcatactccagagccgacgcgagaacacatatatgatacaacattcataccaacgcacgcaggatcgataggacgtgtataattaaa

SEQ ID NO: 94445 - DNA, 1113 bp, Zea mays
  misc_feature: Ceres CLONE 1584253
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (46)..(46): n is a, c, t, g, unknown, or other
  misc_feature (70)..(70): n is a, c, t, g, unknown, or other
  misc_feature (71)..(71): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (100)..(100): n is a, c, t, g, unknown, or other
  misc_feature (1113)..(1113): n is a, c, t, g, unknown, or other
ttttttttttntnnntnaattgtactttcccatctcaccctccccntaaaatataaaagatgtgtttgtnnccccccannnnaaaaggtgggactccccncggtggcggccgctctagactagtggatcccccgggctgcaggaattcgtctcacccctagaaaaactcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttacctttaatctgtttagttccattgcatcttctcgcggttgcgggtagtattgcagtttcttgccccctgtgtcttgttcttttgcttctaaccctggacccagggagcctagctccactctccttctgagaaaaaatcacactggcgggaaggggcgcggcccccctccttttatggaaggggggggctcgccccctcaaacaccgaacacctgaaacccagggatcgcgcccaacccccgccccgcccaaactgtgtaccgggcgcataagggtttgacatcccccccaaccacaggtacgggcccacaaggggaatatagtggataaagctaccggcccctaaaattagccgcatctcctggggagccccccccttggaggggtgcagtctaactgactagaggatcacgccccttatgtgggtaagaatcgcacggctacccacatccttcagacgagaaacgctgaatgcctccccttcgaacggaacgggaactcctctcccgcaacagaaagaaaatgtaatctcttcctaaattcgctgtccacgaccgccgtaaagatgtatacctgtctacgggcgcatacaaaagacacccccaccccagtccctcttgtacatataatatacctctgcttcgggatcacacaacaatagctcattagtacctcttacccaatactgtcaacaatctagataatgactcaacactgctcacaaacaaactataccttcacgtgcgccgagacgcgaagaan

SEQ ID NO: 94446 - DNA, 825 bp, Zea mays
  misc_feature: Ceres CLONE 1584255
  misc_feature: Encodes the peptide sequence at SEQ ID NO. 94447
ctggagctccccgcggtggcggccgctctacaactagtggatcccccgggctgcaggagttcgtctcacccctagaaaaacactgagaaccgcagagacgggcgtcttcatactcgccgatctccgcgactcgcagctttccccaatatcccccccttcacgcatttctcaccaccgccgccgctccccccgttcgacaacaccatgagggagtgcatctcgatccacatcggccaggctggtatacaggtcggaaacgcgtgctgggagctgtactgcctcaagcatgggattcaagctgatgggcagatgcccggcgacaagaccatagggggaggtgatgatgcatgcgagaccttcttcagcgagactggcgctgggaagcacgtcccccgcggtgtatttgatgaccttgagccctctgtcctcgatgaggtgaggactggcacctacagacagctcttgcatcgtgatgagctcatccctggggaggaggatgcagccgactgcttcgcgcgtggtcactgcaccattggcaaggagataggcgacctgtgcctggaccgcgacatgaacgttgcagataatgtgcactggactgcagaggttcatagtggtaacgctgtatggtggaggcacgagctctgggcttggttctctcctccaggagcggctgaacaggtgactatggcaagaagtgcatgcgtggtgtcaccgcgtacctatgcgccgcagtagtcacatccgagaggcagtcgtacgacagtgtacatgtcaacctgtctatgctgcagcattatgatgtaagctgcctgctctacaagc

SEQ ID NO: 94447 - protein, 177 aa, Zea mays
  misc_feature: Ceres CLONE 1584255
MRECISIHIGQAGIQVGNACWELYCLKHGIQADGQMPGDKTIGGGDDACETFFSETGAGKHVPRGVFDDLEPSVLDEVRTGTYRQLLHRDELIPGEEDAADCFARGHCTIGKEIGDLCLDRDMNVADNVHWTAEVHSGNAVWWRHELWAWFSPPGAAEQVTMARSACVVSPRTYAPQ

SEQ ID NO: 94448 - DNA, 982 bp, Zea mays
  misc_feature: Ceres CLONE 1584257
  misc_feature (1)..(1): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (52)..(52): n is a, c, t, g, unknown, or other
ntttttttttttaacacnnntaaatacccaagataaacaatccaaacaccangcctaaacgattcacaagtctgcatttagctggagctcccctcggtggcggccgctctagaactagtggatcccccgggctgcaggaattcgtctcacccctagaaaaaagcgatgcccatcgacgacttgtcttcttgattcttgaagagatgaagctgcttttgcaccacatgacgaggatgtcttgcttctgcgcgatcaacgcggcagctgcggctcaagctgcccgtgccggcagaagtaccctgacctgcatgagaccagcaacatcgcgcacgccaccgtcttcctcggcttgtccccggagaacaacgccgcccccgagctcgccaaggcctctgcagaatcaggcaaggccgcccacacctgcggctgctgcagcagctgcaagtgcgacccctgctactgctgatcacatctatccactaccatgggatatgatcactatctatctaactgcgcgtgggtggttgaaaaataataatcgaggcctatctggccgccatacataagtattgcgagctgtgtcacaaacagagagaaagcgacttcttcacttagcaatctctctcacagcaggtttgtgtactcactaagggcgaatagtccatgtgtctacataggatgattgccaagataccttctgccccttgcagggttccatcccgcggtttaaactaaagcaaccggcagaaccttattgccttggaagctgaataaccctggctccttaatcaaaggacctgggttggcttacacattcagatcctccaaccggggggcccagggattctcttgtcggtcttcggcattccagcaattcccctacaaaaaaacccctttttccgggccaataccttaaggtcgggcgtcaattatatttttcccccctatccccttgtgggctataatccggtccttttgattt

SEQ ID NO: 94449 - DNA, 884 bp, Zea mays
  misc_feature: Ceres CLONE 1584258
  misc_feature: Encodes the peptide sequence at SEQ ID NO. 94450
tggagctcaccgcggtggcggccgctctagaactagtggatcccccgggctgcaggaattcgtctcacccctagaaaaactctcacctctctcgaaactttccccaatcccatctcctgccccccctctcccaaccctatccacgccgccgccagccctgctcgggtggtgcgcatacatgaaccatccgtcctcgtcgtcgtcctccgcccagccgccgccagccccggcggtggcggccgaggccacctccctcgcgccgggcttccgcttccaccccaccgatgaggagctcgtctcctactacctcaagcgcaaggtcctcggccgcccgctcaaggttgatgccatcgccgatgtggacctttacaagctcgagccctgggacctgcccgcccgctcccgcctccgctcccgcgactcccagtgggatttcttcagccgcctcgaccgcaagcacgccaaccgcgcccgcaccaaccgcgccacgtcgggagggtactggaagaccaccgggaaggacagggaggtgcgccatgggcccagacttgtcgggatgaagaagacgctcgtcttccacgcgggacgcgcccccaagggcgaacgcaccaactgggtcatgcacgaataccgccttcaagggcgatgacgccgcagggataccgcaagaactcatttgagggtggggccggatcttccagaaaagctggacccaggtccctcagaatggccgcaaaactatggaagcgccctttcgtttggaggaagaaatggggacgggagggatttaccacgacattcgaggggttttgcccatttcaaagaggaaagggggggctcaggctattttgaacaggaacactcctgcgaggtttcaccccctt

SEQ ID NO: 94450 - protein, 156 aa, Zea mays
  misc_feature: Ceres CLONE 1584258
  misc_feature (26)..(154): Pfam Name: NAM Pfam Description: No apical meristem (NAM) protein
MNHPSSSSSSAQPPPAPAVAAEATSLAPGFRFHPTDEELVSYYLKRKVLGRPLKVDAIADVDLYKLEPWDLPARSRLRSRDSQWDFFSRLDRKHANRARTNRATSGGYWKTTGKDREVRHGPRLVGMKKTLVFHAGRAPKGERTNWVMHEYRLQGR

SEQ ID NO: 94451 - DNA, 796 bp, Zea mays
  misc_feature: Ceres CLONE 1584261
  misc_feature: Encodes the peptide sequence at SEQ ID NO. 94452
ggagctcaccgcggtggcggccgctctagaactagtggatcccccgggctgcaggaattcgtctcacccctagaaaaagtggtcggcgagcatggaggaggcggaggcggctcacgggctctgattggcggatggcgcgtcggatcggagcagtcgagcttcggggatttcctgtccctctggaagggatgaaatgcggcgactacctggtgaactgggtggagctctagtgtcagccagtgttcctgctgacgcctgcctcatctagcccccccccttcgttcagttcttgtggcgagttgttaatccaccgtgtccgggatccgtttggcctggggttttgaggagatggacgacgaggactactcgtgggtgcggcgcaccaggttctcgcagtccatcgtcagatccagctctggcagggagcagtatggcgcgttcatcgagcagttcagccgtggcgccgagctgaggcagaatgggttgggcacagggtacaggaaccctcgccagagtttacagcccttggcgaagggatccggggtctccaactctgcaaggctgccgattcccaaggcgaagtcagcagttgctcagtcggaacggaagctgaagcatgcgtcttctgaaggccaattgaacagagacggtgatcgcccgtttgcagaatcatcgggcgaaccagagccggaaaaggggccggccgggcctggagtctgggactttccgccagctgccatgtgggttcgggcccttcccaaggaagaggccccaaacgccgcctgtggatttctta

SEQ ID NO: 94452 - protein, 149 aa, Zea mays
  misc_feature: Ceres CLONE 1584261
MDDEDYSWVRRTRFSQSIVRSSSGREQYGAFIEQFSRGAELRQNGLGTGYRNPRQSLQPLAKGSGVSNSARLPIPKAKSAVAQSERKLKHASSEGQLNRDGDRPFAESSGEPEPEKGPAGPGVWDFPPAAMWVRALPKEEAPNAACGFL

SEQ ID NO: 94453 - DNA, 834 bp, Zea mays
  misc_feature: Ceres CLONE 1584266
  misc_feature: Encodes the peptide sequence at SEQ ID NO. 94454
ggagctccccgcggtggcggccgctctagaactagtggatcccccgggctgcaggaattcgtctcacccctagaaaaagaccagtgtgcctgccatccggctgctaaacgagccgagccggtgagggttgtccttcctttcttccccactacaacatctgtcaccgtgaaatctcggctacctcctgacttctggtacctcgccgccggggacccaactccgacccccaccccaccataccaaagccaccgcggctgcggcttccgcatcatcaatggtgctgatcactctcgtccgcgactacatcgaccgcatgctccacgacatcccgggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcaaggccgtctacttcctccgaccctccgctaacaacgtccagaagctccgcaggcacctcgccatgccgcgcttcgccgagtaccacctattcttctccagtatatttgaggtcccgcagattcaaatacttgctgactctgatgaacaagaggttgtgcagcaagttcaggagttccatgctgatttttgtgccatttgaccataccatttcactctcaacatacaaaatacccacatgtatatgctcccaacaaggggccgacccttcctgggatccaaggctttctggaatcaaaccgttgataggcattgcttccggtcctcctgggctttaaaaccgcccccctgggtattaac

SEQ ID NO: 94454 - protein, 133 aa, Zea mays
  misc_feature: Ceres CLONE 1584266
MVLITLVRDYIDRMLHDIPGMKVLVLDPQTVGMVSVVYSQSDLLRKEVFLVETMDNASSSRESMAHLKAVYFLRPSANNVQKLRRHLAMPRFAEYHLFFSSIFEVPQIQILADSDEQEVVQQVQEFHADFCAI

SEQ ID NO: 94455 - DNA, 2052 bp, Zea mays
  misc_feature: Ceres CLONE 1584267
  misc_feature: Encodes the peptide sequence at SEQ ID NO. 94456
aaatctccggaagaaggggaagcaagcatcagaaatcctaaataggggggcgcaccaagaactccactgagaatccccaatcatttctcggtgcatttggccccgctccaccatcaccgaaatctccaagaaaactcatcccgaatccgcccccgcccccaaatcggccctacaccgcaccagatcacagctcataattccagtgagaattcggaaaggaggggagcaatgacggaggtggcgctcctccggggcccgaccaacctcgcttccaccgcaagccgcgcccccgcctccccctccccctccccctcctcctcttcgctgcggtatttagccaatgccgacagcgacgtgctccaaggaagcggcagcccggagcgcactgcgggatctgcggggagccgacgactccttgaactgcgcggacaagaggcggcggaggaggaagaggagcggtggtccttcttggcgctgctctttgagctactgcggaagtcgttgctcgggtgcaggaccgtgggcggcggcgaaggcgaacacggcggctgcgggatggagattgggttgcccacggacgtgcagcacgtggcgcacgtcacgttcgataggttccacggattcctaggcctgcccgttgaattcgagcccgaagtgccccgccgtgctcccagtgccagtgcaagtgtcttcggtgtttcaacagaatcaatgcagtgttcctatgattcccgaggaaacagtgtcccaacaatccttttgatgatgcagagacgcctttatgaacagggtggccttcaggcagaaggtatcttccgtataaatgcagaaaatagccaggaagagtttgtgagagaccaactaaatagtggaattgttccagatggcattgatgtccactgtttggcaggtctaattaaagcctggtttagagaaatgccgaggggcgtactggaccctatcccacctgaacaggtgatgcaatgccaatctgaagaggactgtgctcgcgtagcgaaatgccttccaccagctgaagcagctttgcttgactgggctgtgaatctgatggccgacgtagtccaagaagaacagataaacaagatgaacgatcgcaatattgctatggttttcgcaccaaatatgactcagatggcagatcctttgactgcactgatgtatgcagtccaagtgatgaattttctcaagatgctggtacaaaagaccctcaaggatagagaggagtcgaccccagaggatgctttgctgccccagaaggacccatctgatgaaaacaggcatcagaaacccaccgtgacaattgactctctcctcgaggaaggatccaggcgcccttctttcgccaaggaagagcccctcctgaacagccctggccacagcactgatgacaagtctaacgaaactaacaccgatttaggagccactgctgctttcactgcccagacaagcgaggtagcaacgggtgtggaggactccactagtagtggctcacagcctgcacctgctggcccagctgctatcgctgatgcttccggcacgacagccacaaattctctccaggcaggcaaggggagccgaagcctgaaccggaggaggactagaaagggcaagggccagtctggcacgcgcaccacgcctgcagctgagaaatcaagaggtgcgagcatcgtgagccgcataaactccagagttgagcggatcgaagcgtggagatgagaccgaaagccatttccatcgctgttgtgtactagatgatgactgacccagcgtttcctgaaaatagcaccccccgaactgcttgcttgcacattttacatttttctctctctctctatgcgcttatcatttcttgctgtatcatggccatggtattttgagattcgatcttcctgtctttactaacttctgtatctttcttatggttaattctgtgagtcaatgaaagatgcttgtgctttcctttgtacgttgatctttttgatgcctaatttatcaagtccctgaaagttcaggtgtgaaaaaaaaaaaaaa

SEQ ID NO: 94456 - protein, 502 aa, Zea mays
  misc_feature: Ceres CLONE 1584267
  misc_feature (174)..(311): Pfam Name: RhoGAP Pfam Description: RhoGAP domain
  misc_feature (111)..(157): Pfam Name: PBD Pfam Description: P21-Rho-binding domain
  misc_feature: SWISSPROT Homolog: EC 2.7.11.1 Non-specific serine/threonine protein kinase
MTEVALLRGPTNLASTASRAPASPSPSPSSSSLRYLANADSDVLQGSGSPERTAGSAGSRRLLELRGQEAAEEEEERWSFLALLFELLRKSLLGCRTVGGGEGEHGGCGMEIGLPTDVQHVAHVTFDRFHGFLGLPVEFEPEVPRRAPSASASVFGVSTESMQCSYDSRGNSVPTILLMMQRRLYEQGGLQAEGIFRINAENSQEEFVRDQLNSGIVPDGIDVHCLAGLIKAWFREMPRGVLDPIPPEQVMQCQSEEDCARVAKCLPPAEAALLDWAVNLMADVVQEEQINKMNDRNIAMVFAPNMTQMADPLTALMYAVQVMNFLKMLVQKTLKDREESTPEDALLPQKDPSDENRHQKPTVTIDSLLEEGSRRPSFAKEEPLLNSPGHSTDDKSNETNTDLGATAAFTAQTSEVATGVEDSTSSGSQPAPAGPAAIADASGTTATNSLQAGKGSRSLNRRRTRKGKGQSGTRTTPAAEKSRGASIVSRINSRVERIEAWR

SEQ ID NO: 94457 - DNA, 730 bp, Zea mays
  misc_feature: Ceres CLONE 1584268
  misc_feature (306)..(306): n is a, c, t, g, unknown, or other
ctggagctccccgcggtggcggccgctctagaactagtggatcccccgggctgcaggaattcgtctcacccctagaaaaagcgggtgtcagtgccagcgccagcggagaaaagaaacagagttcgaccggccccgccccgccccccaccgcagcgcccgcgaagccgccaaacaccaccacctatccgccagaagcctcttcctccctcgctctccctcagcggcgcgctgccaatggccgcgtggtgaagcgcacccgacggaagaagcaggcaccaacacccaagccccctggtgccttcgccngtcgctgccccgcgcaagaaattgagatccccgggatttcaagacaggttggctaccaatttcggatttttgattttgggcgccgggagacaccttttcccttaatggggccgcccctcccaattcggcggggccctccggttccccttttctttttccccagggggggtcacacccgggggcggcccccggggggccccgcctttcccctttaaaaaaaaaaacggggggcccctttgggggggggaaaaggcgcccccccccaaaaaaaaaaaaccccccggggggaaacaagttttccccggccgggggggcgttttttttgcccgggggcgcaaaaaaaaacccccgcggggggaagaagaccccccctccggggggcggggggttttataaaaaagagggccgcccccccttgtgaaga

SEQ ID NO: 94458 - DNA, 863 bp, Zea mays
  misc_feature: Ceres CLONE 1584270
  misc_feature: Encodes the peptide sequence at SEQ ID NO. 94459
ggcggccgctctagaactagtggatcccccgggctgcaggaattcgtctcacccctagaaaaagcgggtgtcagtgccagcgccagcggagaaaagaaacagagttcgaccggccccgccccgccccccaccgcagcgcccgcgaagccgccaaacaccaccacctatccgccagaagcctcttcctccctcgctctccctcagcggcgcgctgccaatggccgcgtggtgaagcgcacccgacggaagaagcaggcaccaacacccaagccccctgtgccttcgccgtcgctgcccgcgcaagattgagatcccggattcagacaggtgctaccattcgatttgatttggcgcggagcactttcctatggccgcctccatcgcggcctcgtccttctttccagggtcaccggcgccggccgctcctaagaacggccttggggagcgcccagagagcctggacgtccgcggcgttgcggcgaagccgggagcctcgtcgtctagtgccgtgagggcgggcaagacgcgcgcccacgctgcggttcccaagatgaacggtgggggcaagtccgcggtggcggatggggagcacgaaaccgtaccttcttcggtgccgaagactttctacaaccagcttccccgactggagcatgctcctttgcggccatcaccaacattctttcttgggccgcaaaagaaagcagtggaacgaatgctttgacctgggaagccctaggaagggcctggaaatgcttcacctggacaccgttttgggggtttggggccgggaatcaaaacccaggaatgggggctccaatgttttccagggcaagaaaacctttcttcccaatttaagaggtccc

SEQ ID NO: 94459 - protein, 117 aa, Zea mays
  misc_feature: Ceres CLONE 1584270
MAASIAASSFFPGSPAPAAPKNGLGERPESLDVRGVAAKPGASSSSAVRAGKTRAHAAVPKMNGGGKSAVADGEHETVPSSVPKTFYNQLPRLEHAPLRPSPTFFLGPQKKAVERML

SEQ ID NO: 94460 - DNA, 811 bp, Zea mays
  misc_feature: Ceres CLONE 1584282
  misc_feature: Encodes the peptide sequence at SEQ ID NO. 94461
caaagctggagctccccgcggtggcggccgctctagaactagtggatcccccgggctgcaggaattcgtctcacccctagaaaaaaaattcgcctctccgatccggcacgacaccgccgccgatccccatcgtcacggtagccatgtccaaccccggctcgtcgcccgcctccgctcaccacgaccacgaacacacccctctctgccgctcctgcggggcgcccaccacggcgccgaccccggcaccctggtcagggaccaccgactccccgccgccggcgtaccgccccatccgtctcccagccatcaacgcgcccaccaacacagccgccatagtcctctccccggtcccacagcctctccccgtgcctcccgccgcaccgccccacgccttcctggtccctgccaagcggatcacctcaccggacgacatcgcccgcttccatgcctccgtccacggacttcacttcctcgggttcgtcgccgcgctgtccgcctccgtccacagccgcaagctctcggacccgctaccgtccccgccatcccccggcatagctgcggtgctcgatctcgtctcggctctcgccgctctcgtcgcttccacacctccgcttccacacagctctcggtacggcaaccctgctttccgcctgtggcacgagaagctcaccaactccgccagcgagctgatcctccggataacggcccaccgggtcttcccctgcgggaacctccagggtgcccaatgttcaaactagcacccgtaccctcctccgaattccttgcggaaacgccccaccggcattcgaaa

SEQ ID NO: 94461 - protein, 204 aa, Zea mays
  misc_feature: Ceres CLONE 1584282
  misc_feature: SWISSPROT Homolog: EC 5.2.1.8 Peptidylprolyl isomerase
MSNPGSSPASAHHDHEHTPLCRSCGAPTTAPTPAPWSGTTDSPPPAYRPIRLPAINAPTNTAAIVLSPVPQPLPVPPAAPPHAFLVPAKRITSPDDIARFHASVHGLHFLGFVAALSASVHSRKLSDPLPSPPSPGIAAVLDLVSALAALVASTPPLPHSSRYGNPAFRLWHEKLTNSASELILRITAHRVFPCGNLQGAQCSN

SEQ ID NO: 94462 - DNA, 1088 bp, Zea mays
  misc_feature: Ceres CLONE 1584285
  misc_feature: SWISSPROT Homolog: EC 2.7.11.17 Calcium/calmodulin-dependent protein kinase
  misc_feature (1)..(1): n is a, c, t, g, unknown, or other
  misc_feature (30)..(30): n is a, c, t, g, unknown, or other
  misc_feature (32)..(32): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (977)..(977): n is a, c, t, g, unknown, or other
ntttaatttttttgtgtgtgggtgtttgtnanaataacaaaaaggaatatatatattattatattgtttttnnntttttttttttttcaaaactggagctccccgcggtggcggccgctctagaactagtggatcccccgggctgcaggaattcgtctcacccctagaaaaagttcccaatcctcacactgattgtggccttccagttcttgtggtctctcaaccagcatctgatacccaattcctcgcacaaacctgccacacgcaatgtccaagaccgagagcaggaagctgtcggacgactatgaggtcgcggatgtcctcggccgaggcggattctcgatcgtgaggcggggagtgagcaagtcagaggggaaagcggctcaacaagtcgccataaagaccctgcgaaagctggggcccgccaccacgaccgggcgggagcacgctgccccccccagcaagggttcaaaaaaaaaggcggcgggcctgggttcccaacgtggaaaaaaaggtggtcgttccattttcccaaaaaagcttgcttcaccataaaaagaaacctccgttggatgccggccggaatcctatgggaaaaacaccttggggtttccccaaacccccaaaaaagttattttcttcgccctgtgtcccaaaaaagtggttttacaaaaagaaaaaaaccccccccgcggggggggtggtaacccctcccggtgttccccctcgcggaaaaaacctctctctttctcttctccggggcgggggggacaaaaaaaatttttttctccccaccacccaagaaattcttttttggggggggggggtggtaataaccccccaccccaataatatttggggaaagaaatatttaaaaaaatcaccctccaagagaggggggtttcttttcctcccccccaacaaaaaattaactcttcacaccgggggtctttctttgataaaggaccccacccacnaaagaccaggaaagagtggtttttttgtttctcccacggaacctcttcttaatccccaaaaaaaaaaataacctttctttcttctcgaatagagggggaggggggggtccc

SEQ ID NO: 94463 - DNA, 908 bp, Zea mays
  misc_feature: Ceres CLONE 1584288
  misc_feature (161)..(161): n is a, c, t, g, unknown, or other
  misc_feature (266)..(266): n is a, c, t, g, unknown, or other
  misc_feature (269)..(269): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (349)..(349): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (633)..(633): n is a, c, t, g, unknown, or other
  misc_feature (634)..(634): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (650)..(650): n is a, c, t, g, unknown, or other
  misc_feature (652)..(652): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (668)..(668): n is a, c, t, g, unknown, or other
  misc_feature (767)..(767): n is a, c, t, g, unknown, or other
  misc_feature (792)..(792): n is a, c, t, g, unknown, or other
  misc_feature (844)..(844): n is a, c, t, g, unknown, or other
  misc_feature (849)..(849): n is a, c, t, g, unknown, or other
  misc_feature (857)..(857): n is a, c, t, g, unknown, or other
  misc_feature (858)..(858): n is a, c, t, g, unknown, or other
  misc_feature (865)..(865): n is a, c, t, g, unknown, or other
tccccgcggtggcggccgctctagaactagtggatcccccgggctgcaggattcgtctcacccctagaaaaaattcgataaccagaacataacctattggttggggacgcgtatcccacgcctgcacgcaacctcattctccgtcctccagatccaagggnaatggccgtcctccttgagaccttgcctccccgagtgctctcggtgagctactttgtttcgatttatcaggaaatccgtttgcttcatgttgtgcaggctccaantantcccccgggnnnaaaatattgggcggggaaaatttccgggggggaacaaaaaaaaaaaacccccccccctggtgttgggntggataaaaaaaatatcaccccccccccccgcacatataagggtggggatgtggttgtatctgcttatctatgcgccggaggggtagtgtttggtgtgggtgggttgtttctgggggatatgtttaaatggggggcgcccccccaccctctccctcctatcacctttcgtcccctttctccctctcccccccaaaaggggaggagggggggccccccccccctcgcgccgttgtgggggacttttttttttgttgttttttnnnnnncaagggttagtagggtnnttaagtgggannnggngnaagaaannnnnnnnanaaaaaacaaaacacacatacttctcctcccccccgccccgagggggggggggggcgcgggagataaatactatcacccttctttttctttttttgttgncgccgcagtccggcccagcgtaccnctttagttgggttggagaagaaaaaaaaaaaaataaaaaaaacaccctccanctggncgccggcnnctggccncgagcccttacttgggttttttgcgggggaggagaaagaaaaa

SEQ ID NO: 94464 - DNA, 891 bp, Zea mays
  misc_feature: Ceres CLONE 1584289
  misc_feature: Encodes the peptide sequence at SEQ ID NO. 94465
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (754)..(754): n is a, c, t, g, unknown, or other
  misc_feature (756)..(756): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
aaagctggagctccccgcggtggcggccgctctagaactagtggatcccccgggctgcaggaattcgtctcacccctagaaaaagcttttggctcggcagctaacgacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaaacataatcagtgctactcttcattacataaatttgatgctatatatatatacccccatccctccctnnnnnnnaananannnnnannnnnnnnnnnaaaaggccgaacctccctccccctcctctacattccgggccctatcgccggtcggtttccggcccccgtcctgggttggacccaaaaacccgggaatgcggtcaccttgtgcttttg

SEQ ID NO: 94465 - protein, 128 aa, Zea mays; identical to SEQ ID NO: 77829
  misc_feature: Ceres CLONE 1584289
  misc_feature (32)..(128): Pfam Name: PsbR Pfam Description: Photosystem II 10 kDa polypeptide PsbR

SEQ ID NO: 94466 - DNA, 848 bp, Zea mays
  misc_feature: Ceres CLONE 1584298
  misc_feature: Translation starting site: 154
  misc_feature: SWISSPROT Homolog: EC 3.3.1.1 Adenosylhomocysteinase
ctggagctccccgcggtggcggccgctctagaactagtggatcccccgggctgcaggaattcgtctcacccctagaaaaagtcttctccctcactcccgttccatttccccatctcccagatccaattcgcgagttctccctcctctgccgccatggcgctctctgtggagaagacctcgtctggactggagtacaaggtcaaggatctctcgcaggcggacttcggccgcctcgagattgagctggccgacgtcgaaatgcccggcctcatggcgtgccgcgccgagttcgggccgtccaagcccttcgccggcgctaggatctcggggtctctccacatgaccatccagaccgccgtcctcatcaagaccctcaccgcgctcggcgccgaggtccgctggtgctcctgcaacatcttctccacgcaggaccacgccgaccgccgccatcacgcgcgactcggccgccgtgttcgcctggaagggggagaccctctacgagtactggtggtgcaccgagcgctgcctcgactggggcgaggcgggcggccccgacctcatcgacgacgacagcggcgacaccacgctgctcatccacgatggtgtcaaggccgacgacgaatacgagaagacctgcaagatcctcgacccgtagtccaccaataactctgaagtcaagatagtgctcagcatcatacgcgacgggctccaggctgagtcccagtagtaccgctagatccaagagatgcttgtctgcgtctctgaggagactaccatcgggtgtctagtaggctctagcagatgcatggaaacggtgcccctaatcatgccctgacaattaacgacaa

SEQ ID NO: 94467 - DNA, 898 bp, Zea mays
  misc_feature: Ceres CLONE 1584299
  misc_feature: Translation starting site: 312
  misc_feature (858)..(858): n is a, c, t, g, unknown, or other
ctggagctccccgcggtggcggccgctctagaactagtggatcccccgggctgcaggaattcgtctcacccctagaaaaaatcgacctcgatccattgaataattttactaatcaaattcttgttgggatatattcctccaattcccctcctcctcccaacaaggcaacaacaatctgttccggccgccaaacaaaacccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgcggggcgcggcgtcggggagcgcggccgacctggcctcgggggcaggaagtcgtccggcttgccggtgttcgtcatgatgccgctggacaccgtcaaggagtgcgggacccgccctgaaccgcccccagggcgggccagggcaagccttttcgcctctaaaaaccggggcgtcaaggggctcatggggggacctgttgggggggcatatcccaaaccgaaaggcccgggccggtaaaaaattcgggggctacggaaatctatggaaaatggccccaaggccgggttaaaggtccaggccccattttcctctcccacaggggggggaaaaaatggggaaaccctaaaatttccccttttcccngggggggccccaaaaaaaaaaaaagaagagacccccctct

SEQ ID NO: 94468 - DNA, 911 bp, Zea mays
  misc_feature: Ceres CLONE 1584302
  misc_feature: Translation starting site: 295
  misc_feature: Pfam Name: Pentapeptide Pfam Description: Pentapeptide repeats (8 copies)
ctccccgcggtggcggccgctctagaactagtggatcccccgggctgcaggaattcgtctcacccctagaaaaaaccaccactagtatgtcccgttccccagctcaggatctttttccctagactcgggctacagctggaactactgttcgtccgtcgagggcatgattcatggatcggccttcatggtcggcgaggagcacgtgctgctgaactaagatatcttcaatcgctgcctgcatcgcccgggcccgcgacatctgctgcctggccttctccgagcgcgtgggcaaccatgctgtcgaacttcttgccggcagcgaaccacccgaagtggggtgtcgcggaatactacgtcatcgcggcggccgtgattggcgcatctatgccagcttcgcgctagtgagacaagtttgaggtcgaccacctcggccaatatgagcattggctctaccgcgtagtgcgactccacctatcaccagaacgctgtgcacgttaacgagaacttcatgcgggtcaacttcacatccgatgatatgagagagtccgagttcagtggcttcacatacaatggaggctatcatgcagacgatgtagcttatgaggcaaattgtcgaggtgctgatctgagtgatacattactgcaacttctggtacgacatcgaggctatcttatcaatgctgctcgtgtagtgtcgcatctcacacgtagtgatcatggcaggactccttagtgaaggctgcagacttcatggaccccgttaatgacgggtcgcgcagagcggtctatggcaatatgcaggtgctaccaccaccttgacaggagtgagcactccaaaaccccgaagatgggggagaggcgggtcaaatgcaactgggagcacctcaatcccttctgttgagggcccgaac

SEQ ID NO: 94469 - DNA, 773 bp, Zea mays
  misc_feature: Ceres CLONE 1584303
  misc_feature: Encodes the peptide sequence at SEQ ID NO. 94470
  misc_feature (530)..(530): n is a, c, t, g, unknown, or other
  misc_feature (548)..(548): n is a, c, t, g, unknown, or other
ctccccgcggtggcggccgctctagaactagtggatcccccgggctgcaggaattcgtctcacccctagaaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtctccgcgacgcaataatcatagtaataacaagttcggagattgattctggtgcnggattggctggtctatcnaccgccgaagtatcttggcggatgcctgaaattaaacccccttattgctttgggggaaaaaaatgttttgggggggggaaaagggtgaccccgcctttggggaaggggtgtggcgacactagggggtgttgtgtgtgaaaaaaaaaagaggcccccccccaaccacttttttttttggggaggagaagaaccccccctccccccccccatcactattttatgggg

SEQ ID NO: 94470 - protein, 58 aa, Zea mays; identical to SEQ ID NO: 46528
  misc_feature: Ceres CLONE 1584303
  misc_feature (6)..(56): Pfam Name: UPF0057 Pfam Description: Uncharacterized protein family UPF0057

SEQ ID NO: 94471 - DNA, 834 bp, Zea mays
  misc_feature: Ceres CLONE 1584307
  misc_feature (680)..(680): n is a, c, t, g, unknown, or other
ctggagctccccgcggtggcggccgctctagaactagtggatcccccgggctgcaggaattcgtctcacccctagaaaaagtcttctttctcggcttctcgcttccttctccttttcttcctctcctccccactctcaattccttcctcgttcggttgttccttcccacttcctctctctcgcgcgcctgtactacttttgaagccgcaaggtcagaagagaggatccacctctcagttcgattttcggtggctgaagtccttctacctcggggggtttgagcgttttccttgataaatttgtgtttcttcgagagtttattttttgtgttttctcttgagagattcgtgcgaaggacgtcgtcttcggtccattttcttgggtagtcgaattgctcttatacagcgtcaaagcatccaactttgacttctccgtggtggcttcttctactactctgtgttgtcgaggagacaatttaatctttatttaattgggttggatgcttgttcaagttgcagttgaaagggtagcagaagacaccattaatcctggtgattttggtgcttatctgctgaataattgagggtcaaagtaaccatgtgcagttcttacttctcgttttcttgggaagatttggtgaaattcgttgcaggacagagcttccttcaatcctccctccnttgttttatgcatttgggtgggttggggatatcttcactttatcctcgctgcaaaaagactataaacttggggaagtgcctatgatatccattttcttgtgaaggatttgatctttgataactgtgggatcctcggtggaggtggtttgaaaaa

SEQ ID NO: 94472 - DNA, 813 bp, Zea mays
  misc_feature: Ceres CLONE 1584309
  misc_feature: Encodes the peptide sequence at SEQ ID NO. 94473
tccccgcggtggcggccgctctagaactagtggatcccccgggctgcaggaattcgtctcacccctagaaaaattccctgcccccggtgagctgccactgccagcttccccgtgcgcgagctgtgctgctgctcggcggcgcgcccactccccggccgctctctcgtcaccccgcctgccggtaatcggtctctatatatataggtggttcgaggtgatcggcagaaccacacaggcaaagatggcgagcgtgcacaaggccaccacccttgttctcatgttctgcctgctagcgctggggagagcggagtacctcaagtacaaggacccgaagcagcccgtcgctgttcgcatcaaggacctgctgggtcggatgactctcgctgaaaagatcggccagatgacgcagatcgagagggaaaacgccacggccgacgcgctggccaaatacttcataggtagcgtgctgagcggcggaggcagcgtgcctgctcctcaggcgtctgctcaggcttgggccgccatggtgaccgagatgcagaagggcgctctttctacgcgtctgggtataccgatcatctacggtatcgatgcagtgcatgggcacaacaacgtctacaaagctactattttccctcacaacgtcgggcttggagctaccagggaccctgacctcgttaagagaattggagaagcaactgctcttgaagttagagctactggaattccttacgcctttgctccctgtatagcggtttgtagagatccaagatggggacgctgctatgagagctacagtgaggatccaaaggt

SEQ ID NO: 94473 - protein, 190 aa, Zea mays
  misc_feature: Ceres CLONE 1584309
  misc_feature (102)..(190): Pfam Name: Glyco_hydro_3 Pfam Description: Glycosyl hydrolase family 3 N terminal domain
  misc_feature: SWISSPROT Homolog: EC 3.2.1.21 Beta-glucosidase
MASVHKATTLVLMFCLLALGRAEYLKYKDPKQPVAVRIKDLLGRMTLAEKIGQMTQIERENATADALAKYFIGSVLSGGGSVPAPQASAQAWAAMVTEMQKGALSTRLGIPIIYGIDAVHGHNNVYKATIFPHNVGLGATRDPDLVKRIGEATALEVRATGIPYAFAPCIAVCRDPRWGRCYESYSEDPK

SEQ ID NO: 94474 - DNA, 821 bp, Zea mays
  misc_feature: Ceres CLONE 1584310
  misc_feature: Encodes the peptide sequence at SEQ ID NO. 94475
ctggagctccccgcggtggcggccgctctagaactagtggatcccccgggctgcaggaattcgtctcacccctagaaaaagtcgagcagacagaaatcctcctccaagaatcgcttagctgctagcccacgctgggaaggaactcctcgcagacggagcgaccgccgatcaacctgctctcgggctcagcgctggaaggtgttgtaacagaatactcctgaaggttcacaggaaccatgagatgttccaagatgtatcaggctcagacggctgcattgccaccgaatgtgaagcgccgcgtcagcaagtacgagatcgggcgctccctgggagaagggaccttatgcaaagtccggttcgctaaaaacccccaaaacaggagacactgtagctatcaagagccttgacaaggcgaaggttaagagtcacagattggtcgagcagatcaagcgtgaaagtagcatcagtgaaattagtaaggccccctaacgttcttcgactggttcaggagatgcgaagtcaaccacgaatactatcgttctggcaatatgctacctgcagatagctttttgacaccactgctactaatggaacattgaaggaggacgactcacgtaaatcctgccagacactgatgaatgaggctgattactgcaacagcacgggagtgtctctcagacacctccagctcgagaatacgctgcttgatgctacgagaaagatcatagcctctgagctcggtttaagagctgtaatccacgcagtggaagctgatcgtccgctcaacgacaaggggggaaaccccaagttatgttgccccg

SEQ ID NO: 94475 - protein, 62 aa, Zea mays
  misc_feature: Ceres CLONE 1584310
  misc_feature: SWISSPROT Homolog: EC 2.7.11.1 Non-specific serine/threonine protein kinase
MNEADYCNSTGVSLRHLQLENTLLDATRKIIASELGLRAVIHAVEADRPLNDKGGNPKLCCP

SEQ ID NO: 94476 - DNA, 806 bp, Zea mays
  misc_feature: Ceres CLONE 1584311
  misc_feature: Encodes the peptide sequence at SEQ ID NO. 94477
aaagctggagctccccgcggtggcggccgctctagaactagtggatcccccgggctgcaggaattcgtctcacccctagaaaaagtcgagcacacacacatcctcctccaagactcgcttcgcttctcccccagctcggacggagctcctcgcagtcgcagcagccgccgatcaacctgcgctcgggctcagcgctggaaggtgttggaagagaatagcctgaaggttcacagtaaccttcatctgttggaagatgtatcgggctaagagggctgcattgtcaccgaaggtgaagcgccgcgtcggcaagtacgagctcgggcgcaccattggggaagggacctttgccaaggtccggtttgctaagaacaccgaaaacggggaacctgttgctatcaaaatccttgacaaggagaaggttaagaggcacagattggttgagcagattaagcgtgaaatttgcatcatgaaattagtaaggcaccctaatgttgttcgactgtttgaggtgatgggaagtaaagcaagaattttcatcgttctggaatatgttaccggcggagagctttttgaaatcattgctactaatggaagattgaaggaagacgaagcacgtaaatacttccagcaactgattaatgctgttgattactgccacagtaggggagtgtatcacagagacttgaagctcgagaatttgctgcttgatgctgcaggaaatctcagagtctctgactttgggttaagtgctttaaccgaacaagtgaaggctgatggtctgcttcatacaacaagggggaacccca

SEQ ID NO: 94477 - protein, 184 aa, Zea mays
  misc_feature: Ceres CLONE 1584311
  misc_feature (20)..(183): Pfam Name: Pkinase Pfam Description: Protein kinase domain
  misc_feature: SWISSPROT Homolog: EC 2.7.11.1 Non-specific serine/threonine protein kinase
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELFEIIATNGRLKEDEARKYFQQLINAVDYCHSRGVYHRDLKLENLLLDAAGNLRVSDFGLSALTEQVKADGLLHTTRGNP

SEQ ID NO: 94478 - DNA, 831 bp, Zea mays
  misc_feature: Ceres CLONE 1584312
  misc_feature: Encodes the peptide sequence at SEQ ID NO. 94479
agctccccgcggtggcggccgctctagaactagtggatcccccgggctgcaggaattcgtctcacccctagaaaaaagccctcgccatccatggccgccaccgccgccatccacctgcgcccgctccgttccgtcgccgtctcctccgcgaggtcacgctcgctcctccacctcctcgcccggcccctctcctcttcccaatcgtcctacgcctaccgcccttcccctacagcgcccgccgcccccgcccccgcccccaaccatgtccaccaccctctccatcaccaccagtcggtgcctcccccaggaccccctccacagtggtccgcgcagggacatccgcctccgccggccccgtgggctatggggcctccaccgccgcagcaccagcatgtgccggcctcgccaccacgggggttacggaacttcaacacgcgggttacggaccttcaaccaccggctttcggccttcaaaaggggaaaggaaactttcggccggcttttcgccgggaaaaaagggccaagggggccttcccccaaccggggggccaaaaacaatatttggcccccccccttggttaacaaaaaggggccaagggagaacttccccccccaccggggggggcaaaaaaaaattgtgccccccccccccccaaaaggggggacccgggggggcccttcccccacaccaccccgggggggcccaaaaaggggttttaactccgaggggcttttttttgtggggggtgaaaaacaagagggaccagagaggggttttttttctccacccaaatggggggggggggtatgtacatataattaatgtggggg

SEQ ID NO: 94479 - protein, 186 aa, Zea mays
  misc_feature: Ceres CLONE 1584312
MSTTLSITTSRCLPQDPLHSGPRRDIRLRRPRGLWGLHRRSTSMCRPRHHGGYGTSTRGLRTFNHRLSAFKRGKETFGRLFAGKKGPRGPSPNRGAKNNIWPPPLVNKKGPRENFPPHRGGQKKIVPPPPPKGGTRGGPSPTPPRGGPKRGFNSEGLFFVGGEKQEGPERGFFSPPKWGGGVCTYN

SEQ ID NO: 94480 - DNA, 991 bp, Zea mays
  misc_feature: Ceres CLONE 1584314
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (991)..(991): n is a, c, t, g, unknown, or other
tttaatttattattgttttaatatattaaataatattacaaaaaagacgcgaaatnnnnnnnnnnnnnnnnnccaaactggagctccccgcggtggcggccgctctagaactagtggatcccccgggctgcaggaattcgtctcacccctagaaaaagcgtatatcttttccggtgtgcgatgattcatgtattactaatttgactcgtacgtgcctgactacccttgcatgcgatgggcatggtcatcaatttcctggccagggtgctctcctcatcctactagcactacagctacggcccgtcccgtagagtgccctcctcctctgctgtcctggaagacacataagctttgggcatcacgtgaccacaagggccacggctggccaggtaccgtgggcagcccgcccgcgtggcactggcagggggagaagagggcgacagtatcaggcggctgcagaacgggtcggacgtggggggccccccgctggacggcgagaaaggacgggccgtggacctcacgccgactggcggtcgaggccatcgccgagagcttccgggagtggctgccacaggaggagctccggctccggggccaggaaccccagcacctgcatgtgttcgtcggccgggaacccaagctgtcggggcctcgggcttaccgggggagctcttttgcggggctccacagggggggggtgctccgtctttggaaatgggggttatccaccacctccggcctgctttaggaatcagcatttttggccaggctttcaaactatgaaaggctccaattattgatggaggggggttgccacctttcccttataaaccccccaaaaggtggccgagggttcttttcacccaaaaaggagtgccgtgggtttcacgcgttcccgggggagaagtcctaaaaaaacaattttggcgaaacacggagagagagggaagataaaatttacggttgggcccagggcaaaataaataggggn

SEQ ID NO: 94481 - DNA, 838 bp, Zea mays
  misc_feature: Ceres CLONE 1584319
  misc_feature (709)..(709): n is a, c, t, g, unknown, or other
ccccgcggtggcggccgctctagaactagtggatcccccgggctgcaggaattcgtctcacccctagaaaaaaaactcctcgaccgcgcaccgccgcctccacgaccacgcgccgcccctctccgcctcctctacggccgcgcccctccgctctgccttcgccacggcacagccaggccggggccgccgcactgcctccttccccgtcgtcgcgccctctccacacacacaacacctaccctactgtcccccgtgccaccgtcgatgggtccctaggcgcgcaacccgtgccaccgtcgatggagtccttaggcgcgcatctgctccacctcgtcaacgcgtacctggagcaggagctagatcgtcgctgccgcttgtactgcttctcggagtcgcccctaaaatctgtgaaggcccatgtcgaggcgcataattggaaagccttgctagagagagattagattactgctggcttaacaaaaaagcaaaaggacctaatgttgaatccagtaactagtcgtgaaaaggttgtgcacatgtgctggtacgaagatccaaaatttctaacatgaggctgggctttctagcttaacagaaacgccgaccagaccaatttacaattagattctgggacctgagtcaatgtttgtgagactactatgtcaggctgctatgggaaccaaaaccggaggcctctcttctctcctangaatgaagttggagcaagaagctttcgtgcgaactgaaaatttttaatctaataatttgtaggaacaaatgaagtgcaatgcttggctgggcggatttggaaggccagctgtatcgaccacctggggtc

SEQ ID NO: 94482 - DNA, 1195 bp, Zea mays
  misc_feature: Ceres CLONE 1584320
  misc_feature: Encodes the peptide sequence at SEQ ID NO. 94483
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (24)..(24): n is a, c, t, g, unknown, or other
  misc_feature (27)..(27): n is a, c, t, g, unknown, or other
  misc_feature (30)..(30): n is a, c, t, g, unknown, or other
  misc_feature (83)..(83): n is a, c, t, g, unknown, or other
  misc_feature (93)..(93): n is a, c, t, g, unknown, or other
  misc_feature (840)..(840): n is a, c, t, g, unknown, or other
nnnggtgggggtgtgnnnnttttntgntgnttgtggtgtgtggttgtgtcggctctgggtcatttataagtcgtatatatttntaacccaccntcttcaaagctggagctccccgcggtggcggccgctctagaactagtggatcccccgggctgcaggaattcgtctcacccctagaaaaaacactgagaaccgcagagacaggcgtcttcgtactcgcctatctccgcgacatcaaagctttccccaattcccccccttcacccatttctcaccaccgccgccgctccccccgttcaacaacaccatgagggagtgcatctcgatccacatcggccaggctggtatacaggtcggaaacgcgtgctgggagctgtactgcctcaagcatgggattcaggctgatggccagatgcccggtgacaagaccataggtgggaggtgatgatgcttgcacaccttcttcaatgagactggcgctaggaaacacataccccgtgctgtttttgttgaccttgagccccctgtcatcgatgaggggaaggactggcaccctagcccctagcctctttccaccgggaggcatttcaattcctgggggaagggaggatatccagcccaaaccaactttccgcctggtaggtttcatttccccccattttgggaaaaggggaaaaaatagttttggaaacaagattggcccttgggaaacccgcggaaacacggggaaaaacgcttttggcaaagaaaaaaatttttgtgcaatcttggggaattcttcctcacgagggagggggttttttcctacaacaaggtggtttgtgataaaaaatataaacncctaatttgggggggggggggggggcgaaaccacggggggggctttttcttggggcgccccaatggggaattccccaccccctcctccccgccggggaggagggcgccgccgcggtataaaaaatgggggtgctctaaccggggcacaaaaagaaaagaatgtcacaaagagctccgccgcgtgtgttctttatgggcggggagatatgccaattattttcccccgcaaagatgtttttctccacactacactccacgagggtgttccattctctcaataaaacaacaattattgtatctcatttttgtccaacccccaagtgtttatttcgtctctcggaggaaaaaacaacag

SEQ ID NO: 94483 - protein, 45 aa, Zea mays
  misc_feature: Ceres CLONE 1584320
MRECISIHIGQAGIQVGNACWELYCLKHGIQADGQMPGDKTIGGR

SEQ ID NO: 94484 - DNA, 1126 bp, Zea mays
  misc_feature: Ceres CLONE 1584321
  misc_feature: Encodes the peptide sequence at SEQ ID NO. 94485
  misc_feature (820)..(820): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (828)..(828): n is a, c, t, g, unknown, or other
  misc_feature (868)..(868): n is a, c, t, g, unknown, or other
  misc_feature (869)..(869): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (946)..(946): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (964)..(964): n is a, c, t, g, unknown, or other
  misc_feature (965)..(965): n is a, c, t, g, unknown, or other
  misc_feature (1000)..(1000): n is a, c, t, g, unknown, or other
  misc_feature (1001)..(1001): n is a, c, t, g, unknown, or other
  misc_feature (1002)..(1002): n is a, c, t, g, unknown, or other
  misc_feature (1003)..(1003): n is a, c, t, g, unknown, or other
  misc_feature (1004)..(1004): n is a, c, t, g, unknown, or other
  misc_feature (1005)..(1005): n is a, c, t, g, unknown, or other
  misc_feature (1006)..(1006): n is a, c, t, g, unknown, or other
  misc_feature (1007)..(1007): n is a, c, t, g, unknown, or other
  misc_feature (1008)..(1008): n is a, c, t, g, unknown, or other
  misc_feature (1009)..(1009): n is a, c, t, g, unknown, or other
  misc_feature (1010)..(1010): n is a, c, t, g, unknown, or other
  misc_feature (1011)..(1011): n is a, c, t, g, unknown, or other
  misc_feature (1012)..(1012): n is a, c, t, g, unknown, or other
  misc_feature (1013)..(1013): n is a, c, t, g, unknown, or other
  misc_feature (1014)..(1014): n is a, c, t, g, unknown, or other
  misc_feature (1015)..(1015): n is a, c, t, g, unknown, or other
  misc_feature (1018)..(1018): n is a, c, t, g, unknown, or other
  misc_feature (1125)..(1125): n is a, c, t, g, unknown, or other
ccgagctggagctccccgcggtggcggccgctctagaactagtggatcccccgggctgcaggaattcgtctcacccctagaaaaaaccacacctgttctgaccagttccccagctcaggatcttcttccctatactcaggatacacctgcaactactgctcatccgtcgagacaatgattgatgcatccaccttccctctccccgacgacgacgtgcccacgaacatagatatcttgtctcgctgcgcagcatcctccctcccggacatctgctggctggccttctccgaacacgtggggcaacaagtgtcggacttcttgccggcggggaactaaagaaggtgggggtgcgggagagttcccccccccccggggggggggggggggtgggggggtcccccccccgggggggggtgagtttaaaaaagtcttaaggcgggaaaccccccgggcaaaaaaaaagcaatgggggttcctcccgcgtgggggtgggggtccccccaaaaaataaaaaaaaagaggttggttccccgctttattgtaagaaaatattcgggcggggggggcaacatattcttctctccttcctttttaatatgtgggagagaagtcccacaaattttccccgtgggtggttccccaacccctaataataagggaggcgggccctcctctcctattaacaaaacgggcgcgtttatttcttcttcaataagggggcgaaccataatataccccgcagagagggtgttccgtgatattatatttgtggggcggagaacatacatatcatgtaaggagaaacgtaaggatgtgacgnggtnnngngggagagaggaagcgagaaggtagagtccttccttttatnnannnacacaaagacgatgttttttttataataaacgcgagttcttcccacacaacaaaatcagtttattatctttgntnnnnntcggagcagagnntatattttcctgatacctttgggaacacccgtctnnnnnnnnnnnnnnnnttntaaaagagaggggaccccaagacagaagggtttctccctaacattattttagtggggagcgcgagacacccccccgcttacacggtgggggaggccgccagcaccana

SEQ ID NO: 94485 - protein, 53 aa, Zea mays
  misc_feature: Ceres CLONE 1584321
MIDASTFPLPDDDVPTNIDILSRCAASSLPDICWLAFSEHVGQQVSDFLPAGN

SEQ ID NO: 94486 - DNA, 886 bp, Zea mays
  misc_feature: Ceres CLONE 1584325
  misc_feature: Encodes the peptide sequence at SEQ ID NO. 94487
gcggtggcggccgctctagaactagtggatcccccgggctgcaggaattcgtctcacccctagaaaaaccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacgtggccaccatccccctcatcgtgctggtgtgcggcgccgagctgggcagcctcagccgcgacgagcgggggcgcaaggtgtggggggaagccacctacgacctcgccaccgtggctcgccttcctcgccgtcctcgccttcaccatctccgtctacatcatggccagggcccagggcccgtggaacttcatgaacttcggattgctacagccgggccgacgagctcaagggtgtctcaaggcggaagtttcttcgacctgtgcgctcaagtcccggcaaatttcaaccaaggaacagcctgggcgttttccagtccccgacttgctggggcaagtggcgggattcggttaacaggtctgtacttgcccccgctgttgtggttctagacccaatgccctgttgcgcccccccttaaagggaggggccccccccaaggggtccaagggccatgtttctctgcgccttgggaaaacctttttctaaaaattttcgccgtctcggccccaaggaaattggtg

SEQ ID NO: 94487 - protein, 191 aa, Zea mays
  misc_feature: Ceres CLONE 1584325
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYVATIPLIVLVCGAELGSLSRDERGRKVWGEATYDLATVARLPRRPRLHHLRLHHGQGPGPVELHELRIATAGPTSSRVSQGGSFFDLCAQVPANFNQGTAWAFSSPRLAGASGGIRLTGLYLPPLLWF

SEQ ID NO: 94488 - DNA, 960 bp, Zea mays
  misc_feature: Ceres CLONE 1584327
  misc_feature: Encodes the peptide sequence at SEQ ID NO. 94489
  misc_feature (366)..(366): n is a, c, t, g, unknown, or other
cagaagctggagctccccgcggtggcggccgctctagaactagtggatcccccgggctgcaggaattcgtctcacccctagaaaaagtcggaatattatatgaaaaccctcgcggcgaggagcgctctccgtcccacacacgcgcgccgcaacctccgcagtccgcacctgcctccacgacctgtcgtgctcgtgcgctactctcctcgagcgcggcgcggagcacggggacatcaaatggcggcagcggcggagatcggtggtttcacggcggcgagagtggcggtggcaacgctcaggccggctgcgcacccaaccccggcggcggcggcggcaccgcaacctaggagggcggtggcggcgcantcgctgcagacggaccggaccgaggggctcaccccccatctcgccgggagtaccaacggcactgtgcatgctcggatgaatagcaagggctacaagtgaaatcactgtcgcaggcaagttaccggcaaattctagcgagaaagacaaagatagtcctgccccatagggtcccttcaaccagcactccgggaggaggatttgggaaagcttgccggaaacctgggaataaatggcgccggcgccgttaaatagggtcccccaagggttaacccaccggttcgcgagccgaaagggttcatttgattttgggttccaaggtgtaatcaaggtatcggaaaaaactgaatgggcgagtggttattggccctttatggctgggaacacaaaagggtgttttagaggtaaaaagtggggggagggttccccaaattcagttctttgttttatgggggggggcaaggactttccccttttacggattgaaaaaaggggggagggccctaaagaaactatttcaggggggaaatatggaagaagtcccaaaaggggagtttgaaaccggtctagaataattttcgcgggtttgtgaggaag

SEQ ID NO: 94489 - protein, 75 aa, Zea mays
  misc_feature: Ceres CLONE 1584327
  misc_feature (43)..(43): Xaa is any aa, unknown, or other
MAAAAEIGGFTAARVAVATLRPAAHPTPAAAAAPQPRRAVAAXSLQTDRTEGLTPHLAGSTNGTVHARMNSKGYK

SEQ ID NO: 94490 - DNA, 817 bp, Zea mays
  misc_feature: Ceres CLONE 1584332
  misc_feature: Encodes the peptide sequence at SEQ ID NO. 94491
  misc_feature (408)..(408): n is a, c, t, g, unknown, or other
ctggagctccccgcggtggcggccgctctagaactagtggatcccccgggctgcaggaattcgtctcacccctagaaaaaaccgagagttcgtcttctgcctcttcttctccttctactagtggacgcagagagatcgagtgctagggaatatactaagcacgccagccagcagcaaccggacctggtttgctcctcctcctcctcctcatcgtgggctgacaacgcttcctgcgtttctgggggtgtgcgaagccacgcaacggtggatgcggcgctagcttcaccggccgactgccctcctccttttctctaaaggcacttcaggagcggcggcggcggctgcgcatccagcaccgcaccaatgggcccactggagccgcgctaccgtccatgcggccccccccancacactagtaatagaagggcctcctagagcaagagtttcaaagacgccgagaatttcgacagcctcgtccttgtgaagagctgcggttgctcgttcaagtctctgaggatgttgctcatgcccatcatctccgcgacagtccttacccttgtaaccccgaccttatacgagcgccagttgcagtcagcctcccggtacgtggatgtcgggtggatgtgggacagaccgagttccgatccgcggtacgcatcttctgccgatgttaggtgggaggatgtgtacaaagccctggggaaacctaacaagctgggacccccagagtcctctcaaaattggggctcttgaaatttccacagccaccgaggtcccggctcctgggacaccgtttggctccccagctgggacggcc

SEQ ID NO: 94491 - protein, 78 aa, Zea mays
  misc_feature: Ceres CLONE 1584332
MLLMPIISATVLTLVTPTLYERQLQSASRYVDVGWMWDRPSSDPRYASSADVRWEDVYKALGKPNKLGPPESSQNWGS

SEQ ID NO: 94492 - DNA, 915 bp, Zea mays
  misc_feature: Ceres CLONE 1584333
  misc_feature: Encodes the peptide sequence at SEQ ID NO. 94493
ctggagctccccgcggtggcggccgctctagaactagtggatcccccgggctgcaggaattcgtctcacccctagaaaaagactggtgtgccagtctgatcgctgttttcctcccgcacccggctccagggtcggactcactctcatgagcggagaaagctggtgtggaggggcgggcggcctgcctcgtgtgtttgagtacctcggcgccggggacgcgaatccgatgacgctgtccgcagtgacgacgacgtggaagtgtgcggcttccgcatcatcaatggtgctgatcactctcgtccgcgactacatcgaccgcatgctccacgacatcccgggcatgaaggtcctcgtcctcgacccccaaaccgttgggatggtgagcgtggtgtacagcccagtcggatctgctgccggaaggagggttttccttctcgaggaccatggaacaacgccctcccggctcccaggggaattcccatggggcgcccccctttaaggggcttttttttttccctcgaacccctccccgtaaaaaaagtttcaaaaaattttcccagggcacccctgcccatttgcggggcttttttcccagataccccacccattttttttcctccgaaatattttggagaggccccccccaaaatataaaaaatttttcttgcgcacttcttaaaaaacccaagagtttgtctctccccaatttttccgcggggggtcttttctcgcggtgttttttttggccgccgtgtgccccccctccctcctttttcttcttcccgaaagtgaaataaaaataaccccccccttttaattttttctcccccccaacactggggggggcaccccccctcctggggtgtgggggaagtttctttattgtaattcccgccccccttttaatgtgattgt

SEQ ID NO: 94493 - protein, 72 aa, Zea mays
  misc_feature: Ceres CLONE 1584333
MVLITLVRDYIDRMLHDIPGMKVLVLDPQTVGMVSVVYSPVGSAAGRRVFLLEDHGTTPSRLPGEFPWGAPL

SEQ ID NO: 94494 - DNA, 926 bp, Zea mays
  misc_feature: Ceres CLONE 1584334
  misc_feature: Encodes the peptide sequence at SEQ ID NO. 94495
ctccccgcggtggcggccgctctagaactagtggatcccccgggctgcaggaattcgtctcacccctagaaaaactttccagccacctcactcttcactagcctctgctcctctgaaatggcggcggcgacttcctcttccacctacctcgccatcggccgcaaaaccctaaaccccgccccctcccgtagcacagccgccacctccgtctccttccccgcacgcagcacccatgcctcgtcgccgcctcccgcgacccgcgccgcgccgtggctgcgaaggtctcgtcgccgtcggtcatcggaacccgcattgcggtccttggacttcgagacctccggttttaaaaaggaaaaggggtcccttgcccggcccagaggattaatttgtaaggggggggaggggaattttttttcttttctcccccaaaggccccccggggaaaaaaaaaaaaaaggggggaatagggcgggggggccccaggggggctcctccccaaccccaaaatatttggagaaacccttttttgtagaacaaaaaaaaaaaaattttttgaaaaaaaagtccccccccgaaagaggttcaaattctttttaaaaaaaaccccccgcgggggtgttttctctcaaaaaagaggggggccccgcggggtttttttgtgggaaaagttttatacacaaaggcttttttttgttgtttcaaaaaaaaaaaaaaaagccccccgcggggttacatacaaaaaaaaaaatttcttttttccaaaaaaaaaaaaaaaataaacttgggtgtttagtaaaaagattattttctcggaaaaaaaaagcacctggggggtggtttttcactcaaaaaacacccgtttgttgtgcttccctccccgcggggggaggagcctcacaagaaaaaatataattttgttaggggag

SEQ ID NO: 94495 - protein, 50 aa, Zea mays
  misc_feature: Ceres CLONE 1584334
MPRRRLPRPAPRRGCEGLVAVGHRNPHCGPWTSRPPVLKRKRGPLPGPED

SEQ ID NO: 94496 - DNA, 1153 bp, Zea mays
  misc_feature: Ceres CLONE 1584339
  misc_feature (1)..(1): n is a, c, t, g, unknown, or other
  misc_feature (12)..(12): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (218)..(218): n is a, c, t, g, unknown, or other
  misc_feature (727)..(727): n is a, c, t, g, unknown, or other
  misc_feature (730)..(730): n is a, c, t, g, unknown, or other
  misc_feature (732)..(732): n is a, c, t, g, unknown, or other
  misc_feature (822)..(822): n is a, c, t, g, unknown, or other
  misc_feature (895)..(895): n is a, c, t, g, unknown, or other
  misc_feature (1124)..(1124): n is a, c, t, g, unknown, or other
ngcgtggggggnttattttaaggtggaaattgtggggggaggaattatcaaagggggagcannnnatcttgcatgataaacttggactccccacggtggcggccgctctagaactagtggatcccccgggctgcatgaattcgtctcacccccccctagaaaaaacgtcgaaaccagcacccggtaaactcagacaaagcacgagccacgcacgcccncgctgtctccctcccgccgtcccgccgccaccgctactgccggagtctctcgccaccggtcgttgctctcccgccttcaccgtgccaactcccctccttgcctccccccgcgcttcaatccctccactccccatcgctttcgcctggtcagaaattccagaaccagggggtccctttgaccccgaaccgcggcctgccttttcccctccgcctcgggattccttccgcccgtctttcggttccctacagggggccccccccgggggtgggaaatgcggaaaattggggatcccccccaggggagccctgaattccccttctccccccgggagagtcctaggtttggggacggcggggaattttccttttcgcgccggaaccgggggcataatagcaatttgtattcccccggctggggtggaaatttgccgggggcacgcacggggaaattgacgcttttggggtggtaaagacacacttttttggggggcacttgggggaggaaggtntgnanaccccctctcgctctccagaatatatctgtggggacccgctaagaaaagaaaaaattcccctcgtggagaaggtgcgggtgttaacatcngtttcacaccaagtgggagacatattcacacatcttacaccgtggaggagggtttacaccccctgaaagggcnctcaatatttgcgcctttcccaaatgggggcggcctctttgtggaacaaatggggggtgcccgaaaggaggaggggaaaagttttgtgccggccgcaccccgtctaataaacacggttagaggggtggggccacctccctctgaggatatataatgcaaacttggcccgaggcctgatattgtaaaactatacttcctcggcgtagaataagccgagggtgggtctccntcccccgccgcgaaaaaaagatggcaaga

SEQ ID NO: 94497 - DNA, 816 bp, Zea mays
  misc_feature: Ceres CLONE 1584340
  misc_feature: Encodes the peptide sequence at SEQ ID NO. 94498
  misc_feature (816)..(816): n is a, c, t, g, unknown, or other
ggcggccgctctagaactagtggatcccccgggctgcaggaattcgtctcacccctagaaaaagagctcctcggcggctcgccagtctgccgccgcgcacggcgcatctgttccttctgctctgcgacggcgagcctctcccctccctccgtgctcgtatcgtagcctattttcgccgccgcagcttgcccagtgctgttatcttgtgttcggcaccgcgtcaaaggctgaccctctccaggcgcctggtagatcgcccagactcaaccgggtaagccttaccgcgcacgccaccatggccgagccctcgccgcctccggtgtcgaacgctggcctccgtatcctcctgtcgaaggaccggccggctccctcccctccacccaccgccgctgtctccagccacgccgaccgcgaccgcatcatcggagttttcaggagcgcgttgtctaggaacgaacccccggaaacattttcccttcagacggttcaggaagcaattaaacctcagaaggaaaccgtgttggttctagaggagaatcagtccttggaaaatgctcttcgaactttgctgcaggagcttgtgtcatctgcggtccaatcggataaaaagattatgcagtacgggaattctttggatagcggaaaaagtaactgcctgataactcgccttcttgatattgtgctttacctttgccaaaagaaggcatgttgaagggggtatggtattcccagctgttagaagaccttaactgaaatgtcaacaatccaaagactggaagagaatatcttttgggttatattggagagcccgccaan

SEQ ID NO: 94498 - protein, 138 aa, Zea mays
  misc_feature: Ceres CLONE 1584340
MAEPSPPPVSNAGLRILLSKDRPAPSPPPTAAVSSHADRDRIIGVFRSALSRNEPPETFSLQTVQEAIKPQKETVLVLEENQSLENALRTLLQELVSSAVQSDKKIMQYGNSLDSGKSNCLITRLLDIVLYLCQKKAC

SEQ ID NO: 94499 - DNA, 1123 bp, Zea mays
  misc_feature: Ceres CLONE 1584341
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (67)..(67): n is a, c, t, g, unknown, or other
  misc_feature (73)..(73): n is a, c, t, g, unknown, or other
  misc_feature (1123)..(1123): n is a, c, t, g, unknown, or other
ttgggtggggnnnnctgcgaggggagggggggatgaactctcacggaataagtaaggaatatttttntggggnggggaacaaactggagctccccgcggtggcggccgctctagaactagtggatcccccgggctgttggaattcgtctcacccccccctagaaaaacgtcgaaaccagcacccggatacccagacaaagcacgagccacgcacgccccgctgtctccctcccgccgtcccgccgccaccgctactgccggagtctctcgccaccgtcgttgctctcccgccttcaccgtgccaactcccctccttgcctcccccgcgcttcagtcgctccactccccatcgctttcgcctggtcaagattccagatcccaggtgtcctttgacccagaaccggcctgccttttccctccgctcggatttcttcccggccttcgttcctactgggggcgccccccggggtggaaaccgaatatcggattcgccccaaggaacctgaattcctttctccccccaaaggctaagttttgaatgcgggatttcttttccgcgtgaacccggggaattaagccttggatcccctgggggggggaaattttgcgggtcccccggggaattagcctttgtgggtgccaagacactgtttggggcctttgggggaaatttttattcttttttccctaaaattactgggggccctctaaaaagaaataaatattcccctcgaaagaggggcggggtgttaacacgccctcccccaccatatgtggtggattgggccccaaaaatgtgtcgcgggggaagggggggtacccgcgggggggggccgaaaatttgggccgggggcctgggggtgggggcctttttgggacacaaagagggggccccaaccacgcggggggaaaatattctggcccccccccacgcgggaaattaagtgggcaaaggggggggggccccccccccttaaagaaaacacccccacctttctcttgcgccgcgtattgggaaacccactttctccggggaaaaaacccagaggggttctcgcccccgcccctgaaaaaaagggggaaatgggaaaccccaccctccgcaataccccgggaaaataan

SEQ ID NO: 94500 - DNA, 819 bp, Zea mays
  misc_feature: Ceres CLONE 1584343
  misc_feature: Encodes the peptide sequence at SEQ ID NO. 94501
gctctagaactagtggatcccccgggctgcaggaattcgtctcacccctagaaaaaactccgatacgcggggatgcatagacgtcggcaggaggagctcatgtcgaacaccaatagcgttagccaccaccagtagccacagcagtcatggggtcggtgccgccggcagagggggacaggcgccagccccagcagcagccacacgtggtgatgatcccgtacccggcgcagggccatgtcacgccgatgctgcagctggccaagctactccacacacgcggattccacgtcaccttcgtcaacaacgagttcaaccaccgtcgccacctgcgcgcgcgggggccgggcgcgctccacggcgcgccggggttccgcttcaccgccattgacgacggccttccgccctccgacgccgacgccacccaggacgtccccaagctctgctactccaccatgaccacctgcctaccccggttcagggacctaattgtcaggaccaatgccgaggccgaggccgagggacgccccgccgtgacgtgcgtcgtcgccgacagcatcatgagctttgggctccgcgccgcgcgggagctcggtctccgcttgcccacgttctggaacgccagcgcctgcggcttcattggctactactactaccgccaccctcgtcgcaaggggtaatctccccgctttaaaaatgaaaccccagctcacccaacggttaccctggaacacccgtcctccgacgggatcccctttccgcccccccaaggaccctgcaaacttccggggaatttcccccaaaactttttgttcccccccc

SEQ ID NO: 94501 - protein, 176 aa, Zea mays
  misc_feature: Ceres CLONE 1584343
  misc_feature: SWISSPROT Homolog: EC 2.4.1.210 Limonoid glucosyltransferase
MGSVPPAEGDRRQPQQQPHVVMIPYPAQGHVTPMLQLAKLLHTRGFHVTFVNNEFNHRRHLRARGPGALHGAPGFRFTAIDDGLPPSDADATQDVPKLCYSTMTTCLPRFRDLIVRTNAEAEAEGRPAVTCVVADSIMSFGLRAARELGLRLPTFWNASACGFIGYYYYRHPRRKG

SEQ ID NO: 94502 - DNA, 908 bp, Zea mays
  misc_feature: Ceres CLONE 1584346
  misc_feature: Encodes the peptide sequence at SEQ ID NO. 94503
gagctccccgcggtggcggccgctctagaactagtggatcccccgggctgcaggaattcgtctcacccctagaaaaattttttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgaggttggggatatgtctttccaccttcacaagttccctttactttcaaaaagtgcctttccccaacggtcaattgaagaaaattctgaccaagaagaatgcatcatcaaactaaatgacattcctgggggtgccaagtcatttgagctagttgcaaggttctgctatggtgtgaaaatagagctttcacctgcaaatgttgtctacctacggtgtgcctcagagcatctagaaatgacttgaaagagtagctgaggaaaacctgattgcacagtcagaaatgttcctcaaacaagtggttctccgtaactggaaagatcccttggcagcattgggaacatgtgatgacctactcccccatgctgaagacctcagattgtgaacagatgcatcgattcattggcatcaaaactactagtaatcaaaccttctttggatggcccataaggaaactgccatgatgcaaagtcctggtggcgtgtactatggaagggaatcacccggggggcagggcccaaaaattcattcaaactggggggacgggaatgcttcaccatggagttttccctggtaaaa

SEQ ID NO: 94503 - protein, 112 aa, Zea mays
  misc_feature: Ceres CLONE 1584346
MASVKLGSKPDAFKRQGQAWFCTTGLPSDVTVEVGDMSFHLHKFPLLSKSAFPQRSIEENSDQEECIIKLNDIPGGAKSFELVARFCYGVKIELSPANVVYLRCASEHLEMT

SEQ ID NO: 94504 - DNA, 896 bp, Zea mays
  misc_feature: Ceres CLONE 1584352
  misc_feature: Translation starting site: 161
  misc_feature (896)..(896): n is a, c, t, g, unknown, or other
ctggagctcaccgcggtggcggccgctctagaactagtggatcccccgggctgcaggaattcgtctcacccctagaaaaagttcggacttccgccgcgcttcgccctctcgctccagccgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctcatgtgaagacgaagtgggaaaaacagctcatggggcaagaagctgattgtccagaagaggagggctgcgctcagtgactttgacaggttcaaggtcatgctggcaaggatcaagaggggtggtgctatcaggcaagagcttcgccaagctgaagaaggcgtccacggcttaagtccctttttggtggatgggcatgttagttttttggtttcatggttgcatcagcattttggtttttgagtgttgccaaggcccgattaggaatatggtttcatgtggaccctttttagattccgcctctttcacccccctggtcggggaagcagaaaatccattccccccccggggcggcgaagcagcaaaactccctttccccccccttgcggggggagcacgcaaactgggaaatttctgccctaccgagggcctttgggaaattggggcggaaagatccccccctcatcccgaatagggggggggtcaccttttcttttccccccn

SEQ ID NO: 94505 - DNA, 791 bp, Zea mays
  misc_feature: Ceres CLONE 1584353
  misc_feature: Encodes the peptide sequence at SEQ ID NO. 94506
ctggagctccccgcggtggcggccgctctagaactagtggatcccccgggctgcaggaattcgtctcacccctagaaaaactcttggaattggaattggactcaaaagtttcggcggccttctccatgaacacggtggcttcgctgcctttggcgccgcgcctactcattaagccctccctcgcctgcttctccagaaaggacgtcgcccgctatggcgggatcaaggtgtacgccgtgctcagggaagacggggccgagttcgcccggaacaacaacctgggggccctgttccaggtggacgaccccgggccgcgggcccccgtcaagaagttcctggacgtgaacgaggctctggaggtggtccgcttcgacatccagtactgcgactggagggcgcgccaggatctcctcaccatcatgcttctccacagcaaggtggtggaggtcctcaaccctctggcgagggagttcaagtccatcgggaccttgaggaaagagctcgccgagctacagcaggagctggaaaaagctcacaatcagcaggtccatctctcggaagccagagtctcatcggcgctcgacaagctagcgcatatggagaccctggtgagcgcatcatccacagccgagccgcccacttcttcctccctggctgcaactgcaactgcaactgcaactgcaagcagcaccgcccgtgtccgagccaagaacaaacagccacgtcggaagcttgacgtgtccggcccagtgaagccttacaacccagcctcaagaacttctggtacccag

SEQ ID NO: 94506 - protein, 222 aa, Zea mays
  misc_feature: Ceres CLONE 1584353
  misc_feature: SWISSPROT Homolog: EC 1.13.12.14 Chlorophyllide-a oxygenase
MNTVASLPLAPRLLIKPSLACFSRKDVARYGGIKVYAVLREDGAEFARNNNLGALFQVDDPGPRAPVKKFLDVNEALEVVRFDIQYCDWRARQDLLTIMLLHSKVVEVLNPLAREFKSIGTLRKELAELQQELEKAHNQQVHLSEARVSSALDKLAHMETLVSASSTAEPPTSSSLAATATATATASSTARVRAKNKQPRRKLDVSGPVKPYNPASRTSGTQ

SEQ ID NO: 94507 - DNA, 787 bp, Zea mays
  misc_feature: Ceres CLONE 1584355
ccccgcggtggcggccgctctagaactagtggatcccccgggctgcaggaattcgtctcacccctagaaaaagccatctctgccccctccgccgtgctgtctccatgcatcgcctgcagtcgcttgcatcgctgccgtctccgtctcctaccccgccatacagacccatgccttcttcctgcctccgcgggccgtcgtcacgccatgaatgcgaaggtctcttcgccatcgagacctccgtcttcaagaaggaaaaggtctccttggctggccatgaggaggtttgatttgcaggcctagccacttcctccaccacctacctcgccatcgcccgcaaaaccctaaatcctgttccctccataggcacagccgccacctcgatccccttctcttccacgcaggctccatgccttttcttcgtctctgcgggccgctgtcgcgtcgtgtctgcgaaggtacctcgtcgtcgatcatcacgatgccaaccccttcgacgagggcagggccaaagacaaccccttctctatgagcacaaaacccttttcacttactccagaaattttgctaccaacctaggctaggtggtttggtagatctagagattttaggcgagtatccgatcaaccgtggctgttggattgtagaatggaggaggcggaagcatcaagcagtagtacgacttctggctaattgagcccatcaggtttagtggtgccggtagagacgaccgccgtcgtcgtcgtcccactcaaaacatgggggaaagggcttcattcacacactgctc

SEQ ID NO: 94508 - DNA, 1161 bp, Zea mays
  misc_feature: Ceres CLONE 1584358
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (13)..(13): n is a, c, t, g, unknown, or other
  misc_feature (16)..(16): n is a, c, t, g, unknown, or other
  misc_feature (51)..(51): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
naaaaaaannaanttnaatataaaaatttaattaccccccttcctctcganggggaggggttannnnnnnaaaattggagctccccgcggtggcggccgctctagaactagtggatcccccgggctgcaggaattcgtctcacccctagaaaaagtggccacgccgcggcgcgaccctgacgcccgccgtctccggcacccgataggcctcctccccacacccctcgcgtggcttccgtggcccgtagcccggcgcgcttcccttcaaagccactgcttcgcctcctccttctacttaagcgcagccggccccggccggcactcgcatccggtagctcgatcacttcttcctctggattttgggaaggaggcatcggacgtcggatgcatgacacactcattgcattagcgcctacgcctaccgcaagtggaagcctatggatctcaagcaagcctcctctggtacaatcttctgccttctgcttctattctgcgtggggctgcagatggccggccttccgaaaattagaggccacccagacagccagcccttcaagggtgaatgccctccgccacagctttggccccggaaaaatcccctgaaaaacattggttttgcggaaatttttttttttgagggaagaaacagaacccatttctcaaggaaaccttggggtggggccattattcgggacgccagaagagccctttgggtcccatgtaaaaacacagagagggcgcttttttcgcaaagatattctctggagagaagggggccttcatctaccagaagggcgctcccctctgtgtcgagaaaaccgtatttgtggaatccccccccgcggggggtgccccacaccctccaggttgggggcgaaaaaaagaacctcttccccctcctccctgattctttcggtgggcgcccgaacctgtggaatctcgttagcatactataaaagtgtttgctaccagaactcaaaacaaacatttggttcaccgctcttgtgaaaagagtgcgggaggcgccccctctcgtttggaaagagagattatctccagtctgtgggggaggtttttagtggtctcaataacacccacccgttgtttgggggcgcgctcccacctcgcaataaatggagaagggccctccaaaccttcgtt

SEQ ID NO: 94509 - DNA, 1282 bp, Zea mays
  misc_feature: Ceres CLONE 1584361
  misc_feature: Encodes the peptide sequence at SEQ ID NO. 94510
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (30)..(30): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
nnnnggggnaaaannnnnaaagcaggtagntggacgggcgccccttttattccccccnnnnnnnnnnnnnaaatnnnnnnaaatactggagctccccgcggtggcggccgctctagaactagtggatcccccgggctgcaggaattcgtctcacccctagaaaaaagattcagaacgcactagcagttccacgcggcgttccacttccacccgaaaccccaatcaagcgtgcactgcatctgcgtagcccgttcaccacgcacgcgcttccctccctaccgggcgatctatggacggcgacggcccgacgtgggggcagccgatgctggaaaagcggccgagccaccgggagcggcatttcctttcgggggaagggggcgggaccgcctcctggggttttccgacggccccaccaagcctttggcgcataatttttttccccccccccaaaggggggggggggggggttctctccccataaagtttgggagaaggcgggcttgacaacaccctcggtcggggggcgggcgggggagcggagtgccgcgcctcccaacgcaccgctatccggcgatatggcgaccgttcgccgctccgccgtctgtcggagcggccggggggggcctggcccgcgggacgcccgccgcgcgtcggccggcgcgggagacggcccggagaagacgggcgttctgtctcggaccccgcggccgccgggcgcgtctggggcccgcgcccaccgcgcggagggcacgaccggaaggacggcagagtattggtgtacggtatgtccggtgcgcgggatatgccccatctcgcgcccgctggcggcatccatatcatatcagccacccacgggcagagcgatacaccagggcgatcgacagggcgcagcggtcaccgagtgagtgcgcgcgacgcgcgaggacaggcgaggtgacgccgcgcgcacgccccccgctgcaggagccaccgcgcacggctagagagatcgctcttcgtcgcgcgaatgtggtacgcggggccgggctgtgggacggccgacacgcgcgcgtgtgcgccggtgccgccgctgccccgagtgttttgtggcgtgaggactcggtccatagatggatacggcaagactggaatgtagatatgctccttgcacgacccaacacaagagccccacgtgggaaaaagtaccggggccggctacgcaccttgtgcatatcgccggcagtgcggtgagagatacagagcgaagtcagcgcgcgctcgcgtggacgccgtgtcacacgta

SEQ ID NO: 94510 - protein, 63 aa, Zea mays
  misc_feature: Ceres CLONE 1584361
MDGDGPTWGQPMLEKRPSHRERHFLSGEGGGTASWGFPTAPPSLWRIIFFPPPKGGGGGVLSP

SEQ ID NO: 94511 - DNA, 824 bp, Zea mays
  misc_feature: Ceres CLONE 1584363
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (253)..(253): n is a, c, t, g, unknown, or other
  misc_feature (254)..(254): n is a, c, t, g, unknown, or other
  misc_feature (258)..(258): n is a, c, t, g, unknown, or other
gggcggccgctctagaactagtggatcccccgggctgcaggattctctcacccctagaaaaatcggtgtatcttcgcccccggcgaaggcgctatcctcccgaccacccggcggtgccgggtacgccggtaaaggcagggttgccagacccccgcggaccccggatccccgattcgggtccgctttggccaaaggccggccgttgaacccttacccgcagcttttttttnnnnnnnnnnnnnnnnnntnnntnntttntgtctgtgaggttggatgtgtgggtagttgtctggggtaggcatatcctccttgtgtatacactcagtagactctttttatgcattatggtccgcgggggtattgctgttgatgggtggttgggcggtggaggcggtgtggggtgcgtaaacttattttatcagttttggtgtcggtttattttgggtttaggtgggtttcttatgacttccttttgcgctggatttttggtgctggttatttgtccttcttcgctttactactatatgtgagtggtagactcccactccatatctccttttgtttcatttatttctcttcccccgccaagtagtgtctactctctttttgggctgctttgattcttggtgtgggcggggttggtcgggttacggtggtggggttgctctggggtggaggtacccgcgtttctttatccttcctgcgggcccccccttttttttcttctttgtatagctgatttattggaactaacgaggggggaacaaaggacgttgtattacctttcttctgcgctgggcctattcgttggtcgggcggggtga

SEQ ID NO: 94512 - DNA, 790 bp, Zea mays
  misc_feature: Ceres CLONE 1584365
  misc_feature: Encodes the peptide sequence at SEQ ID NO. 94513
  misc_feature (369)..(369): n is a, c, t, g, unknown, or other
  misc_feature (370)..(370): n is a, c, t, g, unknown, or other
  misc_feature (648)..(648): n is a, c, t, g, unknown, or other
  misc_feature (656)..(656): n is a, c, t, g, unknown, or other
  misc_feature (757)..(757): n is a, c, t, g, unknown, or other
  misc_feature (759)..(759): n is a, c, t, g, unknown, or other
  misc_feature (761)..(761): n is a, c, t, g, unknown, or other
ctccccgcggtggcggccgctctagaactagtggatcccccgggctgcaggaattcgtctcacccctagaaaaaggacaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaacggaggctggctgggcgccgggctgatccctggcacggagctggcggaacnncgtgtgcgtgatgggcattctcatgaaccctggtgaacgtacttcgttcggcgaagctgcaccttctcccaaaactccaaagattcccgcccccacccgggggggggggaaaaaaaaacatcttgtggggggggggggagggcccacaaaaaaaaaagggggagggtgcccccccccccccccccggggggggggggggggggggtttttttttttctacccgcgaaaaaaaaaaaaaaaaaaaaaaaaagaaagcggggggggggggggtggggcgnccccaccncacaccacaaaacaaagaaagggagagagcaacgatccccccctttacgcctgaccggaggaaaaaaataaacaaaaatataaatgaaccacaacaccccncngntgcgaaagatgtaatgtgatgtatgtgta

SEQ ID NO: 94513 - protein, 59 aa, Zea mays
  misc_feature: Ceres CLONE 1584365
  misc_feature (48)..(48): Xaa is any aa, unknown, or other
MVSGAGHGGYGGGDDGQAVDFRGNPADKSRNGGWLGAGLIPGTELAEXRVRDGHSHEPW

SEQ ID NO: 94514 - DNA, 803 bp, Zea mays
  misc_feature: Ceres CLONE 1584369
  misc_feature: Encodes the peptide sequence at SEQ ID NO. 94515
  misc_feature (401)..(401): n is a, c, t, g, unknown, or other
tggagctccccgcggtggcggccgctctagaactggtggatcccccgggctgcaggaattcgtctcacccctagaaaaaactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcacccgcnccggcgccatcggccaggtgtgccaggtgatcggcgccgtcgtcgacgtgcgctacgatgagggcctcccgcccatcctcacagcgctcgatgtgctcgacaacgacatccgcctcgtgctcgaggtggcgcagcaccttggcgagaacatggtgcgcaccatcgctatggacggcacagaagggctcgttcgcggacagcgcgtcctcaacactggctcccccatcaccgtgcctgttggcagggctacccttggacgtatcattaatggtatcggtgagccgatggatgagaatggtgatataacggacaacccacttcctccctatcatcgtgaagcccctgctttcgttgaacaggccacggagcagcaaattcctgttactgggaatcaagggcgtg

SEQ ID NO: 94515 - protein, 212 aa, Zea mays
  misc_feature: Ceres CLONE 1584369
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (79)..(79): Xaa is any aa, unknown, or other
MASRRVVSSLLRSASRLRAASPAAPRPRGAPHRPSPAGYLFNRAAAYASAAAAQAAPATPPPATGKTGGGKITDEFTRXGAIGQVCQVIGAVVDVRYDEGLPPILTALDVLDNDIRLVLEVAQHLGENMVRTIAMDGTEGLVRGQRVLNTGSPITVPVGRATLGRIINGIGEPMDENGDITDNPLPPYHREAPAFVEQATEQQIPVTGNQGR

SEQ ID NO: 94516 - DNA, 878 bp, Zea mays
  misc_feature: Ceres CLONE 1584372
  misc_feature: Translation starting site: 158
aaaagctggagctccccgcggtggcggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccagctccctcctcacggcccccaagccctccgccgcggcctccgacctccccgagggcgctcagtggcgctacagcgagttcctctccgccgtcaagcgcggcaaggtcgggcgcgtgcgcttttccaaggacggcggtctgctccagctcaccgccgtcgacggccgccgcgcccacgtcgtcgtccccacgaccccgacctcatagacaaccttcgcaccaacggcgtcgacatctccgtctccgagggcgagtcggcgggcccggggggcttcgtcgccttcgtcggcaacctcctcttcccttttatcgcgttcgctgggctcttttttcctttttccgcccccccaaggggggggccccggcccccggggcctggggggcctcgggggggcccatgggaatttcggccgccttcaagaaacagagtttcccggaagggtgcccctgaaaaaggggtggtcacacctta

SEQ ID NO: 94517 - DNA, 1234 bp, Zea mays
  misc_feature: Ceres CLONE 1584375
  misc_feature (57)..(57): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
  misc_feature (1234)..(1234): n is a, c, t, g, unknown, or other
aatttgtaaaaccttcattttttatatcaatgcataactattttacgcattttaatntnnnncnccccaaactggaactccccgcggtggcggccgctctagaactagtggatcccccgggctgcaggaattcgtctcacccctagaaaaaataatcagtgctcagtgctcactaacccaagtcgccctaaacctagcccgggcacccgccagactagccagcccaacaacgcaaaacgcgacgcggccaccgccttgtccatgggctcctcggcgcagctcagggggctgaagcctctgtaccattggtggtgaacaatatcctgaccatcgtggccgtgccgctcgccaccccggtcctgctcaaagccgcaaaaacttggggccctacgagatctctggccggggtcagcatgctcatgccagagacaaaacctcctggcgggggttcctaccctgaatataacaaccccccccccccccgaaaccctcagttctagttcaccgagttaacttggtgggaacatagacatagtattcctcgaaccaaagccccaataaatggcggccttgccccattttcggcgaaaatttcccctatgaaaataaatatccccgctcgggagtgggtccgggggtatttctaaaacaagagtgccacacgggtttcccggagtttaaatgtagactgtactccaaatctttttaagaaatacatgatcaggcggtactatagtttgttgaataagaaagaccatatttttacttttatacccgtaaccagttcttctttgaagaacaataatagttataccttactgaccgtttctggtagggcggaggaagtacaagggaaagttggcctttcctccagtgatactccgcacttatcaccaaaaggatgcgtgcacgatcatttaattaattggcgaggctaactccataaacgaaaccactggtttaatcttatcacaatagaataatagtctgaggtgtcctccccctcagtgggtataatacaaaatacatcacctctggaggagggaacaaaattttttctatactttatcatacacggcccccacacagcccgcatttgtgtcactgtggtagaatagtgttaagttagaccgcgcctttatagtcctctgcgtcagatggaaaatatgacgatgattggatatatgatttttgggtgtaattgtcagcgttttataccggcggtggacttgcn

SEQ ID NO: 94518 - DNA, 772 bp, Zea mays
  misc_feature: Ceres CLONE 1584376
  misc_feature: Translation starting site: 343
  misc_feature (257)..(257): n is a, c, t, g, unknown, or other
  misc_feature (680)..(680): n is a, c, t, g, unknown, or other
  misc_feature (687)..(687): n is a, c, t, g, unknown, or other
ctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatcntcaccctcatcttcgtcttcgccggccaggggctccgggcatggcccttcagtggagttcctcccgcgggtccgcttcctaccccatggtggatgggcaaaaaaaaagggggttccaaattgggggcccccccgggctttggggcctttttaaaaaaaaaaaaacctttttttttgtttttccccccccccccccccccccgttttaaacaacggggggagcccccccccccccccccccaaaaaaaaaaggggtggtttgtcggacaaaagaaaaaaaaaagcacgcttattataaaaaaaaaaaagaagggggggtcctcgtggtttaaaaaaaaaaaaaaccccccccccccggggggggggtggaggaagaataaaagaagaaagggttgaccccggtgcccccccccccaccaaaaanagggtanaaaaaatttatttgtgtattagccccccccccccaccggggtgtgaggagagttaaataattttaaagtaggaggtgtagggggg

SEQ ID NO: 94519 - DNA, 960 bp, Zea mays
  misc_feature: Ceres CLONE 1584377
  misc_feature (365)..(365): n is a, c, t, g, unknown, or other
  misc_feature (383)..(383): n is a, c, t, g, unknown, or other
  misc_feature (494)..(494): n is a, c, t, g, unknown, or other
ctggagctccccgcggtggcggccgctctagaactagtggatcccccgggctgcaggaattcgtctcacccctagaaaaagcaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttggtctgattngtcatttgctggtgctcnaagccggcttgggttccctcaaggatcagcatctactcttgattgtggactttgtcgcatctgatatcaacttcataaatctttaatcaagatggcgctgcaaaacattgntgcttcaaacagggatgatgcctttctacaggtacaggatgccccgaatggtttcccagaatagaaggcctgggtaaagggtttcagaacaaaggtttggaaaatgggttgaaaatagaaaaaaagctttggcagggcgggttttttaacaaacacaagaattttggattgtgaacctggggccccacccccaatttttgggggaaaaagggggttttctcttggtttaaaggggttttatttaattgaaaaaggggggggggccccctgggggggttttccaaagaaaatctcccatgttgtgggggggggagaaacccgaaaaaagaatttttttctctaaaaacccaaggtattccctcaaatgtccccccgggggggctccccccgggggggtgggtggggggggacccccccccttttttttgaaaaccccccacaaaaaagggggggggaaaaaagaagg

SEQ ID NO: 94520 - DNA, 823 bp, Zea mays
  misc_feature: Ceres CLONE 1584378
  misc_feature: Encodes the peptide sequence at SEQ ID NO. 94521
ctccccgcggtggcggccgctctagaactagtggatcccccgggctgcaggaattcgtctcacccctagaaaaaatcttctccaccctctgcccctctcgatttcttcttcccatctcccgatccatcgcaacccaaaccctactccaggcagatctccgtctccgccgccgctgccggcgtgagcacagcatcagatccgctgtgatggcgttccgccgcatcctatccaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccgtaggaccgcatcgccgaggccgtcaacgccaggctccggcggctcgagcacccagacccgcgcttcctccgctacgccagccccgtgccgtcccacgcggaccacatggccatccttgcggcgccagagacccgggtcaccacactgcccaacggcctgcgcatcgccacggagtcttccctcgccgcgcgcacggctacggtcggcgtgtggatcgatgcgggcagcaggtactagaacgaggaggcggtcggcgtcgcgcattttgtcgagcacatgctgttcaagggcacggggaagcgcagcgccgcgcagctgggagctgagatcgaagacatgggtggggccacctaatgcgtacacgtcgcgggagcagacaacctactacgccaaggtgcattgacaagtacgtgccccgtgccgatggaggttctctcggaacatcctccagaactcctatc

SEQ ID NO: 94521 - protein, 43 aa, Zea mays
  misc_feature: Ceres CLONE 1584378
  misc_feature: SWISSPROT Homolog: EC 3.4.24.64 Mitochondrial processing peptidase
MAILAAPETRVTTLPNGLRIATESSLAARTATVGVWIDAGSRY

SEQ ID NO: 94522 - DNA, 965 bp, Zea mays
  misc_feature: Ceres CLONE 1584379
  misc_feature: Encodes the peptide sequence at SEQ ID NO. 94523
tccccgcggtggcggccgctctagaactagtggatcccccgggctgtatgaattcgtctcacccctagaaaaaagggagcttcatccaacagcccaagtgtccctgctacccccactggatcagcaagctagctacccaggccagtgccagagccacagcggaagctagctagctagcaagcaatggctgcggcggctcctcctgctcgtcctagcagcagctgctgccgctgcatctcgcggcgcgccgccgtcgtcgtgccggcactgctgctgctggcggcgatggccgcctcctccggcgacgcgcacccttccccggggtactacccgagctccaggttcaggccggtgccgatcaaccgagcgtacaccaacaagtggggcccgcaccaccagacgggctccggcgaccattccgccctcagcatctggctcgacaagacctgagggagtggtttcaagtcggatcgcgcctacaggaacggctacttctccactcgcatcaagctccccggccagataccacgccgggaccaacatcggcatctatctctccaacaacgaggtcgcaccctggtttccacgacgaagacctgacagggaagtttcctgggcccccatccccgggggggaacccctacacagctgggggactaaaacgtggtacgttgcgccgggcagccggaatacaggaacccttctatagtgggtggggaagaaggtggaatccaccctagtggggtagaaccccggaggcgggccgttctcaaacctaacggcaatccgggggggaaagccccagaactccagtaaccatttctttgaggggggagaaacttagtccggatccaccgagagtagaaagcctccgccacccgaggcctcgacctttccctcgtgaccggcgccgaagggggagtccttaggcggcctctatgcttggggagaaccgcttccacaag

SEQ ID NO: 94523 - protein, 88 aa, Zea mays
  misc_feature: Ceres CLONE 1584379
MAAAAPPARPSSSCCRCISRRAAVVVPALLLLAAMAASSGDAHPSPGYYPSSRFRPVPINRAYTNKWGPHHQTGSGDHSALSIWLDKT

SEQ ID NO: 94524 - DNA, 862 bp, Zea mays
  misc_feature: Ceres CLONE 1584380
  misc_feature: Encodes the peptide sequence at SEQ ID NO. 94525
  misc_feature (644)..(644): n is a, c, t, g, unknown, or other
  misc_feature (685)..(685): n is a, c, t, g, unknown, or other
  misc_feature (686)..(686): n is a, c, t, g, unknown, or other
ctggagctccccgcggtggcggccgctctagaactagtggatcccccgggctgcaggaattcgtctcacccctagaaaaaacactttttcctggcaaaccctgcacgcctccgcaaccgcaaccgcgtcgtcggcgtgcgcgatcccgagaggcccagccatcagcttccttggcggggtgtgtatgcgcgtacgtcggccgtgaccagatcggctgagccaaggccatggcggaaccggccctcctcgcgccggaccccttcgcggacctccccttccccgaatttcaggcgcccatcgacggcgacagcttcgcgctcgaggacttcgatctggaggatctggacctggacgtggacttcgacctcgacctcttcgcctcggacgggcaaccctcgcaaccgcccccgctcgcgacctcgtcctcctcggccgggtctccggttggaggctcgtcctcttccggtgccgtcggggacggcggagggctgaggaatgaggagtcttcggagtcgtcttcgaggagcgcgagcggcacggatggcagcggcaaggggaaggccgaggaggaccaagcgaagcggcacgcgcggcatgtacgcaaccgcgagagcgcgcacctgtcgcggcagaggaagaagcantacgtggaggaattagagggtaaagtgaaggccatgcaggnncacatcgccgacctcatcggcaggatctcctgcgataacggcggagaacgccgctctcaaacatcaagctgggtggcggctgctgggggcccggcccctcgcctatgccggatgttcccccaagatggattcttttgaccaatgcccggggatttccaccattccgtttcccatga

SEQ ID NO: 94525 - protein, 198 aa, Zea mays
  misc_feature: Ceres CLONE 1584380
  misc_feature (114)..(179): Pfam Name: bZIP_1 Pfam Description: bZIP transcription factor
  misc_feature (139)..(139): Xaa is any aa, unknown, or other
  misc_feature (153)..(153): Xaa is any aa, unknown, or other
MAEPALLAPDPFADLPFPEFQAPIDGDSFALEDFDLEDLDLDVDFDLDLFASDGQPSQPPPLATSSSSAGSPVGGSSSSGAVGDGGGLRNEESSESSSRSASGTDGSGKGKAEEDQAKRHARHVRNRESAHLSRQRKKXYVEELEGKVKAMQXHIADLIGRISCDNGGERRSQTSSWVAAAGGPAPRLCRMFPQDGFF

SEQ ID NO: 94526 - DNA, 906 bp, Zea mays
  misc_feature: Ceres CLONE 1584381
  misc_feature (53)..(53): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (79)..(79): n is a, c, t, g, unknown, or other
  misc_feature (81)..(81): n is a, c, t, g, unknown, or other
  misc_feature (82)..(82): n is a, c, t, g, unknown, or other
  misc_feature (113)..(113): n is a, c, t, g, unknown, or other
  misc_feature (114)..(114): n is a, c, t, g, unknown, or other
  misc_feature (116)..(116): n is a, c, t, g, unknown, or other
  misc_feature (117)..(117): n is a, c, t, g, unknown, or other
  misc_feature (144)..(144): n is a, c, t, g, unknown, or other
  misc_feature (145)..(145): n is a, c, t, g, unknown, or other
  misc_feature (234)..(234): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (346)..(346): n is a, c, t, g, unknown, or other
  misc_feature (347)..(347): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (385)..(385): n is a, c, t, g, unknown, or other
  misc_feature (387)..(387): n is a, c, t, g, unknown, or other
  misc_feature (388)..(388): n is a, c, t, g, unknown, or other
  misc_feature (392)..(392): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (452)..(452): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (492)..(492): n is a, c, t, g, unknown, or other
  misc_feature (493)..(493): n is a, c, t, g, unknown, or other
  misc_feature (499)..(499): n is a, c, t, g, unknown, or other
  misc_feature (526)..(526): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (574)..(574): n is a, c, t, g, unknown, or other
  misc_feature (575)..(575): n is a, c, t, g, unknown, or other
  misc_feature (588)..(588): n is a, c, t, g, unknown, or other
  misc_feature (598)..(598): n is a, c, t, g, unknown, or other
  misc_feature (603)..(603): n is a, c, t, g, unknown, or other
  misc_feature (604)..(604): n is a, c, t, g, unknown, or other
  misc_feature (623)..(623): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (681)..(681): n is a, c, t, g, unknown, or other
  misc_feature (682)..(682): n is a, c, t, g, unknown, or other
  misc_feature (707)..(707): n is a, c, t, g, unknown, or other
  misc_feature (726)..(726): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (760)..(760): n is a, c, t, g, unknown, or other
  misc_feature (766)..(766): n is a, c, t, g, unknown, or other
  misc_feature (771)..(771): n is a, c, t, g, unknown, or other
  misc_feature (782)..(782): n is a, c, t, g, unknown, or other
  misc_feature (785)..(785): n is a, c, t, g, unknown, or other
  misc_feature (823)..(823): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (850)..(850): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (860)..(860): n is a, c, t, g, unknown, or other
  misc_feature (883)..(883): n is a, c, t, g, unknown, or other
  misc_feature (888)..(888): n is a, c, t, g, unknown, or other
  misc_feature (889)..(889): n is a, c, t, g, unknown, or other
gagctcaccgcggtggcggccgctctagaactagtggatcccccgggctgcangggaattcgtncnntcaccccctagnannaaaaatcacacagcgccaccgcgtggttcgnntnntaagggaaagggaaatcgattcccccnngcatccgaatctcttcggtgctagagaatataggccgccgcctcctcctcattcggtgaaaggtgggcggttagggttgggagatctcnttgactcacgacacggagcaggcaggaatttcgttcgaagggggcccccccttgggggttttgtcctctcccccaaaaaaaaaagaannncggggggggggcgggctgaggnntgcacnnnnnnntaggnnnaggggagggnnnnnnaggngnngggngaggggtggggaagggnnnnnnnagagaggaagnnnnnnntatgatgaagggacnnncgngggaggggaggggggagagagannnaggannnnnnnnntnngggagngggggggggtgggggcccccctagtgntttggggggggggaggacgctcccccccccccccccccccccnnnncnngggggggaggaanaaaaaagaanccccnncccccccccccgcgaggcngggtgcaaaaagccnnnnnnnaaaggggggggnnntagggggaancnngagttctctnntcttctcccccctcctgtggggcgncggggcggggccccgcccncnnnnagaggaggagaagaggagnnnagccgcgnactttntgttnttgtttttttntgncgaggcccctcctgcccccccgcgaaagaaggaagaanagtannnnagaagaggtttgttttttntnnntagagnaagggtattatggtgtgtgtttnttcgnnttggggtcgatgtgtgg

SEQ ID NO: 94527 - DNA, 903 bp, Zea mays
  misc_feature: Ceres CLONE 1584382
ctggagctcaccgcggtggcggccgctctagaactagtggatcccccgggctgcaggaattcgtctcacccctagaaaaattcccgtagcttcctcgcgatcattacattcgatctcatccacgaacaatgcttgaacgggatgcacaccggtcctcactatctattccacacctcatggcgccggtgctgagcaggaccctgggcccgtattctgtggccgcgctgctcccgaacccgtcgtgacggagtctgctacgtgtcgcgctcgtgccgcaggctatgggcccatccacgaggtgcgcggtctgccgtgatatgggaggcagcacatcggagaacgatggccggcgtgacgtgcggcgcctacgtcgctgatgaccctgtcggccagcaggacacccccccgcgagaagtacgaatacaccccctgaggttaccctgcttgatggacatacattgttccaccatttatacacgtcacaagctaagtatttttcacgtgagccttgctatctaacgcggagtgaatgctacctgtagaaaggctgaagaattccttcagcggtaacttgaattcttcctagtctttgggacttaatgggtgggcggtactttggcaattttttgggggaatggaaatctcccgaacccttaaaaagggggggggggaaaaaaaaatttgctttttttgtgtgcgcggaaatataatatggggggtgttttttgggagtgatttttttaaaaaaaaaaaaggggtgggaagaaaaacctctctttgtgaggaaacaactgcttttggagaaaggggtgggggcccccgcccgccctcataatattttttgtcagaaagaggggtcttctctgttgggatgagaaccaataacaaacacccccctctgag

SEQ ID NO: 94528 - DNA, 876 bp, Zea mays
  misc_feature: Ceres CLONE 1584384
  misc_feature: Encodes the peptide sequence at SEQ ID NO. 94529
  misc_feature (738)..(738): n is a, c, t, g, unknown, or other
  misc_feature (803)..(803): n is a, c, t, g, unknown, or other
  misc_feature (876)..(876): n is a, c, t, g, unknown, or other
ctggagctccccgcggtggcggccgctctagaactagtggatcccccgggctgcaggaattcgtctcacccctagaaaaaccccctcctctcattccattccacccacgccgcctgcctgccccctcgcctcgggggcgaaccacgagaaggggattccggctagggtttcgcggatcgagaagagtcagggaagaagcggggggagagaagagggcggcacctagggtttccgcgggcggcccccccgcatggcctcgccagctgcagcggcggcggcggcgccaccgccggccgccaaggagaaggagaaggacgcggaggaggcaccggtcacgggggacatggtcagcgccggcttcgcagagctcgagcgccagcagcagctgctggccacctgcacgcgcctctaccagcagctgtccgaccacttcggctcgctcgagcgggggctcgcggcgcgctccgacgcgctccgcgtccgccgcagggccttcgacgcgcgcacccaccgcgcgctcgactcgctccaccgccgggaggcctccatcgacgcctccgtctcgcgcgcgctcgaccacctccactccatctccgcctccgcctccgccgccgccgccgcttcctccaaggcccccgccacctccgactccgactccgagggcctcgccgagagcctgcgcgcgctgtgcgcgcggatggactccgccgcgttcctgggcttcgtggtggcccgccngcaggaggcggacgcgctgcgggccgagatgccgccggcgctcaagctctgcgtggatccggccnagttcgtcatggacgccgtcgccgacgtcttccccgtcgaccgccgcgaggtccggaaccccgtcggactgcn

SEQ ID NO: 94529 - protein, 208 aa, Zea mays
  misc_feature: Ceres CLONE 1584384
  misc_feature (163)..(163): Xaa is any aa, unknown, or other
  misc_feature (185)..(185): Xaa is any aa, unknown, or other
MASPAAAAAAAPPPAAKEKEKDAEEAPVTGDMVSAGFAELERQQQLLATCTRLYQQLSDHFGSLERGLAARSDALRVRRRAFDARTHRALDSLHRREASIDASVSRALDHLHSISASASAAAAASSKAPATSDSDSEGLAESLRALCARMDSAAFLGFVVARXQEADALRAEMPPALKLCVDPAXFVMDAVADVFPVDRREVRNPVGL

SEQ ID NO: 94530 - DNA, 922 bp, Zea mays
  misc_feature: Ceres CLONE 1584388
  misc_feature: Encodes the peptide sequence at SEQ ID NO. 94531
  misc_feature (714)..(714): n is a, c, t, g, unknown, or other
  misc_feature (715)..(715): n is a, c, t, g, unknown, or other
  misc_feature (721)..(721): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (744)..(744): n is a, c, t, g, unknown, or other
  misc_feature (824)..(824): n is a, c, t, g, unknown, or other
  misc_feature (869)..(869): n is a, c, t, g, unknown, or other
  misc_feature (877)..(877): n is a, c, t, g, unknown, or other
  misc_feature (893)..(893): n is a, c, t, g, unknown, or other
  misc_feature (894)..(894): n is a, c, t, g, unknown, or other
ctggagctccccgcggtggcggccgctctagaactagtggatcccccgggctgcaggaattcgtctcacccctagaaaaaaaacgggagggtgggcgagcctgctcttcctgtctgggagagagaccgaagaagaggagagagaggcgcagcgcagcgcaggcgcgcatctcccccctccccttgccggctggcccctgctgcagctctgctccggtcggctctgcccccccgctctgctgactgctctgccgctgctgctgtcgcaggcgcgccaccaacccgccgatgcgcgcgtagcggcgtaggtaccatcatcatccatccccgcgacgacccaccacccacccctgcagtctgcagcatccccttccccactcccggctggtctgctgcggccacccctgcgccgatccacctccgctgcttcctgcctcaatatattcgcccgcctcgtcgcctccgaccccgccacagaaggccttccagaaccctccgacccctcacctccgctccgccccgctccactctcctcctcccgggccggccgactccgatggccgtcgtcgaggccgccgcagccgaccacgccgcgccgccgctccaggaggaggcaccgggcgcgggcgctggcgctggcgccgacgccggggagcgcgagatgcgggatctggaggacctgctctccaagctcaaccccatgggcgaggaggtnngtccgncctccnnntcgctccccgcgccntcacgccgcggccgctctcccggggcgctacggcttctaccctgccgggcgccgcttcgcggtcgcctcgccggggcacngcggcgtcgtcggctttccggccgtcgcggacgccacgtcccacnaggcaggnagaaaggcgggacccnngagagggttccagcgcccccgccaccca

SEQ ID NO: 94531 - protein, 122 aa, Zea mays
  misc_feature: Ceres CLONE 1584388
  misc_feature (54)..(54): Xaa is any aa, unknown, or other
  misc_feature (56)..(56): Xaa is any aa, unknown, or other
  misc_feature (58)..(58): Xaa is any aa, unknown, or other
  misc_feature (90)..(90): Xaa is any aa, unknown, or other
  misc_feature (105)..(105): Xaa is any aa, unknown, or other
  misc_feature (108)..(108): Xaa is any aa, unknown, or other
  misc_feature (113)..(113): Xaa is any aa, unknown, or other
MAVVEAAAADHAAPPLQEEAPGAGAGAGADAGEREMRDLEDLLSKLNPMGEEVXPXSXSLPAPSRRGRSPGALRLLPCRAPLRGRLAGAXRRRRLSGRRGRHVPXGRXKGGTXERVPAPPPP

SEQ ID NO: 94532 - DNA, 808 bp, Zea mays
  misc_feature: Ceres CLONE 1584390
  misc_feature: Encodes the peptide sequence at SEQ ID NO. 94533
  misc_feature (401)..(401): n is a, c, t, g, unknown, or other
  misc_feature (654)..(654): n is a, c, t, g, unknown, or other
ctggagctccccgcggtggcggccgctctagaactagtggatcccccgggctgcaggaattcgtctcacccctagaaaaattctccctccggcctcacactctctttctcgcccgtcccacctcttttcgctgataagcacgccgccttctccagcccgtccacccccgccgctgcaggtcccgggcgctgctccccaccaccggcggaaaaatgtcgacggagtgttcggacctcggggacgagttctggctgccggaggagttcctggacgacgacttcttctccgaggaggagaaggcggccgtggcggccaggagcgagagcgacgaggaggacagcctggcggggctctcgcgcaggctcgcgggcctcctcggcgacgacggggagcggacaccncctaccgccaaggcggaggtggcggtgattgggtcgccgcagtcgacgctgtgcgggctgcccaagtcgggccaggagagccccaacggcggggcgtccaaggggacgtcgccgccgtcgtcgccgcctctggagcagaagccggccgacccgtgggacgtcctgtacgaggcggcggggcaggtcgcacgcatgcgcgccgccagcagcgtgccggccaacgcctacgccttcagcaagccatcccccgcgncgcccgcgatcgctccgcccctcctcgcaagggtcctgccgggcgcggcggtcactaccacccgctcgcgcacttggtttcgcagcgccagatgcaggctgctcagttccatctcctgaagcagcatcagctgctgaagctgcagagggagccc

SEQ ID NO: 94533 - protein, 186 aa, Zea mays
  misc_feature: Ceres CLONE 1584390
  misc_feature (148)..(148): Xaa is any aa, unknown, or other
MSTECSDLGDEFWLPEEFLDDDFFSEEEKAAVAARSESDEEDSLAGLSRRLAGLLGDDGERTPPTAKAEVAVIGSPQSTLCGLPKSGQESPNGGASKGTSPPSSPPLEQKPADPWDVLYEAAGQVARMRAASSVPANAYAFSKPSPAXPAIAPPLLARVLPGAAVTTTRSRTWFRSARCRLLSSIS

SEQ ID NO: 94534 - DNA, 1063 bp, Zea mays
  misc_feature: Ceres CLONE 1584398
  misc_feature: Encodes the peptide sequence at SEQ ID NO. 94535
  misc_feature (35)..(35): n is a, c, t, g, unknown, or other
  misc_feature (65)..(65): n is a, c, t, g, unknown, or other
  misc_feature (69)..(69): n is a, c, t, g, unknown, or other
  misc_feature (70)..(70): n is a, c, t, g, unknown, or other
  misc_feature (87)..(87): n is a, c, t, g, unknown, or other
aaacaaacaccacatcccccccataggtgatcctnattgggggggggggggggtgcccccccatntttnncaaactgggactccccncggtggcggccgctctatactagtggatcccccgggctgcatgtattcgtctcacccctagaaaaacaagctcacgcaggacgggtgcattgtttgtccatcaacagacagcacatttgaccttcgcaccggggagataaaagaatggtatccgaaaaaccctgtcctacgggctcttacgccagccttgaggaaactattcacctaccgcgtgaaaacagacgaagaaaacatatacatcagcttcagcggggccgatggtacggggtcagcggagattatattcagcgggaaagctcagcctggtgtgactgcatcggatgtcaatgtggaacaggtgaggatggtcgtcgacgaggatgtcggaggcttcggcttcaccagtgacaacgagctgatcaacggaaaagccgccataatcggcttcctcctgctgatagatttcgagcttctaaactggcaagggccttctcaaggggacggggttcttggacttcatctacgcagtttcgggtgctttcaactgagagtcatgtgtgttttgttggttcgtatccttgggaactcccctccgttccctttttaaattggtccccgaggaaagacgaaaaacgagcttgatatagtcaatctgcaggaggggtagaaatatagacaccggggaaagccccttatgtctcggtcatatccttatctgccacgcaagcaaaacgaagacggaagcctggcacgcagaatgtcaaacatcccggtgatggtaaactcctttaccaactaattgtacgttccgaatttccacgggagcgttgaggtcaaaccacctcacgaggaacgactctcacagtagcgagaagacacccaacagaccagtgttatcaagaatacgatcttaaagtgtcaaaccccaccccagacctaaccccgcaccccaacacttggcgcgcggggtgggaggtgacaagaaaaggggtgtacg

SEQ ID NO: 94535 - protein, 80 aa, Zea mays
  misc_feature: Ceres CLONE 1584398
MVVDEDVGGFGFTSDNELINGKAAIIGFLLLIDFELLNWQGPSQGDGVLGLHLRSFGCFQLRVMCVLLVRILGNSPPFPF

SEQ ID NO: 94536 - DNA, 726 bp, Zea mays
  misc_feature: Ceres CLONE 1584399
  misc_feature (598)..(598): n is a, c, t, g, unknown, or other
tggagctccccgcggtggcggccgctctagaatagtggatcccccgggctgcaggaattcgtctccccctagaaaaaccgaacacaatctcatccgtcttcctcttccccatcagccgccctaccgagtcttcgcacgcacgacgcttcgtcaggatcgattcgcgagacctctcctgtccggatcgaggttcatggtttacatatgcgcgtttgtttactgatgcataccacggacaccttgattcggatttcaggacaggattccccggctttaaatcggggccccgtttcagggtttgaaaattctcccctttttttccggggacctttttttaaaaaaataaaaaagggggtttttcccggggttttttaaaaaaaaaaaacccccccccggttttttttttttttttttttttcccccccaaaaaaaggggggtttcccccccccgggggggggtaataaaaaaaaagccttctccccccccccggggggggggggcccccccaaaaaaaaaaaattttttttttttggggggggggcggccctcttgttttttataaacaaacaccacccccccgccgggccctttttcggngctcactctctttttttttttttttttttctcctcccccccgcccggggagggatgtgatttatctcctccccacaccacaaaccacgatggtggggggagggtgggaaagaaaattctcttctttct

SEQ ID NO: 94537 - DNA, 950 bp, Zea mays
  misc_feature: Ceres CLONE 1584401
aaagctggagctccccgcggtggcggccgctctagaactagtggatcccccgggctgcaggaattcgtctcacccctagaaaaaatcagttttctcatctcagctcagctagctttcccctcccttgcaactgcaagcttgcccaacccaataagctaagcaagcacgcaccatacacactctctagtagctagctaagctagccggccgcccctcctcgcacgcgtgcgcgcaccagcatctatcatcagagctagccacgaaacggatcggagcagcagatctcgatcggcggcccacatgggggatcacgctgagatgttgcatgccgctccggccatgtacaacggcgctggcgctgcccactgatggacgggtggtggaatacagcggtgcccggtgacgacgtgctccacgacggagctgagctgggttcaccacgttggtccgtccgccctggatgctagatacaacctgtgcgggcgaaggggacaaaacgcaagaagcgctgccccgcctccttccagaaacccccccgggaaaaacaaccaaggtcccggggaacaccttccaaaaagaaaccccagtaccctactcccatttgaaaaaagggatatatcctttacctactggactatattttggttagaaacaccaccccccccccgagaagggaaaataatctacaataagaaacgaaaaagagatttttccacaataatacagccttattacaccacacaactagaaaaaaaaactaccatggcaacaaaaaaaaaaagagaggagatgggttacattaaaaaataaatacgaacaagacacaagattaaaaacaagcacacccaaggcaacagataaaagagaacaactaaaataaaagatgaaaggcacgcaaggcgaacagccgcgcaggggggagcaagaatgaccctggaggcgcatggatg

SEQ ID NO: 94538 - DNA, 801 bp, Zea mays
  misc_feature: Ceres CLONE 1584408
  misc_feature: Encodes the peptide sequence at SEQ ID NO. 94539
  misc_feature (723)..(723): n is a, c, t, g, unknown, or other
ctccccgcggtggcggccgctctagaactagtggatcccccgggctgcaggaattcgtctcacccctagaaaaaagcacgtcggggaagggaagcaagcgtccgcgagtaaggacagaaaaccgaagggaggagtggagaggaggagcttgcttggagcgggtggacgggtggtgtgtatatagttaagcgggcgggcgggcagccaatgccgtcgggcgcgcagggctaggagcatgggcggagggggcgcgatcgtgcacggcttccgccgctggttccaccgccggagcgaaggctccacctccaactccaaccagccgtccctcgccggcgagggggaagcggacgacggctcatccgatctcgaggtcatcgaggacccggatctcctcggcctccgcgccatccgcgtgcccaagcgcaagatgccgctgcccgtcgagagccacaggaagaactcagtagaaatggagttcttcacagagtacggagaggcaagccagtaccagatccaagaagtcattggtaaagggagctacggagtagttgctgcagctgtggacacccgcaccggtgagcgggttgctatcaagaagatcaatgatgtgtttgagcacgtctcggatgccacacgcatactgcgggagatcaagctcctccggttgcttcgtcacccagacatagtcgagattaagcacatcatgcttcctccttctcgganggagttccagacatctatgttgtttttgagctcatggagtcggatctcccatcagtgatcagcgatatactactactc

SEQ ID NO: 94539 - protein, 181 aa, Zea mays
  misc_feature: Ceres CLONE 1584408
  misc_feature: SWISSPROT Homolog: EC 2.7.11.24 Mitogen-activated protein kinase
  misc_feature (163)..(163): Xaa is any aa, unknown, or other
MGGGGAIVHGFRRWFHRRSEGSTSNSNQPSLAGEGEADDGSSDLEVIEDPDLLGLRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRXEFQTSMLFLSSWSRISHQ

SEQ ID NO: 94540 - DNA, 822 bp, Zea mays
  misc_feature: Ceres CLONE 1584409
  misc_feature: Translation starting site: 178
  misc_feature: SWISSPROT Homolog: EC 1.3.5.1 Succinate dehydrogenase (ubiquinone)
  misc_feature: SWISSPROT Homolog: EC 1.3.99.1 Succinate dehydrogenase
ctggagctccccgcggtggcggccgctctagaactagtggatcccccgggctgcaggaattcgtctcacccctagaaaaagttttcgtctccacagccgctctcctttgcaatctccgacaccgctcgtctccccgtatcgtgggcaacccccctcccctgcgagatccggggcgcgatgtggcgcagctgcgtctcgcggggcctctccaggggcaaggcatcagcctgcaggctcctctccacggcgtcgacggcctacacggtggtcgaccactcctacgacgcagtggtggtgggggccggcggcgcggggctccgggcggcgatcggcctctccgagcacggcttcaacaccgcatgaatcagcaagctctgtccccacgcgctcgcacaccgtcgcggctcacgaaggcataaatgctgcacttggaaacatgagtgaagatgactggaggcgggatatgtatgacactgttaagggaagcgattggctgggtgaccaggattcgtattcagtataggtgcagagagacaccaaaagctggtatagagcttgagaactatggactaccattttcaagaactgaagagggaaagatataccaacgtgactctggagggcagagcatagattttggcaaaggaggacaagcctaccgttgtgactgcgctgctgacagaaaggacatgctatgctgcacgatctatatggtcaagcaatgaagcacaccacgcaattttttgtggaatacattgctctcgagcttatcatggagcatgcacggaagagtcaggtaatcattaccgtttacatggagga

SEQ ID NO: 94541 - DNA, 1039 bp, Zea mays
  misc_feature: Ceres CLONE 1584410
  misc_feature: Encodes the peptide sequence at SEQ ID NO. 94542
  misc_feature (1039)..(1039): n is a, c, t, g, unknown, or other
aaagctggagctccccgcggtggcggccgctctagaactagtggatcccccgggctgcaggaattcgtctcacccctagaaaaactctctttccagccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtggggaagggatctgtttcccgctggttaccggaagcctttcaaggggaatcacaacagagtcggttgtaagtcggctgggggcttcgcaagggtccttgcgcaaagctccagaaaacttgtaaaagaccccaactttgtttgagggcaaaaattcataaaattggtctggttaaacaagtggggtctcccggaaaaagggttccgaaaacctctttggggaaaaaaagcccccgaacctagtcaagggaatttacccctaaaaaaagaagttggggaaccccttcagcgcaggaatatttttgggggaagaaaggtaattcaaaacacaggggattcttgggttttgggctaactgaaaaaatcctggaatttcgggctccaggggctggaaatactctcccggataaagagggtttcctctccccctttgaaacccccaaccacagaagtttcctcggtttatggccgcccggggagcttcccccccttagaaatattttgccaacactccaggagcgttgggaatcttcgccttaaaaacatttcctgtgttatattctcatcttcgcccaattggagaaaggggggcctatatattcaaaaaaacttctttgtttatggggaaaan

SEQ ID NO: 94542 - protein, 68 aa, Zea mays
  misc_feature: Ceres CLONE 1584410
  misc_feature: SWISSPROT Homolog: EC 1.1.1.86 Ketol-acid reductoisomerase
MPSLDFETSVFKKEKVSLAGHEEYIVRGGEGICFPLVTGSLSRGITTESVVSRLGASQGSLRKAPENL

SEQ ID NO: 94543 - DNA, 1160 bp, Zea mays
  misc_feature: Ceres CLONE 1584412
  misc_feature: Encodes the peptide sequence at SEQ ID NO. 94544
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (17)..(17): n is a, c, t, g, unknown, or other
  misc_feature (55)..(55): n is a, c, t, g, unknown, or other
  misc_feature (59)..(59): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
nnttttttnnttttttnaaaggggggggccattttttattatattttattgttanacantnnngtgtnnnntccaaaactggagctcaccgcggtggcggccgctctagaactagtggatcccccgggctgcaggaattcgtctcaccccctaaaaaaactgctggccaagatcgtgcatttcgtcttttctcagttatccaggatcaacaaagtagagagctttctcagaggcatgtcgcaaaaagagcaaaaaaactaaaagtaaaggaggaagagatgaagctaaaacccagttgttacatttgactgtgcagagatacatgcacgtgactggtggaatgttgtcacatgccacatggatactcctcgggcatatggatggcgtcttcaaaacctttgatattggggaaaatgttttgacccccatcattaagccctgtgaccccccatttacggcttatgtggataaatgcgatgtgggaaattttctacctaacctggggacctgcaagggggttggaatttaaaaaaatttttaacctttcaatccggggtttaaagtcagggggggggtaaagcgtttggaaaccccccgctggggggaaatgcgaaatggtgccccaaaggagcggaagggaaaattgtggtagggaaaattaaaccttgtgccaagaggccaccggaaacgaccgcggcgtttatctaaaatttaagagggggggggggagaaaaacacaaccggggtgggaggtttattaaaaaggggcacttgtgggtgatgtttttataataaaaatacttttgcgactggtgctgggaaaaaacatctccatacagaatgtgggagagttcgttgggttaacaaaaccttccagctgaggtttaaaacaatcggcggctgtgttgttccgaccgcgcggcacaaaaaggggggctcccatcctttgcccccaccgcggacctgtgcaggggagggagagaggggggtaccaccaccacaggcgggggttgtgcaatacccgcaggtctcacctctaaaaaacatggctgtcccccgcaaaaatttcataaagagaaatattacggagagtacatatctatatcggtaaagttttggagctatatcgggctaagacgggtgtggtaaaatatggtcct

SEQ ID NO: 94544 - protein, 101 aa, Zea mays
  misc_feature: Ceres CLONE 1584412
  misc_feature (3)..(3): Xaa is any aa, unknown, or other
  misc_feature (5)..(5): Xaa is any aa, unknown, or other
  misc_feature (18)..(18): Xaa is any aa, unknown, or other
  misc_feature (19)..(19): Xaa is any aa, unknown, or other
  misc_feature (20)..(20): Xaa is any aa, unknown, or other
  misc_feature (21)..(21): Xaa is any aa, unknown, or other
  misc_feature (23)..(23): Xaa is any aa, unknown, or other
FFXFXKGGGHFLLYFIVXXXXVXSKTGAHRGGGRSRTSGSPGLQEFVSPPKKTAGQDRAFRLFSVIQDQQSRELSQRHVAKRAKKLKVKEEEMKLKPSCYI

SEQ ID NO: 94545 - DNA, 880 bp, Zea mays
  misc_feature: Ceres CLONE 1584420
  misc_feature: Encodes the peptide sequence at SEQ ID NO. 94546
ctggagctcaccgcggtggcggccgctctagaactagtggatcccccgggctgcaggaattcgtctcacccctagaaaaaacgtagggaggggattggagacgccgagctccaccggaggcgaaggcggaggcgcgtggcgcgccctcggactcctcgctggacaaaatggaccttgcacctcagggtttgataacacagcaacaaaaggcaaatgagcgaaggccagttggtagctcacaaatttggacacggtatggtgttctgcttccaagccagcagactcgaaagctaaaagaatggattctgactgatgagcagcaacagcttgttaatgctagtggtcttggacatctggcacttaccactgggtttaccattgaccgttctttgctgacatcccccccccaaagatggaataatgaaacaaatactgcacatttcatgggatttgagattgcgccttcacttcgtgatgtttcatatattcttggcattccagtgactggtcatgtggtgaccgcagagccaattggtgatgaagctgtgaagcggatgtgcttgcattatttaggaaagagccctggaaatggagagcaactgtgtggcttaattaggctgacttggttgtataggaattttcatccacctacctggaacatccaacccatcaataagattggcatatagcaaccccaagcttatcttttctatacccttggtgtgggttccaaccctttgttttcctggaacaccactggaagggggaattttgtttatccccccaaggattttcttataccccctgggttgggcacaaaatttcttgggggaaagaaatccccgtggaagatatatccacttggaggggagaggtctct

SEQ ID NO: 94546 - protein, 173 aa, Zea mays
  misc_feature: Ceres CLONE 1584420
  misc_feature (70)..(119): Pfam Name: DUF1723 Pfam Description: Protein of unknown function (DUF1723)
  misc_feature: SWISSPROT Homolog: EC 3.1.3.16 Phosphoprotein phosphatase
MDLAPQGLITQQQKANERRPVGSSQIWTRYGVLLPSQQTRKLKEWILTDEQQQLVNASGLGHLALTTGFTIDRSLLTSPPQRWNNETNTAHFMGFEIAPSLRDVSYILGIPVTGHVVTAEPIGDEAVKRMCLHYLGKSPGNGEQLCGLIRLTWLYRNFHPPTWNIQPINKIGI

SEQ ID NO: 94547 - DNA, 816 bp, Zea mays
  misc_feature: Ceres CLONE 1584421
  misc_feature: Encodes the peptide sequence at SEQ ID NO. 94548
ggagctccccgcggtggcggccgctctagaatagtggatcccccgggctgcaggaattcgtctcacccctagaaaaaacgtctagtcgtcgatacgcctgaaccccagctttccactcgcctcgctcgcccctttcgcgtccaccgaccccgaccccgaccccgatccccgccggtgcttcgccaccccgatccccaccgcgcgatggcggagccggctccggctcccccggtgaccgcgccgctgggggggctgctgtacgacgagcggatgtgcgcgcacgcgacgcccaacggggaggaacacccggagaaccccgagcggctgcgctccatctggcgcaagctcaacgccgcgggcgtcgcgtccaggtgtgtggaccttaaggcaaaggaagctgaggacaagtatatatgcttctgttcacagcaagaggcatataaagctgatgaaggaaattagctcaacaatatatgatgccaacaggaacaagattgctaggaaattcaattccatttacttgaataagggttcctcggaatctgctgtgcttgcagctggttctgtcatagaggtagctgagaaagttgctgcaagtgagttaagttctgctattgctctagtcagacctccaggccaccatgcagaacatgatgaggctatgggattttgcctcttcaacaatgtggcagttgcagataattatctcttaaacgagaggcctgatttaggtatcaagaatatattgactgtctattgggatgttcaccatggaaaatgcacacaccaacatgttttactatgatcctcatgtat

SEQ ID NO: 94548 - protein, 118 aa, Zea mays
  misc_feature: Ceres CLONE 1584421
MKEISSTIYDANRNKIARKFNSIYLNKGSSESAVLAAGSVIEVAEKVAASELSSAIALVRPPGHHAEHDEAMGFCLFNNVAVADNYLLNERPDLGIKNILTVYWDVHHGKCTHQHVLL

SEQ ID NO: 94549 - DNA, 1076 bp, Zea mays
  misc_feature: Ceres CLONE 1584424
  misc_feature: Encodes the peptide sequence at SEQ ID NO. 94550
cttagctggagctcaccgcggtggcggccgctctagaactagtggatcccccgggctgcaggaattcgtctcacccctagaaaaaatcgccagggcgcccgatcgtgagcgagctcattctccacgcgacccaagagctatgattcctccatctccccttctctggcctccggcagcccgctgacagatgcaggcgaatcccaagatcaccttcaccatcaaagtggaggacggcaagccccgaaacgacagctcgatcgcgagcggaccagtgttccagagcggatctgaccgaggatcggttcccccaccttgagcctgacatgaagacggtccgggacattgttcagggcagcaagcgctccagcatgcccacaaccgggaagctcagatggcctgccctcccaccacggaaggcacaggggccctacttcgtgtacataatcgcgtgggagagccacgacaaagctgttgacaagcgcgggatctgcggtaggcacaaagctggcgagcggcgcgcccggtgctccccggcgtggcggcaaccttcctgcacagggaaccgggccctctgttgggaatacgtgggcccaaggaaaaggttctggcctaaggggcctttttggaaaccttggtttctgtttggtggacatccgtggtggagcaatgagcatttgataccgtgtgagggggaggataagattcgcgaccttacagtccgaaggccgatccgactgccccgtagtaataccaagagggtgtggtgcggtgcggcaaaggggggtgtcacaagcaaaaatttagaggaggagttcgggggtggtccccgcccaaacacggtggcgcgggccgggacacataggggtcactcttaacagccctgtagcgggggaggggagtcccccctcggcggggaggacggggtgtgtgcggatatctcagagtacatgcgcggttgccgtattgcggggtgtctctctcactggtgaggccgctggcgggtacatatggggtgctcgtgaagcgcgggggaaacggaggttatatctccccacggaaacagcctctgcacttgg

SEQ ID NO: 94550 - protein, 183 aa, Zea mays
  misc_feature: Ceres CLONE 1584424
MKTVRDIVQGSKRSSMPTTGKLRWPALPPRKAQGPYFVYIIAWESHDKAVDKRGICGRHKAGERRARCSPAWRQPSCTGNRALCWEYVGPRKRFWPKGPFWKPWFLFGGHPWWSNEHLIPCEGEDKIRDLTVRRPIRLPRSNTKRVWCGAAKGGVTSKNLEEEFGGGPRPNTVARAGTHRGHS

SEQ ID NO: 94551 - DNA, 819 bp, Zea mays
  misc_feature: Ceres CLONE 1584427
  misc_feature: Encodes the peptide sequence at SEQ ID NO. 94552
ggagctccccgcggtggcggccgctctagaactagtggatcccccgggctgcaggaattcgtctcacccctagaaaaaatcacaattcactccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtccccccagaaggcttagaaagtagggacttcatttgcactgtgtgctgtagcatgctcgtgtctagatctgtggatgggatgatgtctgctctagtttcgtccttgtgtcttattgaatgttccgtcttcctcgagaagatcttcagcaatcaaaactcgttgcggaactaaaaaaaattctcaactcctgaaacggcgat

SEQ ID NO: 94552 - protein, 157 aa, Zea mays
  misc_feature: Ceres CLONE 1584427
  misc_feature (29)..(102): Pfam Name: Histone Pfam Description: Core histone H2A/H2B/H3/H4
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASAGSKEPKSPKKGAKSPQKA

SEQ ID NO: 94553 - DNA, 857 bp, Zea mays
  misc_feature: Ceres CLONE 1584428
  misc_feature: Encodes the peptide sequence at SEQ ID NO. 94554
ctccccgcggtggcggccgctctagaactagtggatcccccgggctgcaggaattcgtctcacccctagaaaaaatcaatactgaagcctcaaaatcctccgcctcactcccatcccatgccctcctctcaaccctagtccctccccatcccttactcatggcgctctcttcccacgccaccaccgctgctgcggcggcggccgtcggcacctttacccaatccactcgctcctcttcccggcgattccccgcgtcgtctgtctccccccgccccccgccgcccccgcgctccctacgcctcgaccatgccatggcgccgtccctctcccccgccaccatgcccgcgcccgacggtctcctcgctgcagccatcgaacacctggagcgcgagccagcatccgtcgcagccgacgaggccccgctcgcggcgctgtccccgcgggagctgcagctggtgctcgtctacttcgcgcaggaggggcgcgacacctactgcgcgctcgagggtcttcgactggcttcggcgcgtcaacggcgtcgacggggagaccatgaagctcatggccctcatcgctggcggctggatcgagcgccttctggggggccggcgggggacctcccaactttgctgccctgctccggggaaaaagactggcgtccggctaccggcccgggtttagccttccgggagaaaggcctcccccctctatctgggacccccggggaaaaaggaaactactcttccaatttttgtaaaaaaccttcctccgaaaaggggggaacctcaaccccggcccggggagggggaaacaccctttcccaaagggcaatggggaacacgggggggggccccttt

SEQ ID NO: 94554 - protein, 233 aa, Zea mays
  misc_feature: Ceres CLONE 1584428
MALSSHATTAAAAAAVGTFTQSTRSSSRRFPASSVSPRPPPPPRSLRLDHAMAPSLSPATMPAPDGLLAAAIEHLEREPASVAADEAPLAALSPRELQLVLVYFAQEGRDTYCALEGLRLASARQRRRRGDHEAHGPHRWRLDRAPSGGPAGDLPTLLPCSGEKDWRPATGPGLAFREKGLPPLSGTPGEKGNYSSNFCKKPSSEKGGTSTPARGGGNTLSQRAMGNTGGGPF

SEQ ID NO: 94555 - DNA, 876 bp, Zea mays
  misc_feature: Ceres CLONE 1584430
  misc_feature: Encodes the peptide sequence at SEQ ID NO. 94556
ctccccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaaatcctccggctagctgctttccagtgaccaaaagatatcaaagaccacttcccgtcttcctcccgtggctgtctgtcatctggctctgaaaacgatgcagtcctgcaagttgctgctgctgcccctccccctgtctcttgggatgggttccaagggatttgaaaaccccctggaaatcaacttctttgagggacctgtcttgggctgaccccacgggaaggggactggctggccctttccggtggccccaaatcacttctgttcttgaccttggtccggggacccatttgtgtccagagcttccaaaaaaaaggaattccacccttttggtttttattggaaggcgg

SEQ ID NO: 94556 - protein, 51 aa, Zea mays; identical to SEQ ID NO: 13325
  misc_feature: Ceres CLONE 1584430
  misc_feature (1)..(51): Pfam Name: AdoMetDC_leader Pfam Description: S-adenosyl-l-methionine decarboxylase leader peptide

SEQ ID NO: 94557 - DNA, 919 bp, Zea mays
  misc_feature: Ceres CLONE 1584431
  misc_feature: Encodes the peptide sequence at SEQ ID NO. 94558
  misc_feature (397)..(397): n is a, c, t, g, unknown, or other
ctggagctccccgcggtggcggccgctctagaactagtggatcccccgggctgcaggaattcgtctcacccctagaaaaaacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgaacatctcaagccccgcattgagggcctggacagtgacaccctgccaatctacnagcctggtctcgatgatgttgttgagaagtgcaggggcaagaaccctcttctcagcactgatgttgagaagcacttccctgaggctgacattattctttgtctcggggaaaacccccaccaaaacccttgggcttggaactggccagggtttcccaactctcctactggaaaaaagcctcccccccggatttcggatttcccccaatttaacaaaattggtggttaaaaaatcccttgttccttttaaaacccctgtaggggttttggaaaaaattttaccccacccaggcggggggggaaaattatacaaatttttttcaaccccaaatttttttttggggggaggcgtccctctttggaagactttttacaccttcaaagaggtgttttttttggggggggggaacccctcggggggggagggggcgcccccccccccaggaggggggccaccccccggggggcccgcagggaggggcctcctccccccccgcggtgggggggtggatccccaacaccgc

SEQ ID NO: 94558 - protein, 125 aa, Zea mays
  misc_feature: Ceres CLONE 1584431
  misc_feature (2)..(122): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature (51)..(51): Xaa is any aa, unknown, or other
MVKICCIGAGYVGGPTMAVIALKCPDIEVVVVEHLKPRIEGLDSDTLPIYXPGLDDVVEKCRGKNPLLSTDVEKHFPEADIILCLGENPHQNPWAWNWPGFPNSPTGKKPPPRISDFPQFNKIGG

SEQ ID NO: 94559 - DNA, 794 bp, Zea mays
  misc_feature: Ceres CLONE 1584432
  misc_feature: Encodes the peptide sequence at SEQ ID NO. 94560
  misc_feature (730)..(730): n is a, c, t, g, unknown, or other
tccccgcggtggcggccgctctagaactagtggatcccccgggctgcaggaattcgtctcacccctagaaaaaatccatgccgtccatcggatcagatcgtcttctcccgcgctagggtttagcatcggtccccaatggcgtcctcagccgccgccgccgccgccaccgtcatgctcggcggcaagggctccgccctgtccccggccgccgtttacgcgttctccctcggcctcgccgccccgggcatcgacccttccgcgcacaagtcgctctctacccgcgcgccctcgccgcaggagacccccgcgcggctcgccgccgccctcgcggcgctggcgccggccgagtcccgcgccgccgcggcggtgctgcttaacaagctggtcctcacgtcgtccgactccgcctccgcgctcgtcaccgccgccacggtcgcccgcctcgcggactcgctcgacctcgccgccgcgctgccgctggcctcccgcgacgaggccgcggtggccgcggcgaccgcgcccgtcgccgtcgcgctagcggcgctgatcgattgctgcgccgcgccgctggctcgcgtcgccgacgccgtcgccgcgctgtcgtgcgaggccgcgcgcggggacgccgcggccttcgacgtgccggcctccggcgacgggctctgcgccaaggacgaggccgacgtcgccgccgacatcaaggtgctcgtcttcggctccaagcttgtcngcgctgctgggggcgtccccgccgccgccacgtttcgcaaggtgcccgcgctgaacgggatctt

SEQ ID NO: 94560 - protein, 219 aa, Zea mays
  misc_feature: Ceres CLONE 1584432
  misc_feature: SWISSPROT Homolog: EC 6.1.1.21 Histidine--tRNA ligase
  misc_feature (199)..(199): Xaa is any aa, unknown, or other
MASSAAAAAATVMLGGKGSALSPAAVYAFSLGLAAPGIDPSAHKSLSTRAPSPQETPARLAAALAALAPAESRAAAAVLLNKLVLTSSDSASALVTAATVARLADSLDLAAALPLASRDEAAVAAATAPVAVALAALIDCCAAPLARVADAVAALSCEAARGDAAAFDVPASGDGLCAKDEADVAADIKVLVFGSKLVXAAGGVPAAATFRKVPALNGI

SEQ ID NO: 94561 - DNA, 870 bp, Zea mays
  misc_feature: Ceres CLONE 1584434
  misc_feature: Encodes the peptide sequence at SEQ ID NO. 94562
ctggagctccccgcggtggcggccgctctagaactagtggatcccccgggctgcaggaattcgtctcacccctagaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcagcaaggtcgtcaagagcggcatcaacgcgacgccggtgatccagtgcagcaagggccccttcgacaagtacatgctgttccagctctacttctgcgcggcggggaacgcacgttcatcgactgccccgcggcgcagcagtacactggctcaaagagatcctctccacccctttcaggaagtggatgctcaagcagcagctcaaccaggacgacgaccccttccagctgcctggagtcgccatggacactgaaacacggaccgtcg

SEQ ID NO: 94562 - protein, 251 aa, Zea mays
  misc_feature: Ceres CLONE 1584434
  misc_feature (30)..(216): Pfam Name: Ribonuclease_T2 Pfam Description: Ribonuclease T2 family
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAISKVVKSGINATPVIQCSKGPFDKYMLFQLYFCAAGNARSSTAPRRSSTLAQRDPLHPFQEVDAQAAAQPGRRPLPAAWSRHGH

SEQ ID NO: 94563 - DNA, 987 bp, Zea mays
  misc_feature: Ceres CLONE 1584435
  misc_feature: Encodes the peptide sequence at SEQ ID NO. 94564
  misc_feature (5)..(5): n is a, c, t, g, unknown, or other
  misc_feature (6)..(6): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
aaaannaaaggggggggggggggggganngnngnnnnggnngtgggtgnnnnnnnnnnnggggnnnnnnccaaagctggagctccccgcggtggcggccgctctagaatagtggatcccccgggctgcaggaattcgtctcacccctagaaaaatctccgctttccctcctcgcctaggcctagcctagccgcccccgcacgccacgccacattcgcatctctggatccccctcccttcgccctctcccattacccgccgccgccgcctcgcgcccgcgacccacccggcctcccacttcgatcccgccccgttcgctgcccccgccccgattccgattcgtcactgtatcgcgcgcgcgcgggtggtaagacagcgatggctcgtggcgggggcctctcgccccgccgcgggtgatctctcctctagcggggagccttcccgcgtgcccaagcggaggatcccgtcgcagctggtgcctcacctatccctctccttcgcatctccgccgtgctctctcgcgcaccccctcgaacctaggtttgctccttccctcccttcctcgccacccgattcgatctcgctccctccgggcctccgctaggctgctccgtctctcctccgccatgttctcgcacggcgctgaatccgcccacgaccccggggggcgtcggcgtcagcagcgggcggggctacccgtccccacccgctttcgtctgggccctatggtggggaagaggggttttcgtctcaggcttctttcaccgggtggtcgggaacatttgcccaatgtcttcctattcaaaaggtggcccccctgtaattttaaggctattttgcagtctggttcccctggggaattccccaagtaccaaatttctttttgggaacgggaaaaatggcgcgccattaataaaacgttcaaaccttacccaatttttgggggaagtatttgggcaatattttaaacacccccttttacttgggg

SEQ ID NO: 94564 - protein, 113 aa, Zea mays
  misc_feature: Ceres CLONE 1584435
MFSHGAESAHDPGGRRRQQRAGLPVPTRFRLGPMVGKRGFRLRLLSPGGREHLPNVFLFKRWPPCNFKAILQSGSPGEFPKYQISFWEREKWRAINKTFKPYPIFGGSIWAIF

SEQ ID NO: 94565 - DNA, 1039 bp, Zea mays
  misc_feature: Ceres CLONE 1584437
  misc_feature: Encodes the peptide sequence at SEQ ID NO. 94566
  misc_feature (11)..(11): n is a, c, t, g, unknown, or other
  misc_feature (12)..(12): n is a, c, t, g, unknown, or other
  misc_feature (16)..(16): n is a, c, t, g, unknown, or other
  misc_feature (19)..(19): n is a, c, t, g, unknown, or other
  misc_feature (21)..(21): n is a, c, t, g, unknown, or other
gggggggggcnnacgnccngngggaaggacggggaaaccaaactcccacccacccgttggcaagacgcacaaactggactccccgcggtggcggccgctcttgactagtggatccccccggctgcaggaattcgtctcacccctagaaaaaaccatgccgtccatcggatcagatcgtcttctcccgcgctagggtttagcatcggtccccaatggcgtcctcagccgccgccgccgccgccaccgtcatgctcggcggcaagggctccgccctgtccccggccgccgtttacgcgttctccctcggcctcgccgccccgggcatcgacccttccgcgcacaagtcgctctctacccgcgcgccctcgccgcaggagacccccgcgcggctcgccgccgccctcgcggcgctggcgccggccgagtcccgcgccgccgcggcggtgctgcttaacaagctggtcctcacgtcgtccgactccgcctccgcgctcgtcaccgccgccacggtcgcccgcctcgcggactcgctcgacctcgccgccgcgctgccgctggcctcccgcgacgaggccgcggtgggccgcggcgaccgcgcccgtcgccgtcgcggcctagcggcgcttgatcgatttgctgccaccacgcccgctgggctccgcgtcgcccgaacatccgtccccgccgcttgtcatggcaaagggcccgcaccgccggtgggaactccgcggggccatttcaaaccgtggcccggacccttcccgggtcaaaccaggccttcctggcgccccagaggaaaccaaggccccaaacgttccaccgcccccgaaactatcaaagggtgacgacggatcattccgggctgtcccagaacttttggctcgggcgccttgcactggaggggggagttctccccagacaagtcggatctaacagatgccgccccaaagaggaggccctgacaggccttgaatccggagtaatttgtttctcgtcccaaataaccgaataatctcatggactctccctcccaattatt

SEQ ID NO: 94566 - protein, 210 aa, Zea mays
  misc_feature: Ceres CLONE 1584437
  misc_feature: SWISSPROT Homolog: EC 6.1.1.21 Histidine--tRNA ligase
MASSAAAAAATVMLGGKGSALSPAAVYAFSLGLAAPGIDPSAHKSLSTRAPSPQETPARLAAALAALAPAESRAAAAVLLNKLVLTSSDSASALVTAATVARLADSLDLAAALPLASRDEAAVGRGDRARRRRGLAALDRFAATTPAGLRVARTSVPAACHGKGPAPPVGTPRGHFKPWPGPFPGQTRPSWRPRGNQGPKRSTAPETIKG

SEQ ID NO: 94567 - DNA, 884 bp, Zea mays
  misc_feature: Ceres CLONE 1584438
  misc_feature: Encodes the peptide sequence at SEQ ID NO. 94568
  misc_feature (397)..(397): n is a, c, t, g, unknown, or other
aaagctggagctccccgcggtggcggccgctctagaactagtggatcccccgggctgcaggaattcgtctcacccctagaaaaaaccttacccaggccataccccccgccccgaccgggggtctcctatcctcctgccctcaccgcgggtgcccgcaccgcgcggcgacgcctccccttcaaatctcccaggagctaggggcctcggccaccaccaccgcaccgcaccgtctcggacgcggctgcagctccgagcattggattccgaccaactgaccgagcggcgtgtcagatgatctcgccggcgatgtgtcgttcggcgccgcggcgggccgcgcaggtccggcgcctcctgtcgtcggccgcgcccccggcgcacgccggcgctgccgtgcctnggccctgcatcgtgcacaagcgcggcaacgacatcctccacgatccgtggtacaacaaggatacggcgttccccatgacggagcgcgaccgcctcggtctccgcggcttgctcccgccgcgggtcatgtccttcgagcagcagtacgagcgatttataaactctttccggtcgctggagcacaataccccgcggcgagcctgactccatcgtcgcgctggccaaatggaggatcctcaacaagttgcacgaccggaaacgagacattgtactaccggggtgctaatttgacaatattcaggaattttgcccccaataaaatacacctccccactggttgggcttggctctgtggaaaattacagcgggtctggttcagaccaaccccggggggggaggtattttcatttgccaagggaataaaggggggaaatgaatgttcaaatgaattaaccaactgcgcccacccacaaaaaagggtatggaat

SEQ ID NO: 94568 - protein, 97 aa, Zea mays
  misc_feature: Ceres CLONE 1584438
  misc_feature: SWISSPROT Homolog: EC 1.1.1.39 Malate dehydrogenase (decarboxylating)
  misc_feature (31)..(31): Xaa is any aa, unknown, or other
MCRSAPRRAAQVRRLLSSAAPPAHAGAAVPXPCIVHKRGNDILHDPWYNKDTAFPMTERDRLGLRGLLPPRVMSFEQQYERFINSFRSLEHNTPRRA

SEQ ID NO: 94569 - DNA, 967 bp, Zea mays
  misc_feature: Ceres CLONE 1584440
  misc_feature: Encodes the peptide sequence at SEQ ID NO. 94570
  misc_feature (923)..(923): n is a, c, t, g, unknown, or other
  misc_feature (927)..(927): n is a, c, t, g, unknown, or other
ctccccgcggtggcggccgctctagaactagtggatcccccgggctgcaggaattcgtctcacccctagaaaaagcgccctcgtcgccatcgtcaccacaccaccactccctcactgccctctcactcccgatccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaagttactgtatttcagcagcctcattatctgcagaactttgtccagtcaacaccgcaatgcccttcctgcagaccaagtaaaaagtgccaccacttgttgtctctgggtgagggcgctatttcttcaaaaaatgctgttcaaatctaaacaaaaatgggctgctggcaatgggagtaagacctggtttgggttgggacaaaaaaggctcccgggccaccccccggctggaatctggctgggcctccccggaaaaaaatttgggggcgaatggggtcccaagggcgtcctggggggccctttctttttggaccgggaggccccataaaccccggggggggcccttcccgggggggaacttttggggaattaaaaaacaaaaatttgggggaaaagggtggggaccctgccccccctgaaacccccttttccccgaaaaaaattttttttttttattaaaacgaaccaacacctctcgagaaaccctccttttcccttaaagagccccccccacacagggaggagatattttttgtttgtgggggggggggcgccccccccttctttggtgggcccaaagggcccccccaacccctagaggggggtctttttttctcccctgngagntcgtgaaatatcagaggaggggagcggacctttttttctg

SEQ ID NO: 94570 - protein, 75 aa, Zea mays
  misc_feature: Ceres CLONE 1584440
  misc_feature: SWISSPROT Homolog: EC 5.4.2.2 Phosphoglucomutase
MGLFTVTKKATTPFEGQKPGTSGLRKKVTVFQQPHYLQNFVQSTPQCPSCRPSKKCHHLLSLGEGAISSKNAVQI

SEQ ID NO: 94571 - DNA, 801 bp, Zea mays
  misc_feature: Ceres CLONE 1584441
  misc_feature: Encodes the peptide sequence at SEQ ID NO. 94572
ctccccgcggtggcggccgctctagaactagtggatcccccgggctgcaggaattcgtctcacccctagaaaaagagggaccggtcgccttggcggactcccgctggtgctcctccacgcccatctctctcttttcctcgctgcagccacggatcttggtagcagggacgccaccgcatttccagaatccaaacggaattttacaggaatcgcgctggaatttcacaggaatcagttcaatttcacggaacaaacgcaggagcaaggaaattttgtcacgttcccctcatttgtttccttcggcgacgactaggcgagtgctgcccgctcttcacgaggttttcacctgcgacgaacatcctccagttgatcttctggctggaaaatcacgttgacggtggcaagtaggggttctatcatccgcagcctcatctcaagaagcaaaattctttcatgatccctttgaaccggagggcaagcctgcccagggctgatttcagttgctagaaagacaggcaagttgagctaaagctattaggtgcgatatttcaatcgaagtcaggcatggagtactttgatgcaacgcggaagcctcgtaatgttggaaaaatcattgcagccctggtcctcacaacactctgtatatttgctctgaagcaatctcctggctttggtggcaatagtgtgttttctcgcaatggacctggtggttacccacgtctagtaacaggaggagctgggtatatgggtgcacatgcccgctttaaggctcttacaggatagctatcgaggttacattgg

SEQ ID NO: 94572 - protein, 72 aa, Zea mays
  misc_feature: Ceres CLONE 1584441
  misc_feature: SWISSPROT Homolog: EC 5.1.3.5 UDP-arabinose 4-epimerase
MEYFDATRKPRNVGKIIAALVLTTLCIFALKQSPGFGGNSVFSRNGPGGYPRLVTGGAGYMGAHARFKALTG

SEQ ID NO: 94573 - DNA, 1044 bp, Zea mays
  misc_feature: Ceres CLONE 1584445
  misc_feature: Encodes the peptide sequence at SEQ ID NO. 94574
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (21)..(21): n is a, c, t, g, unknown, or other
  misc_feature (1044)..(1044): n is a, c, t, g, unknown, or other
nnnncctgtgcgggcccccgnagggcagaagcaccaatcaggaaacaaacaccaacacaaaaggattgtggttataaaaatggaactccccgcggtggcggccgctctataactagtggatcccccgggctgcatgaattcgtctcacccctagaaaaactcgccctgcaaagcacagacacaaaccacgagcgcgaggcacgacctacatctaatcggccacgaaccaccatggcggcctcacgcgcgctcctccccagcccgcaggtgagccctgcgagcgcgcgggtccgcctggccgcggccgtgccgtcgtcgctcacgctcacggcgcgcagcggggccggggccggcgcgcgtctccgcgtgcggtgcgcgatcttgtcgtcgcccgcgcccgtggcgcccaccgagtcgaggccggcgcgccggatctcgccgtccgcgccggacggcgcgctgcggcccaagccggctgtgctggtcgccgagaagctgagcgaggccgggctggccctgctgcggcagttcgcggacgtggagtgcgcctacggcatgtcccccgcggagctcctcgccaaggcggcgcagcttcgacacgcctcatacgtgcgcagcgacacccaaaggcgaccaccggaaggtgcctgggaggcccgggccaggggcctggctttccagagtaggtggggcccgcggccggggcggctacgggaaccaaaacaaccgttccgaacccttcactagggcccccccaaccacaaaggttcaggggtggcccttcgattcaattctaaaggcggcctcatacctgtgcaaaataacccatccgtccgtcagggcccgaaaccaacggagaatcatccgcctgtattagagcgctccaattggtcgccgacaaacggtcgctcccaagggccggaacgccgggccgcctcacaaagccccggtataaagggtgttaagcggaacttaatcccggtggggggggttttccccggtgtgggagaaaaagaaaccatggttccctccgattggggcttn

SEQ ID NO: 94574 - protein, 171 aa, Zea mays
  misc_feature: Ceres CLONE 1584445
  misc_feature: SWISSPROT Homolog: EC 1.1.1.95 Phosphoglycerate dehydrogenase
MAASRALLPSPQVSPASARVRLAAAVPSSLTLTARSGAGAGARLRVRCAILSSPAPVAPTESRPARRISPSAPDGALRPKPAVLVAEKLSEAGLALLRQFADVECAYGMSPAELLAKAAQLRHASYVRSDTQRRPPEGAWEARARGLAFQSRWGPRPGRLREPKQPFRTLH

SEQ ID NO: 94575 - DNA, 803 bp, Zea mays
  misc_feature: Ceres CLONE 1584446
  misc_feature: Encodes the peptide sequence at SEQ ID NO. 94576
ctccccgcggtggcggccgctctagaactagtggatcccccgggctgcaggaattcgtctcacccctagaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcagggccaagagcctccctcaccctgctgcccatcaacttccatggactcgccaaggctttgacacaggtgcaacgatatttgtgggcccatacttggtcactggtagcgagactacttagttttgggtggaagtttctgaagttaaagg

SEQ ID NO: 94576 - protein, 141 aa, Zea mays
  misc_feature: Ceres CLONE 1584446
  misc_feature (30)..(141): Pfam Name: PK Pfam Description: Pyruvate kinase, barrel domain
  misc_feature: SWISSPROT Homolog: EC 2.7.1.40 Pyruvate kinase
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEPPSPCCPSTSMDSPRL

SEQ ID NO: 94577 - DNA, 1235 bp, Zea mays
  misc_feature: Ceres CLONE 1584447
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (829)..(829): n is a, c, t, g, unknown, or other
  misc_feature (918)..(918): n is a, c, t, g, unknown, or other
  misc_feature (920)..(920): n is a, c, t, g, unknown, or other
  misc_feature (1057)..(1057): n is a, c, t, g, unknown, or other
aacggaggcggacaagaagaatcacgagcgaaacacccgacccgncgagatannnntttccctcctcttaaagctggaactcaccgcggtggcggccgctctagaactagtggatcccccgggctgcaggaattcgtctcacccctagaaaaaaccaccgcctcgccctccgtcgtctcagcgtatgttgtggatgtgaagagagagacgaacagggtgacgagcgagaaaaaagctaatagagtgataggttgacaagacgcattgaagctaaagacacgcataccaaagcaacctgaccatcgctcggattctactcaatcaaggacattattgtctcaacgaactatctaggatccgcgcgttaggtcctcgaagcggtgggacatatgagctcgcatcctcttgttggctatggttaccatcgcgagccgcctcctgtcgccggtcatcgcaagactactggaggaggaccagtgggaatacagaaaagcactccttgccaccgggtacataggactcgtgtagagtctaggaaaagaatcgtagagtaaaacataaaagcggctgcccggctaattttgtttgtaaaatcccatatccttggcgggggacttccctagcccgtagaaggcggaaatgacccttcgtccgccctataatccgaagagaagaatgaaaagggcgccagtatagaggttcactttttcaagcttcaggttgcggatatgctggcgccgggggatttcaaaaaagaaaggaggaagggcagagaaaagatgatgcccctggggggtttccgttctcggagtcccactcgtatactccnccgtctacccacgtatggggctggtttaaaaatgtgggtgcgctccagtatacacgggggcgtctcttcattattaactatattctccnantctccctctttgttaatggggggtgacagttccccttatcataccgaatccgaccaccagagagaaagggactccactgccccgctgagcgggttaatccaaatgcgttactagatgttttaaaaatcagatgtctntacatcagttcgagcacaattagaaggaagagagaacttataacgcatacggcttatatcgctccagcgccttattttttgtcccggcggggtggggatacttttggccgcggagctgtgttttgtgtggtctccattttcaatttaaatacgcgtgtttcttctcacgtgtgataag

SEQ ID NO: 94578 - DNA, 880 bp, Zea mays
  misc_feature: Ceres CLONE 1584450
  misc_feature: Encodes the peptide sequence at SEQ ID NO. 94579
gagctccccgcggtggcggccgctctagaactagtggatcccccgggctgcaggaattcgtctcacccctagaaaaaatccgtcttcctcctgtaaccagatctgaacccgcggcgacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaggagcagctgatcacgccgtgggccttctccgtcgcaagcggctacaccctgctgcgcgacccgcggcacaacaagggcctggccttctcggaggcggagcgcgacgcgcactacctccggggcctgctgccgccggcgctggcgtcgcaggagctgcaggagaagaagctcatgcagaacctgcgccggtacgagcagccgctgcaccgctacatcgccatgatggacctgcaggagcgcaacgagaggctcttctacaagctcctcatcgacaacgtcgaggagctgctccccgtcgtctacacgcccaccgtcggcgaggcatgccagaagtacggcagcatctaccggccgcccgcaggggctgtacatcagcctcaggggacaaggccaagatcctcgaggtgcctcaagaactgggcccgaaaggagcatccaggtttatttttctttaccgaagggggaggcgcattcctgggccctccgggaaattccgttggcacaggggatggggaaattccccttggggaagagttttccccttttacaggtgcccttgggaaggggttgtcccccctaaactattggcgcgcccacatcaaaatttgggtggggggccccccaacc

SEQ ID NO: 94579 - protein, 226 aa, Zea mays
  misc_feature: Ceres CLONE 1584450
  misc_feature (95)..(222): Pfam Name: malic Pfam Description: Malic enzyme, N-terminal domain
  misc_feature: SWISSPROT Homolog: EC 1.1.1.40 Malate dehydrogenase (oxaloacetate-decarboxylating) (NADP(+))
MAGGGVEDVYGEDRATEEQLITPWAFSVASGYTLLRDPRHNKGLAFSEAERDAHYLRGLLPPALASQELQEKKLMQNLRRYEQPLHRYIAMMDLQERNERLFYKLLIDNVEELLPVVYTPTVGEACQKYGSIYRPPAGAVHQPQGTRPRSSRCLKNWARKEHPGLFFFTEGGGAFLGPPGNSVGTGDGEIPLGEEFSPFTGALGKGLSPLNYWRAHIKIWVGGPPT

SEQ ID NO: 94580 - DNA, 836 bp, Zea mays
  misc_feature: Ceres CLONE 1584451
  misc_feature: Encodes the peptide sequence at SEQ ID NO. 94581
  misc_feature (731)..(731): n is a, c, t, g, unknown, or other
ggagctccccgcggtggcggccgctctagaactagtggatcccccgggctgcaggaattcgtctcacccctagaaaaaatccccccttcctcttttctttctcctccctcttgcggcttctctctggactcgcccctccctcctctcgtctcccaggtcatggcaaagctggagcacccgtgaaaatagcaagtgggagataaacaggaagagctagggtgaatactaactacaagtagcagtagaaggaagagagtcagtctgcccgtgactgcgagtgaatttgttgggtgtggtgtttgttgagatcacgatgatgggaggcgggctgttggtggatcagagcgtggtgttccctggcgtccacaacttcgtggatctcctgcagcagaacggcgacaagaacctgggcttcgggtctctgatgccgcagacgtcctctggcgaccagtgcgtgatgggggagggcgatctcgtggacccgcctccggatagcttcccggacgccggggaggacgacagcgacgatgacgtcgaggacatcgaggagctggagcgccgcatgtggcgcgaccgtatgaagctgaagcggctcagggaactgcagcagacccgcggcaaggactcgttggctagcggtgcgggactggctgatggctcgtccaagccaaggcagtcgcaggagcaggcccggcgcaagaagatgtcgcgcgcgcaggacggcatcctcnagtacatgctcaaagatgatggagtgtgccgcgcgcaggggtttggtgtatgggatcatttccggagaaggcaagcccagtgagtggtgcctccgacaacctcgt

SEQ ID NO: 94581 - protein, 166 aa, Zea mays
  misc_feature: Ceres CLONE 1584451
  misc_feature (140)..(140): Xaa is any aa, unknown, or other
MMGGGLLVDQSVVFPGVHNFVDLLQQNGDKNLGFGSLMPQTSSGDQCVMGEGDLVDPPPDSFPDAGEDDSDDDVEDIEELERRMWRDRMKLKRLRELQQTRGKDSLASGAGLADGSSKPRQSQEQARRKKMSRAQDGILXYMLKDDGVCRAQGFGVWDHFRRRQAQ

SEQ ID NO: 94582 - DNA, 851 bp, Zea mays
  misc_feature: Ceres CLONE 1584452
  misc_feature: Encodes the peptide sequence at SEQ ID NO. 94583
aagctggagctcaccgcggtggcggccgctctagaactagtggatcccccgggctgcaggaattcgtctcacccctagaaaaagcgccgtcttctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgaggggggtcaagcccgaggaagattacgagaaagaccgggcagatccccgaccccggagtccacccgacaacgcgtgaattcaaagaccgtggctcccccattcatcccgcggaacggggcccagaggcttgacccccaaaaaaagtcacccccaagaatgaaaaggagaagggccttgtccggcccgtcctcccgagggaaagaaccccaccaccggggggggttccaaaagaagggccccccc

SEQ ID NO: 94583 - protein, 230 aa, Zea mays
  misc_feature: Ceres CLONE 1584452
  misc_feature (12)..(229): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGGQARGRLRERPGRSPTPESTRQRVNSKTVAPPFIPRNGAQRLDPQKKSPPRMKRRRALSGPSSRGKEPHHRGGFQKKGPP

SEQ ID NO: 94584 - DNA, 891 bp, Zea mays
  misc_feature: Ceres CLONE 1584454
  misc_feature: Encodes the peptide sequence at SEQ ID NO. 94585
ctggagctccccgcggtggcggccgctctagaactagtggatcccccgggctgcaggaattcgtctcacccctagaaaaaacacgcgctcctctctcgccgtcgccaaccatcgccgcctcgcgtccggacccgccgttcctccgaggaaatggctgcactgcaaccctcattttcaccagcaatgactttgaagagtagctgcagcgccctgaagttcccaaaaactgcactgttatctggttttggtggcattccacgccttcaagatgcgcaagacaggaacactagcgtcgcttatttgatccccaaggctgcttcagtgactgaccagtcaatagcagagccaccaaaaaccaagcaaaataggcacacaggcgacccaacagctccagaatttctgccactcccatcttttgaagaatgctttccaaggagtaccaaagaatcaagtgaaatcatccacgaggaatcaggtcatgtcctcaaggttccattcccgagagtccatttgactggagatcagaagcactttgatacatatgacaccagcggtcctcaaaatataagcccaaaggattggactccccaagataaggaaggaatggattgattaggagggaaaagctgggttagtcctcggtacacacaaatgtattattgctaaacagggaattgtaacagaaggaaaatgttttactggtgcccagcgtggagaaacctttagtcctggaatttgtttccggaaaagaaagtttgcccggtgggaacgaagcccattatttcccttcccaaaaaagagggcaacctgggaaatttgggaaaccccatggatttggtttgggaaaaaaaaacctcccctgggtaaaagggtgggaattggcaaaattat

SEQ ID NO: 94585 - protein, 153 aa, Zea mays
  misc_feature: Ceres CLONE 1584454
MAALQPSFSPAMTLKSSCSALKFPKTALLSGFGGIPRLQDAQDRNTSVAYLIPKAASVTDQSIAEPPKTKQNRHTGDPTAPEFLPLPSFEECFPRSTKESSEIIHEESGHVLKVPFPRVHLTGDQKHFDTYDTSGPQNISPKDWTPQDKEGMD

SEQ ID NO: 94586 - DNA, 816 bp, Zea mays
  misc_feature: Ceres CLONE 1584458
  misc_feature: Encodes the peptide sequence at SEQ ID NO. 94587
aaagctggagctccccgcggtggcggccgctctagaactagtggatcccccgggctgcaggaattcgtctcacccctagaaaaaaagcaaataagacgacttgtttcattgattcttgaagagatcgagcttcttttgcaccacaagggcgaggatgtcttgcaactgcggatcaagctgcggctgcggctcaagctgcaagtgcggcaagaagtaccctgacctggaggagacgagcaccgccgcgcaggccaccgtcgtcctcagcgtggccccggagaagaaggccgcgcccgagttcgtcgaggccgcggcggactccggcgaggccgcccacgcctgcagctgcggtagcagctgcaagtgcgacccctgcaactgctgatcacatcgatcgacgaccacgcatatcattattatctatctagcttgtggtggtggttgaacaataataagcgaggccgagctggctgccatacataggtattgtgtggtgcgtgagacacagagagaaacagagttcttcagtttgctatctcgctctctgcatgtttggcgtcagtctctgcgctcatgtgcatgtgtctacacgcatgctggtcgatgcgattgcctctgctgtaaccatattttaggtggaccaccatcgatcgatgtggatccctctggagaggtcgtttcctacaaaaagctccgagaagcaacccccagccctcgtaggcaaggagcgttatctcctctccaatgcatcccgccaaggaagagagagagaacacccctcccctttatcagaatccgggggtggcgggggacccc

SEQ ID NO: 94587 - protein, 76 aa, Zea mays
  misc_feature: Ceres CLONE 1584458
  misc_feature (1)..(76): Pfam Name: Metallothio_2 Pfam Description: Metallothionein
MSCNCGSSCGCGSSCKCGKKYPDLEETSTAAQATVVLSVAPEKKAAPEFVEAAADSGEAAHACSCGSSCKCDPCNC

SEQ ID NO: 94588 - DNA, 855 bp, Zea mays
  misc_feature: Ceres CLONE 1584459
  misc_feature: Translation starting site: 151
ggagctccccgcggtggcggccgctctagaactagtggatcccccgggctgcaggaattcgtctcacccctagaaaaaagctgcctaccccccaaacaaaaccctaggcgacgattctgaccaccaggcacaagcagagcataagcagacatggccaccattccgaccaccgattctggcctcatgctcagttcctccgctctcctccggaggactaggagggccgcctcgtccgtcaccgccaggctgccagccgacgcccgccgtcgcccgcagctcctcgtgcgtgcctccgacgaggagatcggctgtgaccaaggctccagagccgcccttcaggcctgcgtcggagagctcgccgccgcggtctgagtcaccctcggactcagaggaaggaatgttgtcttggatgagtttgagaacccccaaagtggtgcaatgatggagttaccattgcccgcgctattgagcttgctgatcccatggagaatgctggtgcttccttgattcgtgaagttgctagcagagacgaatgactcgtgctggtgatggaaccacaactgcctgtgttctcgctacggagatcagcacattgtgcatgctgagcattacttcaagagatgatccagtgttcgttcagaatggatttgataacactgttcacatattgggtgaggaacttgagatgaatcaggacggtcaaggtagtgaggaatataaagctgatgctgcatatactgcggaatgatcactcgtggtgacatgatcgacgagctatgacgagttcggacctgatgggtcctatgattgagtcgcatcagctttgagacaatatcgagttgagaaagattgact

SEQ ID NO: 94589 - DNA, 845 bp, Zea mays
  misc_feature: Ceres CLONE 1584461
  misc_feature: Encodes the peptide sequence at SEQ ID NO. 94590
  misc_feature (434)..(434): n is a, c, t, g, unknown, or other
  misc_feature (800)..(800): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
ctggagctccccgcggtggcggccgctctagaactagtggatcccccgggctgcaggaattcgtctcacccctagaaaaaaacacccaattcctcgcaactgggctcccccgcctccacgaaccacgacactgccccccgcctcaagttcgccgtctccattcctcagctctcctctcctctgtagtctgcctgtacctattggctgaagcagagctgacccccactttatcaagagttgctcaacaatggacactggctgcctgtcatctatgaatattactggagctagccaggcaagattttttgcggggcaacttcctcctcagagatgtttttgcgagtagtcactatacaagctttgccgtgaaaaaacttgcctcgaggaataaagggaggagatcacaccgtagacatcctgcctttgcaagttgntctgcaaggattttccaagaactccactagaaagcacaataaactatttggaagctggacagcgtctcttcattttttagaaacagcgaacgctccagtaagcgtttgcaggtcttgggttgctgggtgacagaatttgcttgtctatccaacaggcaaatattcttggaaaatgtgggcataaacccatttggctggaggcaaaaaatttttttgggggggaaaaggaacctcctttgaaaggtaaaaaaaggggaattttggtccaaaaacggggcttccaaaacttttaaaacgtgtggggccacttttgaaatttaggggaatctttttttttgggggaaaaaaaaaccccccaaaaaatcnaaacgagnnnnnnnnnnnnnnnnnnnnnnnnnnnnnnnnnnnnnn

SEQ ID NO: 94590 - protein, 32 aa, Zea mays
  misc_feature: Ceres CLONE 1584461
MDTGCLSSMNITGASQARFFAGQLPPQRCFCE

SEQ ID NO: 94591 - DNA, 866 bp, Zea mays
  misc_feature: Ceres CLONE 1584465
  misc_feature: Encodes the peptide sequence at SEQ ID NO. 94592
ggacgccctgcaataagagatcccccgggctgcattactcatatgagcccctagaaaaagaaccgggccctgaccgttcgcctcctcggttgcttgttttttctcccccttcccacctccgcgagatctgacggctcggcctccaatggcgcccttctccctgtaaacctagctgctctacctacccgcacccccaccccgtggagagcaagtgcagccatggcggcggatcgggagaaggagcgcgaggcggagctggagggcgccatgtacactaactgcctactcctcggcctcgatcccgcggtcctcggctctccctcttcccccgccggccgcgtgggcctatttcgtcactccaacccccgccttggcgagcaactcctctacttccttctctcctcgctccgcggccccgcgcagtccgcgaaggattttgacaaggtctggccaatcttcgactccgctcagtccagggagttcaggaagatcgtgcaagggatcatcagcgagctggaacagcatggggcactgcctcggagcaattctagggtctcgtcacttgccacatgctgcgggacgagatttgttgagcttttgtggcaactatctgtacttgcccctgagagaagtccacaagaagaacatttgcagcttgatgttgttttcaaaatccacttacctggcggcacctaacaagatggtttcctttatctttcaatgccggcttctttttcctcccccggttaacccaagggcaaagaaatttacctcctgggagaagggggtgaaaatattgccttaaaaagatggccataacaattgccctggtttccacaagggcgcaaattggacaacttggttct

SEQ ID NO: 94592 - protein, 158 aa, Zea mays
  misc_feature: Ceres CLONE 1584465
MAADREKEREAELEGAMYTNCLLLGLDPAVLGSPSSPAGRVGLFRHSNPRLGEQLLYFLLSSLRGPAQSAKDFDKVWPIFDSAQSREFRKIVQGIISELEQHGALPRSNSRVSSLATCCGTRFVELLWQLSVLAPERSPQEEHLQLDVVFKIHLPGGT

SEQ ID NO: 94593 - DNA, 810 bp, Zea mays
  misc_feature: Ceres CLONE 1584466
  misc_feature: Encodes the peptide sequence at SEQ ID NO. 94594
  misc_feature (810)..(810): n is a, c, t, g, unknown, or other
ccccgcggtggcggccgctctagaactagtggatcccccgggctgcaggaattcgtctcacccctagaaaaaagcctcctcgcaggcgaccttgcgtacgtacgtcgtagcggatcgtccagctcgctcgccaccgccatggacccgtacaagcatcgcccgtcgagcgccttcaacgccccgtactggaccaccaactccggcgcccccgtgtggaacaacgacagctccctcaccgtcggcgcacgaggtcccatcctgctggaggactaccacctggtggagaagctagccaacttcgaccgcgagcgcatcccggagcgcgtggtgcacgcgcgtggcgccagcgccaagggcttcttcgaggtgacccacgacatcacccacctgacgtgcgccgacttcctgcgcgcgcccggggtgcagacgcccgtcatcgtccgcttctccacggtgatccacgagcgcgggagccccgagacgctgcgcgacccgcgcgggttcgccgtcaagttctacacccgggagggcaactgggacctggtgggcaacaacttccccgtcttcttcatccgcgacggcatcaagttcccggacatggtgcacgcgctcaagcccaacccgcggacgcacatccaggacaactggcgcatcctcgacttcttctcgcaccacccggagagcctgcacatgttctcccttcctcttcgacgacgtcggcatccccgccgactaccgccacatggacggatccggggtgcacacgtacacgctcgtcagccgcgccggaaccgtcacctacgttcagtn

SEQ ID NO: 94594 - protein, 224 aa, Zea mays
  misc_feature: Ceres CLONE 1584466
  misc_feature (18)..(224): Pfam Name: Catalase Pfam Description: Catalase
  misc_feature: SWISSPROT Homolog: EC 1.11.1.6 Catalase
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSLPLRRRRHPRRLPPHGRIRGAHVHARQPRRNRHLRSV

SEQ ID NO: 94595 - DNA, 953 bp, Zea mays
  misc_feature: Ceres CLONE 1584467
  misc_feature: Encodes the peptide sequence at SEQ ID NO. 94596
ctccccgcggtggcggccgctctagaactagtggatcccccgggctgcaggaattcgtctcacccctagaaaaagtgtctcgtcctcgcatcccgcgccacaccatcccgatcccctccctccccctcgggtctccggtctccacacctttcacacgcgacgccggagagacagagcgcgcgcgcgcgcccgaaagatgtcgacgtgcgcagcggacctggcgccgctgctgggcccggcggcggcgaacgccacggactacctgtgcgggcagttcgcggacacggcctccgcggtggacgccgcgtacctgctcttctcggcctacctcgtgttcgccatgcagctcggcttctccatgctgagcgccggctcgttccgcgccaagaacactaccaacatcatgctcaccaacgtgctcgacgccaccgcgggggcgctcttctactacctcttcggcttcgccttcgccttaggcacgccctccaacgggttcatcggcaagcagattcttcggggcttagcacctgaccaggaccgggcttcgactacggactttcttcctctaccagtggggccttcgcctatcgccgccgcggggcatcacgtacggggctccattcgcccgagcgggaccccggttgggtcgccaaacctcattctactcccgcgtttcccgaagtgggttacgccttcccccgggggattcccccctggtttctggttcgcccaaccggttggggccggcgtccggccctaactttaggggctccctgctatttttggggtcgggggtagatcaaatttcgcgcgggttccagggttttttccaccatggtgcggggggatcccccggggtctggtgtgggggcctcttatgtgagggcccccccaatacgggggtatttataaacggcaggctcctttcgggaggcctaaaggggcaacggggg

SEQ ID NO: 94596 - protein, 187 aa, Zea mays
  misc_feature: Ceres CLONE 1584467
MSTCAADLAPLLGPAAANATDYLCGQFADTASAVDAAYLLFSAYLVFAMQLGFSMLSAGSFRAKNTTNIMLTNVLDATAGALFYYLFGFAFALGTPSNGFIGKQILRGLAPDQDRASTTDFLPLPVGPSPIAAAGHHVRGSIRPSGTPVGSPNLILLPRFPKWVTPSPGGFPPGFWFAQPVGAGVRP

SEQ ID NO: 94597 - DNA, 882 bp, Zea mays
  misc_feature: Ceres CLONE 1584472
  misc_feature: Encodes the peptide sequence at SEQ ID NO. 94598
ctggagctccccgcggtggcggccgctctagaactagtggatcccccgggctgcaggaattcgtctcacccctagaaaaaactacccagtacccagtagtcagtaaccacatctcctcccccctctcctgcaaagacaaggccgctgtccatggccgtccaggcgcagcacctactcaaccccgccttcctgccccacgacatggggcacgccttcagggcgctggagggcgccacggtcggcggcggcggcggctccgcgttcctggaagagctcggcttcggcgggtgcgcgccggcgccggcgcccatcgaggtcgccgcgtttggcgacacccagccgcgcagcgagctcacctgcaacggcggcggcggcggcgacaacagcaacgtgtttctcccgaggaagcgtgcacgcgtcgcgcccgggttcctggatgatgcccaccagcaggggttggttctgcccctgccggtgccggtgccggtgccgcagggccaggtgttcgccggcgacgtgcagagcatggagggagggtgcggcgcggcgtcaccagcggtcggggaggggccaccgacaacggcgtcctgtcgctgctctaccgccagggcatggagatcgacgcgcttgtgcggctcgagaccaagaggatgcgttgcgggctgcaagaggcccggcggaagcacccgcgcgcggggggcgggggccctggaacgcgcctcggccggggcggcttgcggctggcgcgaggcccaccttggggcaactcccgccgccgccaagcccgaacttgaaggaaaggctcccggcagcttggctcccaaagggcaagggcctttggctggggcgctccccccgaaacccaccagggtccgtcccccc

SEQ ID NO: 94598 - protein, 244 aa, Zea mays
  misc_feature: Ceres CLONE 1584472
MAVQAQHLLNPAFLPHDMGHAFRALEGATVGGGGGSAFLEELGFGGCAPAPAPIEVAAFGDTQPRSELTCNGGGGGDNSNVFLPRKRARVAPGFLDDAHQQGLVLPLPVPVPVPQGQVFAGDVQSMEGGCGAASPAVGEGPPTTASCRCSTARAWRSTRLCGSRPRGCVAGCKRPGGSTRARGAGALERASAGAACGWREAHLGATPAAAKPELEGKAPGSLAPKGQGPLAGALPPKPTRVRPP

SEQ ID NO: 94599 - DNA, 783 bp, Zea mays
  misc_feature: Ceres CLONE 1584473
  misc_feature: Encodes the peptide sequence at SEQ ID NO. 94600
ctggagctcaccgcggtggcggccgctctagaactagtggatcccccgggctgcaggaattcgtctcacccctagaaaaatttcggaaatatattggcggatgaattagtcgttgttgttcttgtttctttagtccccttagtagtccctataccggtcatgtttcttggattatttacaagcggtattcaagctcttagttttgcaacgttagccgcagcctatataggtgaatccatggaaggtcatcattgaattaactagtttttgaaatagtctttctttttttagcttagcccaattcatgcatgattccggataatcctcttagttggaaaactaaatagttcgaaaggcgtatgaatatacaacctagagttgtaggagagagaatagactatattatggaagaggtaaagtatatatgcattcaggggggccaagtcaggttagatctatatctttaatgcctataagacagtcatcttttgtgtggctttctaaagaatgattttagaatcggattcaatagaaaatgagaaaataggcaaacaaaatagaagaaacaaatgtatatgggattttttttattcctaagttagattcattatctaatccgatatatagaattcccttctatatggaactggattccatatctagttctatgcagcatattgttatcaattgtatatcttgatttgattcctattggatttggattagttcgatttcaataggggttcttcctgtatttcgtcttttattatgttagatgaaagg

SEQ ID NO: 94600 - protein, 31 aa, Zea mays
  misc_feature: Ceres CLONE 1584473
  misc_feature: SWISSPROT Homolog: EC 3.6.3.14 H(+)-transporting two-sector ATPase
MFLGLFTSGIQALSFATLAAAYIGESMEGHH

SEQ ID NO: 94601 - DNA, 776 bp, Zea mays
  misc_feature: Ceres CLONE 1584475
  misc_feature: Encodes the peptide sequence at SEQ ID NO. 94602
aaagctggagctccccgcggtggcggccgctctagaactagtggatcccccgggctgcgggaattggtcccacgcccaggcaatctggaagccgcaagagaaacacctggccgaggtgtccggcgaggattccgcccccgtgccggagggctgctcgcccctggacggagtcggagctgacgaccccatggttccttcctcggacgagagctgggtggtctggctcgagcaggctggctacattttcctcacggtatcgactgattatccttctgcttgccgagtaccgtggactgaactacgaccgtttgtttgtgctggagactattgacagggtgccggatctcccgttattgttaacgcttcacttgcatttacactttagctggagcagacgaacctatgtctaacagtgcagcttgctcggacctgtgagcagtttcatcatctcttgatttgcggaggaatgggacggcacccctgatggactggctgctgcgctgattcgattaggtggttttgtgacaactccagagctttgcgaggtacagtagtacgccacaatgggataccgcttctctgaatgtgtagaaatactgcgttgtccaacgtagatgattactcgagctccatgatgaggacttgaatagcgtccggctccacaggcaacttggaactttttctcgaagccgacctttacgtctttcagaaggtcctacccccctatttcatgggtctaggagtcctaacattgctcaacttgtttgggaggaatc

SEQ ID NO: 94602 - protein, 109 aa, Zea mays
  misc_feature: Ceres CLONE 1584475
KLELPAVAAALELVDPPGCGNWSHAQAIWKPQEKHLAEVSGEDSAPVPEGCSPLDGVGADDPMVPSSDESWVVWLEQAGYIFLTVSTDYPSACRVPWTELRPFVCAGDY

SEQ ID NO: 94603 - DNA, 850 bp, Zea mays
  misc_feature: Ceres CLONE 1584477
  misc_feature: Encodes the peptide sequence at SEQ ID NO. 94604
  misc_feature (270)..(270): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (709)..(709): n is a, c, t, g, unknown, or other
  misc_feature (772)..(772): n is a, c, t, g, unknown, or other
ctggagctccccgcggtggcggccgctctagaactagtggatcccccgggctgcaggaattcgtctcacccctagaaaaaaaaacatagtgcagcaagcaactgcaaagcagcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggccngtggcgaaggtggctacaacaagtcgggcggcgatgacgactacggccgcagcggcggcgatgggtacggcaggtccggcggcgacgactacggccgtggcaccggcggtggtggctacaacaagtccggcggcggcgacgactacggccgcagcggcggcgatgggtatggaaggtccggcggcgacgactacggccgtggcaccggcggcggcgggtacaacaagtccggcaacgacggctacgacagcgggtacaacagatcgggcaccaccaacgacgacgaatacggccgtggcaccggcggcgggtacggcagcaagccctctggcgacgacgcgtacgccggcggcggcggtggcgggtacggcaagcagtccggtggcggcgcggactaaggcggagagtacggctcctcccggacaccgnnnnnaaaaantacaggaaagggagagaaggagcacaagcacaatgagcacctcggcgagatgggcgccctcgncgccggcgccttcgccctgtacgagaggcacgaggcgaatgaagacccggacacgccagcgcacaatcagattggggg

SEQ ID NO: 94604 - protein, 136 aa, Zea mays
  misc_feature: Ceres CLONE 1584477
  misc_feature (5)..(5): Xaa is any aa, unknown, or other
MTTAXGEGGYNKSGGDDDYGRSGGDGYGRSGGDDYGRGTGGGGYNKSGGGDDYGRSGGDGYGRSGGDDYGRGTGGGGYNKSGNDGYDSGYNRSGTTNDDEYGRGTGGGYGSKPSGDDAYAGGGGGGYGKQSGGGAD

SEQ ID NO: 94605 - DNA, 813 bp, Zea mays
  misc_feature: Ceres CLONE 1584478
  misc_feature: Encodes the peptide sequence at SEQ ID NO. 94606
  misc_feature (565)..(565): n is a, c, t, g, unknown, or other
  misc_feature (567)..(567): n is a, c, t, g, unknown, or other
  misc_feature (597)..(597): n is a, c, t, g, unknown, or other
  misc_feature (676)..(676): n is a, c, t, g, unknown, or other
  misc_feature (677)..(677): n is a, c, t, g, unknown, or other
  misc_feature (680)..(680): n is a, c, t, g, unknown, or other
ctccccgcggtggcggccgctctagaactagtggatcccccgggctgcaggaattcgtctcacccctagaaaaaaccctgcccacccgaacaataaccaacagcttcaccctcctcctccagtgcaggccgtcggcggctggcggcgtcatttctcctccttcctctggcctgccctgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtaggtagccaagaagacatgagatgggggcgtccttgggctccgccgccagcaagaaccggcagcaggagcacggcggcgaagctccgcgaccagatccctgcaagaagacgcggctctcgacccttctctgcactatccacggccactcgaggctgatcccggggctccgggatgaagtctctctgcagatcctcgcgaggatgccgcgaatggggtacctcaaggncnagatggtctcgcggagctggaaaagcggcngtgaaccggccggagctgtaccggctgaagaaggagctccgcgtgggccgaagagtggctgtacatactggacaaagcnngcngcaggtgggcaaaaactggtcttggacccttcccaatcgggtagcaccaatggcaaaggctgccgctcatgcctgggatccaatgcaggattggcggcttttaacggctgggctttccgggacttgttgaccc

SEQ ID NO: 94606 - protein, 151 aa, Zea mays
  misc_feature: Ceres CLONE 1584478
  misc_feature (69)..(69): Xaa is any aa, unknown, or other
  misc_feature (70)..(70): Xaa is any aa, unknown, or other
  misc_feature (80)..(80): Xaa is any aa, unknown, or other
  misc_feature (106)..(106): Xaa is any aa, unknown, or other
MGASLGSAASKNRQQEHGGEAPRPDPCKKTRLSTLLCTIHGHSRLIPGLRDEVSLQILARMPRMGYLKXXMVSRSWKSGXEPAGAVPAEEGAPRGPKSGCTYWTKXAAGGQKLVLDPSQSGSTNGKGCRSCLGSNAGLAAFNGWAFRDLLT

SEQ ID NO: 94607 - DNA, 803 bp, Zea mays
  misc_feature: Ceres CLONE 1584480
acccgcggtggcggccgctctagaactagtggatcccccgggctgcaggaattcgtctcacccctagaaaaaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactggctcacgcctatacgagctggtggaccaagaacaagcagcgcaacaaacgccgggtggtcccggatcccctttttccccggggggggtgtggggggggggccccccccccccccttaaatcttttcggggggtttttttggtggttttttcccgccccccccccccctttctgggggtttataaaaaaaaaaaaatccccccgggaaaaactcttctgccacctagtggggtgtgtgtaggcctcccaaaaagaagaccccccccccacaaaaaaaaaaaggatctctttttttgcgagaaacctctctctttttgttgtgtggtgctttttcgcccgccccgccccccaagaaaagaaaaagggtcccccccccccacaaattaaggggggggggaggtccctctcccgtccctcccgtcataaagggtgggggggggggagggaaaaatacccccccccacacgtggggggtggaggttttcatgtataggtcggcccggctgaggtttggttccttaaaaaaaaaagggtggagttggtcggccc

SEQ ID NO: 94608 - DNA, 803 bp, Zea mays
  misc_feature: Ceres CLONE 1584486
  misc_feature: Translation starting site: 599
  misc_feature (476)..(476): n is a, c, t, g, unknown, or other
  misc_feature (711)..(711): n is a, c, t, g, unknown, or other
  misc_feature (748)..(748): n is a, c, t, g, unknown, or other
ctggagctccccgcggtggcggccgctctagaactagtggatcccccgggctgcaggaattcgtctcacccctagaaaaatgcaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttagaagcttctgcttcttttatgtctgaacaatctttgctttatttgggaattgttgggagagtactctcgtgcaactaggaaaaggcacaaggttccgtcccactgcatgcgtcaagagactgtctggttttcttgttctgatttgtcatttgctggtgctcaaagccgggcttggtttcctcgaaggatcagcatctactcttgattgtggactttgtcgcatctgatatcaacttcataaatctttatccangatggcgctgcaaaacattggtgcttcaaacagggatgatgccttctacaggtacaagatgcccagaatgattaccaagatagaagggccgtgggtatggtatccaagacaatgttgtgaacatggttgacatagcaaaagcacttgccagggcagcttccctacacaccaagtactttggatgtgagcttggtgcacagtccaatttgatgagaagacagggatttcttgggtnacggggctcatgatactgcaaagctggctggtctccntgaggattcatcagaagatgtcaaatgtaagtggggtggaatcctggacagagac

SEQ ID NO: 94609 - DNA, 848 bp, Zea mays
  misc_feature: Ceres CLONE 1584488
  misc_feature: Encodes the peptide sequence at SEQ ID NO. 94610
tggagctccccgcggtggcggccgctctagaactagtggatcccccgggctgcaggaattcgtctcacccctagaaaaaatactctgcgtgtctaccaaatttttttattcttcttccatatacttctccaacagatgctcctatggagtgtgagaggcaccggccgcagatgggggtcgacttcagttcgaccttgtcaagacctgggtgcttccagtgtctcgcaacccacatagtggccgagtgtgggcgcacccggacatgcttcgttcttatgccccggaaagaaatcctgacagactcgtgactgacgccgcctacaaccatgtactcctgaaggccatccgccgattactatacccgaatccgctctgagtgactcccttcatcatgagacgactacttcagacatgcaccctagccaacggcctttcactaggatatcgagttcctgccactaccccatgatcagggtgcatctcgggggcgaggagatacactccgcgccccagaagttcagctccatgatcctgatcagcatgaaggacacgggcgatgcttccctccgcgccaccaatattaactgctgtcgtcagcagggccaacatacttccagtactctacgctccaatccacccaggacccctagactcatctcagtgctcatggtcctgcgcattatctatgagcccaccggacacgatcatcaaattctgtctcgaccccccgtcaatcatctaccggttataataacgtcctaatctttcgattttggcggcggtccattttgacctattgctccatatggtagaaggagggcttccttttcaggttcagggtcccccgc

SEQ ID NO: 94610 - protein, 98 aa, Zea mays
  misc_feature: Ceres CLONE 1584488
MIRVHLGGEEIHSAPQKFSSMILISMKDTGDASLRATNINCCRQQGQHTSSTLRSNPPRTPRLISVLMVLRIIYEPTGHDHQILSRPPVNHLPVIITS

SEQ ID NO: 94611 - DNA, 838 bp, Zea mays
  misc_feature: Ceres CLONE 1584491
  misc_feature: Encodes the peptide sequence at SEQ ID NO. 94612
  misc_feature (678)..(678): n is a, c, t, g, unknown, or other
  misc_feature (838)..(838): n is a, c, t, g, unknown, or other
ctccccgcggtggcggccgctctagaactagtggatcccccgggctgcaggaattcgtctcacccctagaaaaaataaccatcccgcagacccccacaggccacagtccaatcggcggccctctcgaccggaccggacgcctggactcgcaagtcgcaccagcctacttgttacttaagctcggctcgctcgcttttgcgccagtgagcagaccggcagagaaactgcagctacgtgcttgcatgaaatggcgcccgccgtgcaggaccgcctcccgttcctagcctcgcccccggcgcccccgcccgcgcgggagaggggccggaacccgtccctcgccgagatgctccgcctcgtcggcgccgccaccaccaccaccgtcgacacggcggacgacgacggcaccgcgtcggtgttctcgctcccgctcgcgctcgccaccactcccggacgtgacgcggtggcggggggcgcgagcgcgacgaccatcgcgcgcaccgtgcacttccgcctggcgttcagcaacctgacctacagcgtccgcgccaagcagcgccggcgcggccccagcctgcccctgcagagccgcgtcaccgccgccgccgcgggggcgcccgacgcgcacgcggcgcgcaccagggcgctgctggacggcgtatccggggaagcgaggcaggncgagatccctggcgtcatgggcgccagcggctccggcaagtccacgctcatcgacgcgctcgcctaacgcatctcccgcgacgcgctcaagggcgccgtcacgctcaacggggaagccctcgtcggcgacatcatcaagtccatctccgcctacgtcatn

SEQ ID NO: 94612 - protein, 165 aa, Zea mays
  misc_feature: Ceres CLONE 1584491
  misc_feature (144)..(144): Xaa is any aa, unknown, or other
MAPAVQDRLPFLASPPAPPPARERGRNPSLAEMLRLVGAATTTTVDTADDDGTASVFSLPLALATTPGRDAVAGGASATTIARTVHFRLAFSNLTYSVRAKQRRRGPSLPLQSRVTAAAAGAPDAHAARTRALLDGVSGEARQXEIPGVMGASGSGKSTLIDALA

SEQ ID NO: 94613 - DNA, 838 bp, Zea mays
  misc_feature: Ceres CLONE 1584498
  misc_feature: Encodes the peptide sequence at SEQ ID NO. 94614
ctggagctcaccgcggtggcggccgctctagaactagtggatcccccgggctgcaggaattcgtctcacccctagaaaaaaaatactggggattggggaggctaatgacgaagtgcaaaagttttgatgagttgctagagttgagccagcgtggagacaatagcaccatggacatgcttgtaggagacatatatggtggtctggactactccaagattggcctttcagcatctacaattgcctctagttttggaaagataatttcagaaaacaaggagctatcagattatagacctgaagatatatcgctctctctgttacggatgatttcatataatattggccagatttcctatcttaatgcacttcgttatggactcaagaggatattttttggtggattcttcatccgtggtcatgcctacactatggatacaatttcttttgcagtgcatttctggtcaaaaggagaggcacaagctatgtttctgcgccatgagggctttctaggagctcttggtgcatttatgagttatgagaagcatggtcttgatgacttaagggtacatcatttggttgaacgcttcccaatgggtgctccatatgttggtgggaagattcacgggccaccctcttggagatctcaatgagaagatatcatggatgggagaagtttgtggcaaagggtactcagattatagcccctgtacctttgggagttccagctacgacaggtatggggaggcttttgaagggccgactggctagggtgacatcttgccggccagatggcagtgcaacgcctaaaatgtcggtggtcctccatcttgtacccaca

SEQ ID NO: 94614 - protein, 215 aa, Zea mays
  misc_feature: Ceres CLONE 1584498
  misc_feature (2)..(179): Pfam Name: Fumble Pfam Description: Fumble
  misc_feature: SWISSPROT Homolog: EC 2.7.1.33 Pantothenate kinase
GAHRGGGRSRTSGSPGLQEFVSPLEKKYWGLGRLMTKCKSFDELLELSQRGDNSTMDMLVGDIYGGLDYSKIGLSASTIASSFGKIISENKELSDYRPEDISLSLLRMISYNIGQISYLNALRYGLKRIFFGGFFIRGHAYTMDTISFAVHFWSKGEAQAMFLRHEGFLGALGAFMSYEKHGLDDLRVHHLVERFPMGAPYVGGKIHGPPSWRSQ

SEQ ID NO: 94615 - DNA, 891 bp, Zea mays
  misc_feature: Ceres CLONE 1584499
  misc_feature: Translation starting site: 179
  misc_feature: SWISSPROT Homolog: EC 2.3.3.1 Citrate (Si)-synthase
ggagctccccgcggtggcggccgctctagaactagtggatcccccgggctgcaggaattcgtctcacccctagaaaaaagcaggctcccctcctcgcccgcccccgtacgtgtccatctctccactcctttcctttccttgttggtaagagcaaggcgagacgtaacgtaatccggccatggcgttcttccggggcctcaccgcggtctcgagactgcgatcccgcatggcgcaggaggccaccacgctgggtggtgtgagatggctgcagatgcagagcgcgtccgacctcgatcttaagtcccagctgcgggaactgattccggaacagcaaggaccgcttaaagaagcttaaatcagagcatgggaaagttcagcttggaaacataacccccgatatggtcctttggtggaatgagagggatcattggaattgctttggggagacatccctagtcgaacccagagggagggtatttcgtttttagggggcctcttcaaatcccagaaggggcccaaaaaagtgctggccaaacagccagtttgaagggggggggggaacccttttgcccctgaaggggtcttccttctgggctttccttttttgacagggggaaagggcccccaacccaaaaagatacaaggttgaaaggcctctatttccaaaaaaaatttgctttggcgcgccctcaaacttgttccccagggttatttttgaatccccccccgctggggctacccttgggggttttattgggttttggcccccattttaaattcttcccaaactcttttgaaaaggaacactgaaggccgaaaatctccccccgcgtgttcccaaagtttcaaaggggggggctccccaaatttttataaaaaggggctttttat

SEQ ID NO: 94616 - DNA, 846 bp, Zea mays
  misc_feature: Ceres CLONE 1584501
  misc_feature: Encodes the peptide sequence at SEQ ID NO. 94617
ctccccgcggtggcggccgctctagaactagtggatcccccgggctgcaggaattcgtctcacccctagaaaaagtctttcccccccagccagcctcgcctcaccgactccccgatccggtccctcccttcgccagctatgcacccctcctccggcgcgggggactacgccccttactacccaccttacccctccccggccgcgccgcctcccgccgcctacccgtcggtgtccgccccggcttccgcgcccccgtactcgtcgtaccccgcggacttcgcccccgcgccttcgtaccccgcgtacccgcccgccgacctcccccactacgcgccgccgccggctgcgcccgcgcccccgcagccgtactacccctacgagccggcgccggcgccgccgctgccgccgtccccgcacaacccggtgccctctccgtacccgtcgctggatcgggcggggagctacggctacggatccggccctggctccgggtacggccaggagctgtacccgcccaagccggcgggcgggtggtccgacgacggagcgtacgcttacaacggcggcgacgcgccggagccgtacgggtccaggggcaccgcaccgaggccgggctcgggatccgcgctgtttgatgactacgggaggccattgctcctcccccccaaagggggggggcccccccgggggtacccccgccagccccaaaggtggggaggggcgtgcccaaggcagagacgtcagaggacgttcggggttggggggcagaagttcaaggttcagctgctgcccgaaggcgctgggagccccatggatgtgctctgtcaggttggtctggatgggaat

SEQ ID NO: 94617 - protein, 236 aa, Zea mays
  misc_feature: Ceres CLONE 1584501
MHPSSGAGDYAPYYPPYPSPAAPPPAAYPSVSAPASAPPYSSYPADFAPAPSYPAYPPADLPHYAPPPAAPAPPQPYYPYEPAPAPPLPPSPHNPVPSPYPSLDRAGSYGYGSGPGSGYGQELYPPKPAGGWSDDGAYAYNGGDAPEPYGSRGTAPRPGSGSALFDDYGRPLLLPPKGGGPPRGYPRQPQRWGGACPRQRRQRTFGVGGQKFKVQLLPEGAGSPMDVLCQVGLDGN

SEQ ID NO: 94618 - DNA, 999 bp, Zea mays
  misc_feature: Ceres CLONE 1584505
  misc_feature: Translation starting site: 669
ccgcggtggcggccgctctagaactagtggatcccccagggctgcaggaattcgtctcacccctagaaaaaagaggcttgctcctccctccaataattcccttccgcctctcctcccgtcctctcgcaagcccacaccacacctgcagaaatcacagcggcaggtgcagcaaaaatctccatgcccccgctcggctagatctccgacgagccggccccgcgctgtagcagattcgctccccgatcccgaccgatgggcggtgaggtgccggagccgcgccggctgagccgcgcgctcagcttcggctgcggcggcgtccccgaggaggcgctgcacctcgtgttcggctacatggacgacccgcgagaccggggaggcggtctcggtccccccccccctctggcaccgcatcgacgcgctctcgcgcaagcacgtcaccgggggcttctgctacgccggggaaacccgcgcggctgctcgccaggttccccgcgggctcgagtcggctcgcggctcaaggggaggccaccgcgcccgccatggtacgggcttcatccccccaaaaactttgggggcctaacccggcgcccccctgtggtcgcccaaagcttcccccccgccccctttgaacggcccctcaaggggcgctccccaccctggcgttcgcaatggaaccgccccccccgaacaaaggaacaatcccccgtgtgttttggtcaacacgctgcggtgggccctcatggtgtttaaggggggtcttccaagcgtcaaaaagaggggtttccgggcttttctaaaaaagagagcccccctcgagctttgttgtggggggcttccttggaggtggtttctgaagaacacttgttttcttgggaaaaaagtgttaattctgagagataaaaggggggggaaaaggctccctggaaacacacctggtgaaaaaattttgtttctgggggagaccggatattttttacggacaaaaaactaagggggggc

SEQ ID NO: 94619 - DNA, 837 bp, Zea mays
  misc_feature: Ceres CLONE 1584506
  misc_feature: Encodes the peptide sequence at SEQ ID NO. 94620
  misc_feature (837)..(837): n is a, c, t, g, unknown, or other
ggagctccccgcggtggcggccgctctagaactagtggatcccccgggctgcaggaattcgtctcacccctagaaaaaaggctccacttcccttcgcgcgcacgcctccgcctccgcccccgcgacttcgtcgagcacctgcacttgcacctccacgggcgcgcccatggcaaccggatccgccgcgggagaggagtcatcggcggcggcgcgccgcctccgccgcctctccctgcaccttctccagcccgcccgggccccggccccggccgaccgccaccagcagcagctggccctcgcggcgtgcgcgcgccgcgtcgagggcggcgcggacgtggcggcggcgctcgcggcgtacctccgcggccggcaccgcgccgcgcagatgcgtctgttcgacttcttccgggcgcgccccgacctgcagacgcccgtcgagctgcccacggccgcgcaccgcgagctctgctaccgccagctgcgcgcgctcgtgcgcgaggccggggtgcgcccgctcacgctcatggccaccgaccccgccgagtacttcgccgtcatggaggccgccggcggggccgacatctccctcggcgtcaagctcggcgtccagtacagcctctggggtggttctgtcataaatctaggaaccaaaaagcacagagataagtactttgatggaattgacaatttggattatccaggctgtttcgcaatgacagaactacatcatggatcgaatgtccaagccctacagactaccgctacatttgatcctgtcactgatgagttcattatgtacactccaaatgatggagctatttaagtggtggatcggcn

SEQ ID NO: 94620 - protein, 218 aa, Zea mays
  misc_feature: Ceres CLONE 1584506
  misc_feature: SWISSPROT Homolog: EC 1.3.3.6 Acyl-CoA oxidase
MATGSAAGEESSAAARRLRRLSLHLLQPARAPAPADRHQQQLALAACARRVEGGADVAAALAAYLRGRHRAAQMRLFDFFRARPDLQTPVELPTAAHRELCYRQLRALVREAGVRPLTLMATDPAEYFAVMEAAGGADISLGVKLGVQYSLWGGSVINLGTKKHRDKYFDGIDNLDYPGCFAMTELHHGSNVQALQTTATFDPVTDEFIMYTPNDGAI

SEQ ID NO: 94621 - DNA, 849 bp, Zea mays
  misc_feature: Ceres CLONE 1584507
  misc_feature (416)..(416): n is a, c, t, g, unknown, or other
  misc_feature (423)..(423): n is a, c, t, g, unknown, or other
  misc_feature (424)..(424): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (490)..(490): n is a, c, t, g, unknown, or other
  misc_feature (491)..(491): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (768)..(768): n is a, c, t, g, unknown, or other
  misc_feature (781)..(781): n is a, c, t, g, unknown, or other
  misc_feature (782)..(782): n is a, c, t, g, unknown, or other
  misc_feature (822)..(822): n is a, c, t, g, unknown, or other
  misc_feature (823)..(823): n is a, c, t, g, unknown, or other
  misc_feature (833)..(833): n is a, c, t, g, unknown, or other
  misc_feature (841)..(841): n is a, c, t, g, unknown, or other
tggactcccgcgggcggccgctctaactgtggatcccccgggctgcggattcgtctcacccctagaaaaaaaaccaaaccactctcctactacagctctcggcctccctcgcgttctctccatcaactggcgaactgctcctgctcgtctcttccacaccaccattttgtcggattcgggacctatcgccggatcttccgcggcggcgaatgcgatccctcgcgggctgcaggacacatcaagcttgcgcggaattacgcgctcgagggcccttatacaaaaccccccccattaattttttttttgaaaaaggggggcccctttttggtcccacaaaaattaaccaaaaaagggccttttctaaaaaaccctccttttttttgggaaaaaaaaaaaaagctccttttttggggggnccccccnncgggcaaaaaaagttgtaataaaccccccccgccnnnnnnaagggggagagcctggggannntggnnannnnnnnnaaaacctttttctcccccaaaaaaaccccccgaaaaaaaaaccttgggggagagggggccccccaaccccccttttttgcnnnaaaaaaaaaaaaaattttttttttccccccgggggggaaaaaaaaaaaaatttttcccccccctttttttttttaaaaaaaacaagggggggggggggcccccccccgcggggggtctccccccccccccccaaaaaaaaaaaagggggtgctcttctttggaaaaaaaaaccccccccaacaanggggggccggggnncgtttttttttttttttggggggggagacacccccccccnnccccctaagnaaaataantaataaaa

SEQ ID NO: 94622 - DNA, 889 bp, Zea mays
  misc_feature: Ceres CLONE 1584509
  misc_feature: Encodes the peptide sequence at SEQ ID NO. 94623
  misc_feature (622)..(622): n is a, c, t, g, unknown, or other
  misc_feature (677)..(677): n is a, c, t, g, unknown, or other
aaagctggagctccccgcggtggcggccgctctagaactagtggatcccccgggctgcaggaattcgtctcacccctagaaaaaacacaccacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaaccagaacaagcacgtcgtgcaggacatggttaggttcggccagcaatggaactatgggctcgaggctggctccaagccagaactgctcatcgccatgagctgcctccccgtcaccgaagccgagcccaagccgtacttgatctgncacggctacagggacgcggactacatcgcgctcgcgctctcggcgcgggcatggnccttggaccgcatcatcgtgctcgagatggaggaggagcttgtcatcgtccttcgacagtacaagagctgcagcaaaagctgccagacaaccatgccgtgcgccccaagaggttcgagccgggcatcggcatccgcggccagcttcttcaccaagctaccaggcactttcggttcgacagccgggaaaccacgggcagttttcgaatgctca

SEQ ID NO: 94623 - protein, 245 aa, Zea mays
  misc_feature: Ceres CLONE 1584509
  misc_feature (73)..(245): Pfam Name: Orn_Arg_deC_N Pfam Description: Pyridoxal-dependent decarboxylase, pyridoxal binding domain
  misc_feature: SWISSPROT Homolog: EC 4.1.1.19 Arginine decarboxylase
  misc_feature (156)..(156): Xaa is any aa, unknown, or other
  misc_feature (175)..(175): Xaa is any aa, unknown, or other
MDKNYGELYNILGWGEEYFAVNTEGHLSVKPFGRWTEPGQEIDVHSVIVEALATQPNDSTSKSQFPMILRFPDVLKNRIETLHNAFNSAMESTGYTSRYQGVFPIKVNQNKHVVQDMVRFGQQWNYGLEAGSKPELLIAMSCLPVTEAEPKPYLIXHGYRDADYIALALSARAWXLDRIIVLEMEEELVIVLRQYKSCSKSCQTTMPCAPRGSSRASASAASFFTKLPGTFGSTAGKPRAVFECS

SEQ ID NO: 94624 - DNA, 957 bp, Zea mays
  misc_feature: Ceres CLONE 1584510
  misc_feature: Encodes the peptide sequence at SEQ ID NO. 94625
ccgagctgaagctcaccgcggtggcggccgcattagaactagtggatcccccgggctgcttgaattcgtctcacccctagaaaaagtggtagaatttggttctcaatggggcagggggtggtgttctgtaaacgtggttccgtttcaactcttgcagttgaaattattgtggtgccgacagtattttagagcagagaatgaggttccccttcgtgaaggaaaaaaaaaaaaaaaaaaaaaaaaaaaaaaaaaaaaaaagtcgtcgtcgcacggattggcattggctgccctccggccctgttcctcgtcctcctcatcaaatcccgtctcctcagtcctcccaataatggtggcgtggtgagaaatctttccgtccggccgtcgtcttaaaaaatgaactgttcctcttgctgcgccgctgccactccatcttctccggcgcttctcgccaggccgcgggggggtttagctgctaactgctccacgacgacagcaaatcaaaaggggcttttcctgggctcaaaacagtttccacggatcacgtaaagccgtgcttccgtacgggttgtccccgcagaaagggaatagctttttgccgggcaacaacccgtggaccttcggcaaaattggtaaaggccctttattttcctcgacggggcctcaaaacgtttctaaggagtgtagaaatttttctcagacgggtttccctgggaccggcttctcggggaaaccccaaaaaaaatgtaaaacattgaagtgggggttgggatattggaagccacccggtggggtttggggcgaaatgggggggggaccgcccttccaaaagaaaggagagcgccgagttaaagaattggctgagaaaatgttgagcacgggagagagacaaatgaggggtgccggatgggatccccccggatatctgggcgggtttgccgacggggggggggcgcgctt

SEQ ID NO: 94625 - protein, 50 aa, Zea mays
  misc_feature: Ceres CLONE 1584510
MNCSSCCAAATPSSPALLARPRGGLAANCSTTTANQKGLFLGSKQFPRIT

SEQ ID NO: 94626 - DNA, 960 bp, Zea mays
  misc_feature: Ceres CLONE 1584513
  misc_feature: Encodes the peptide sequence at SEQ ID NO. 94627
  misc_feature (363)..(363): n is a, c, t, g, unknown, or other
  misc_feature (369)..(369): n is a, c, t, g, unknown, or other
  misc_feature (398)..(398): n is a, c, t, g, unknown, or other
ggagctccccgcggtggcggccgctctagaactagtggatcccccgggctgcaggaattcgtctcacccctagaaaaatagaaaaacaagcctgtggacgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctccnttctcntcgcggcatctcgttggcccacgttcggnatggtcgtctcctaagggggccttttttgtccttgccggtttccgggaacccccggcgggggggaccctaccaaaggaaaaactggggcaaaaaacatcccggggggggggggggggtaaaaaaaaagggggcccaaaaaaacccaccctttcgagggggggtttaggggggagccccccctccctcgggggtggggagaaagaaaaaaaccggggccccccccgggggaaaaaaaccgcggggggacccccccccgggggggtttggggggggggaaaaaccccccccaaaaaaaaatttttttgtgccccggggcgggggggtctctaaaaaaaaaacgggggggggggggggtgttttaaaacacccccccctttgtgggggggggcgggggggcccccccccacaagaaagaggggggtccttctctcctctgggggggggggggagaatatttttcggggcgagaaaaaagggggtggagggaagagaaaataaaaacagacgaaaagggggggtggctaacaacaaaaaaaaatataactccctccctctccggtg

SEQ ID NO: 94627 - protein, 134 aa, Zea mays
  misc_feature: Ceres CLONE 1584513
  misc_feature: SWISSPROT Homolog: EC 1.10.99.1 Plastoquinol--plastocyanin reductase
  misc_feature (68)..(68): Xaa is any aa, unknown, or other
  misc_feature (70)..(70): Xaa is any aa, unknown, or other
  misc_feature (80)..(80): Xaa is any aa, unknown, or other
MATSAALSTAANPTQLCRSRASLGKPVKGLGLSMGRERAQRSIVCQAASSISADRVPDMEKRKLMNLXSXRGISLAHVRXGRLLRGPFLSLPVSGNPRRGGPYQRKNWGKKHPGGGGGVKKKGAQKNPPFRGGV

SEQ ID NO: 94628 - DNA, 883 bp, Zea mays
  misc_feature: Ceres CLONE 1584514
  misc_feature: Encodes the peptide sequence at SEQ ID NO. 94629
  misc_feature (641)..(641): n is a, c, t, g, unknown, or other
  misc_feature (672)..(672): n is a, c, t, g, unknown, or other
ctggagctccccgcggtggcggccgctctagaactagtggatcccccgggctgcaggaattcgtctcacccctagaaaaaatccaatccaatccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcgccgccgtcggtgccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgacaagtacggctgctggtcgggctcggcgacgatcctggaggacggcacgccggcgatcctgtacacggggatcgaccgggcggacatcaactaccaggtgcaggtgctggcgctccccaaggacgcgtccgacccgctgctccncgagtgggagaagcccggagagtacaactcngtggcgacgccgggcggctgcggcatcaacgcgacgcatttccgcgacccaacaacggcttggcggcacccggggcacttgccgaatctggtggccaccttgcccggccccccgggaatggccctgggttcccgaacccggaatttcggaaatggacaaagggcaaaaacctttttcctcttgggggtttaaaggggatatgggaatgccc

SEQ ID NO: 94629 - protein, 243 aa, Zea mays
  misc_feature: Ceres CLONE 1584514
  misc_feature (58)..(242): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature (170)..(170): Xaa is any aa, unknown, or other
MGTRPRGVVLAPWAVVLVLVLALRLAGASHVIHRSLEAEAPPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLXEWEKPGEYNSVATPGGCGINATHFRDPTTAWRHPGHLPNLVATLPGPPGMALGSRTRNFGNGQRAKTFFLLGV

SEQ ID NO: 94630 - DNA, 894 bp, Zea mays
  misc_feature: Ceres CLONE 1584520
  misc_feature: Encodes the peptide sequence at SEQ ID NO. 94631
ctggagctccccgcggtggcggccgctctagaactagtggatcccccgggctgcaggaattcgtctcacccctagaaaaaactgccagtgccatcccattcccatccgagctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgccgtggcgttccccgagtgccccgccgactaccaggactacaccccctgcaccgaccccaagcgctggcggaggtacggcaactaccgcctcagcttcatggagcggcactgcccgccgccgcccgaacggcagcagtgcctggtgccgccggccaaggggtacaagccgcccatccggtggccctagagcaaggaccagtgctggtaccggaacgtcccctacgactggatcaacagcagaagtccaccagcactggctcgttcaggaggacgaccgccttcggtttctcggcggcggcacatgttcccccacgggcgtccgcgcgtacgtgaacctgaatgcgggcctggttcccgggcatggagcaacggaaccgtctgcaccggttgagacccggatgacgtgtcccccgctgggggggggaacttgttgggggcgggggatccttccacgtgtcgctggggcccaaggaaaaccaaa

SEQ ID NO: 94631 - protein, 147 aa, Zea mays
  misc_feature: Ceres CLONE 1584520
MKYSKEDKPERAGGAGAGSRAVPVALVVVVLCAFSFYLGGIYSTGRSLLDSIQPAPTALLALGAATTTRRPSDDGQARPALASTAAVAFPECPADYQDYTPCTDPKRWRRYGNYRLSFMERHCPPPPERQQCLVPPAKGYKPPIRWP

SEQ ID NO: 94632 - DNA, 844 bp, Zea mays
  misc_feature: Ceres CLONE 1584523
  misc_feature: Encodes the peptide sequence at SEQ ID NO. 94633
aaagctggagctccccgcggtggcggccgctctagaactagtggatcccccgggctgcaggaattcgtctcacccctagaaaaaccggggtacctcagccgactcttgcggaaacaaacaaaacaccctcccaccctttgcgctggccgttgcggcctgtctgtctccccgtgacgtctcccggcggctcctggcatcggcgctctgcctcgcctctcctcctgcggcggcggagagaggagggcgacggacggcatcatgaagcgcctagtagtcgtcctggcattggcgctggccgccgcgctcggcccggccacggcgcgcgcccagctgcggcgggaccaccaggcgccgccgggcccgcgcccgcacagcgtcaccatcaccgagttcggcgccgtcggggacggcaggacgctcaacacggtccccttccagaacgccgtcttctacgtccgctccttcgccgacaagggcggcgcgcagctgtacgtgcccaggggccgctggctcaccggcagcttcaacctcaccagccacctcaccctctacctggaggaaggcgccgtcatcgtcggcgcataggactcatcacaatggctgatcgttgaacctttgccatcttatggccaagggctagaccttcctggtcctagacatcaaagcttgatcagcggatacaacttaaccgatgttgtcataaccgggaacaatggagttattgatggccaggggcttggtatgggtggcagtggttgcgctcccatgagctgaaacatagccgacccaaccctctggagttcttgtattccggaggatattggcatctcaaaattgacattca

SEQ ID NO: 94633 - protein, 108 aa, Zea mays
  misc_feature: Ceres CLONE 1584523
  misc_feature: SWISSPROT Homolog: EC 3.2.1.82 Exo-poly-alpha-galacturonosidase
MKRLVVVLALALAAALGPATARAQLRRDHQAPPGPRPHSVTITEFGAVGDGRTLNTVPFQNAVFYVRSFADKGGAQLYVPRGRWLTGSFNLTSHLTLYLEEGAVIVGA

SEQ ID NO: 94634 - DNA, 826 bp, Zea mays
  misc_feature: Ceres CLONE 1584527
  misc_feature: Encodes the peptide sequence at SEQ ID NO. 94635
  misc_feature (562)..(562): n is a, c, t, g, unknown, or other
ctggagctccccgcggtggcggccgctctagaactagtggatcccccgggctgcaggaattcgtctcacccctagaaaaaaggctgggcgcatgcatccgaggccgcctcaccccgcgcatctccctcgagctctccctctagggttttccgccggcaccctcagccgccgctgtcgagctctccctctcgtgtctccactcgccctcgagctctccctctccgtctccagtcgtcgtgaactagggtttggcgctctcagccgccgctgttgagctccccctctctccctctcccgtctccactcgccctcgagctctccctctccgtatccactcgttgtgagctagggtttgacgcccttactcgccgctgtcgagctccccccctctccgtcgagctcgcctcagtccccgttgtggagctctcgcactctccaggtttctccgctgcctcagccgccctcgctgtcgctgagccgacagattcattcgaccggtcatggctgacacgttgtgcaacggcgccatggtgtccccgtgcggccgggacgttgctggccngggccaggggcgccgccagggccgccgctcgcgaagtccctgcagggcgcccggcacagcagcaagaactcctttctcccctgggaagaatgtcggtcaaggaacgcaaggccaagccccctgtccggtatcccccaaggccccccccccacggaaaaatgaacccgggcgttcccccaaggccattccgggggggggaaaaaaggggtctccccccaaatttgcccgaagggaaaatcccccaagggaaccctcccaaccccc

SEQ ID NO: 94635 - protein, 108 aa, Zea mays
  misc_feature: Ceres CLONE 1584527
  misc_feature (21)..(21): Xaa is any aa, unknown, or other
MADTLCNGAMVSPCGRDVAGXGQGRRQGRRSRSPCRAPGTAARTPFSPGKNVGQGTQGQAPCPVSPKAPPPRKNEPGRSPKAIPGGGKKGSPPKFARRENPPREPSQP

SEQ ID NO: 94636 - DNA, 905 bp, Zea mays
  misc_feature: Ceres CLONE 1584528
  misc_feature: Encodes the peptide sequence at SEQ ID NO. 94637
  misc_feature (495)..(495): n is a, c, t, g, unknown, or other
ggagctccccgcggtggcggccgctctagaactagtggatcccccgggctgcaggaattcgtctcacccctagaaaaaggccattccgcccgcatgaagccccaaaccctcttcggcatcgccttcgccgcagcagcgcccgcgtagcccgcccctctcgcccccgcccgctcgcccgctcctcgatcccgcccgctctgcagccgatcccgccgggagcacgaccgattacgatgaacggcgccgcggcaccggagcgctcgccctcaccctcgcccccgcctccggcccaggcccaggcccaggcgccgccgtcgccctctccggctcagccgctcgagtggaggttctcccaggtgttcggtgagcgcagcgccggggaggaagtccaggaagttgacatcatctcagcaatagagttcaataaatcaggacatcatcttgccactggagacagaggtggacgagttgttttatttgaaaggactgatgtcnaagatcatgctttgtagaaagatgctgagaaagctgatcattctatcagcaggcatcctgaatttcgctacaaaactgaggttcaaagccccgaaccaggagtttgattatcttaagagcttggaaatggaagagaaagataacccaaataaatggggtcaaagacacaatgggcccattgatctttcttcccccaagggcaaaactttaaagtttttggaaggccaaaaaaaagagggaaaaaaacttttgggaagaatttgggccgttccccctccccccaaaagggaaacccggggggggggggaattcggaccccctctccctcaagggggagggctaaaaacggggggggttttttgttttcccgcgcgggggggggaaaaaacaaaaaaaaattttgctcatga

SEQ ID NO: 94637 - protein, 92 aa, Zea mays
  misc_feature: Ceres CLONE 1584528
  misc_feature (88)..(88): Xaa is any aa, unknown, or other
MNGAAAPERSPSPSPPPPAQAQAQAPPSPSPAQPLEWRFSQVFGERSAGEEVQEVDIISAIEFNKSGHHLATGDRGGRVVLFERTDVXDHAL

SEQ ID NO: 94638 - DNA, 820 bp, Zea mays
  misc_feature: Ceres CLONE 1584529
  misc_feature: Encodes the peptide sequence at SEQ ID NO. 94639
ctggagctcaccgcggtggcggccgctctagaactagtggatcccccgggctgcaggaattcgtctcacccctagaaaaaaaccatgaaacggttctctttcccgttccaactcccatccaaacgccaccatacagagctccgttcagcgcctaccttttcttctgcccgtccaccgtgcgcgaggcgctctctcgtgtagctactagacgaccgccaccgccgtctggtcttcgtcgggtccttcgccgatcaacacccaccatttatcgggtgtacatgtgtacacccatgtcctacactgggtccgcccccgagccttctgatcctaacaggaaacctgcaaaaaagcagactcgacaatgggctgcgtggacacaccaagaggaggagatttttttcaatgcgctgcggcaagtaggaaaaaactttgacaagattacacaccgtgttcagagtaaaaacaaggatcaggtcaggcattactattatcgtcttgttcggcgcatgaagaagctactgggtcctaggttctcacttgatgcaaaatactccaaggataccattgctgctatgcttcgctggtggtctctgcttgagaaatttagctgcactgcatcaaagttgcatctcaaacctcggaagttcaaaacatttgtagaagcactggggaaacatctgctgaaggacagaaataagtccaggagaaagcgttcacgagtggatatgtgcctaccttctgcatctccaattatcagcaaagctcctggcaatgagaatcctcctgtaaagatcctgtcagtagatgctcagaatggtaa

SEQ ID NO: 94639 - protein, 176 aa, Zea mays
  misc_feature: Ceres CLONE 1584529
  misc_feature (25)..(70): Pfam Name: Myb_DNA-binding Pfam Description: Myb-like DNA-binding domain
MSYTGSAPEPSDPNRKPAKKQTRQWAAWTHQEEEIFFNALRQVGKNFDKITHRVQSKNKDQVRHYYYRLVRRMKKLLGPRFSLDAKYSKDTIAAMLRWWSLLEKFSCTASKLHLKPRKFKTFVEALGKHLLKDRNKSRRKRSRVDMCLPSASPIISKAPGNENPPVKILSVDAQNG

SEQ ID NO: 94640 - DNA, 971 bp, Zea mays
  misc_feature: Ceres CLONE 1584530
  misc_feature: Encodes the peptide sequence at SEQ ID NO. 94641
gctctgaactagtggatcccccgggctgcaggaattcgtctcacccctagaaaaaacggtaccctcccgtccacgcgacgacaggacagacacccaccccatcaccggaagcaccgccaaagcccaaagccggccaattccgacgccatggccgacgtcgacgacgacgctgtcctctccgacgtcgacgaggacccactcccgcccccctccacctcttccgcctcttcccacaaatcccttccacaagctcaaccccaatcacagtccgatgcccaggcgcagcagcagcggctgctggacctggccgcggagctcgaggaggagcgccgcctccgccgcgcagccgaggcctccctcgcagaggccgagccccgcgtcgcccgcttcagggccttcgcgcaggaagcgctccgcaggcgcgacgacctcaccgcccaagccgcggcctccgcgcggtccctggccgcgctccgggccgaggggcgccaccggcctccttcctgggcgctcctctgggcttgcgagaggggtctcccgcccaagggccttccccctttccttgggggccccggaaccggttttcccgagaacttcccaagaaagggaaactccctgccggggcctgtcccgggggccctggggcggatgaaggggcgtgtcacccaaggggcgggcgcccatcggattttgtcgggcggaaccgaaaactgccttcggccccagggattgggaagcccgggccttaacggcggcgaggccggtgaattctgcggccgcgcggggaaaccgaagagtgggaaacaacccgaaaaacctgccaaaaaatggagccgttctcgagggctccgctgggagcctttgggggggatttggctctggatttcgcggggttctggccggaggggccggagttcccctctgccgatagtctcttctcctcccaggggggaggagccgagagagtttcc

SEQ ID NO: 94641 - protein, 274 aa, Zea mays
  misc_feature: Ceres CLONE 1584530
MADVDDDAVLSDVDEDPLPPPSTSSASSHKSLPQAQPQSQSDAQAQQQRLLDLAAELEEERRLRRAAEASLAEAEPRVARFRAFAQEALRRRDDLTAQAAASARSLAALRAEGRHRPPSWALLWACERGLPPKGLPPFLGGPGTGFPENFPRKGNSLPGPVPGALGRMKGRVTQGAGAHRILSGGTENCLRPQGLGSPGLNGGEAGEFCGRAGKPKSGKQPEKPAKKWSRSRGLRWEPLGGIWLWISRGSGRRGRSSPLPIVSSPPRGEEPREF

SEQ ID NO: 94642 - DNA, 953 bp, Zea mays
  misc_feature: Ceres CLONE 1584531
  misc_feature: Encodes the peptide sequence at SEQ ID NO. 94643
  misc_feature (386)..(386): n is a, c, t, g, unknown, or other
  misc_feature (819)..(819): n is a, c, t, g, unknown, or other
  misc_feature (874)..(874): n is a, c, t, g, unknown, or other
ccgctctagaactagtggatcccccgggctgcaggaattcgtctcacccctagaaaaaatcacttgttctctcttctctctctctcgtcgtgtgcctgggtcgaccagcgacctggctagctagctctccagctgcgcgcgccatggccaacccaacagctaccaagcatgctttcaagcgtattttgacgagcctgcttaagcctggcggtggtgaatacggcaagttcttcagccttccggcgctaaatgatccaaggatcgataagcttccctactctatacgtgttctcctggaatcagctatccgccattgtgataacttccaagttacagagagtgatgttgagaaaatcattgattgggaagaacacatctcccaaaanctggctggagataccctttcaagcccagcgcagatgcctttctaaatgggaaaaacactgggaagttccccaacaaggtttgtaagaaaccctttggcaacgcaatagggcgatgaaaaaataggatgttcccccaaaaaattgggggggaaaagggggttgttcccccccccacacaagaaaaaaaaaacaaccccctcctaattagagtaccccccccgctggaagggaagaagtattctcttttattttattaataaaaacacacactcctctcgcaatctttgggggagggggggtgttgtgatgtaagacgcgtcgcaagtgcgagagaaactgtaaccatgtatatgtgttgttttagctatcgtttcttcctagtatgggctttatagtagatacatagaagctggtgtgacgggggtgggttagntcagtaaagtctgatacacctcgatagacacccaccttaagtactgtaacatcanagacaagcaagggcggggctcgtgcgctcgtttggctttaatttccctaggtcagtaagagagaattgcgcggagttgg

SEQ ID NO: 94643 - protein, 95 aa, Zea mays
  misc_feature: Ceres CLONE 1584531
  misc_feature: SWISSPROT Homolog: EC 4.2.1.3 Aconitate hydratase
  misc_feature (81)..(81): Xaa is any aa, unknown, or other
MANPTATKHAFKRILTSLLKPGGGEYGKFFSLPALNDPRIDKLPYSIRVLLESAIRHCDNFQVTESDVEKIIDWEEHISQXLAGDTLSSPAQMPF

SEQ ID NO: 94644 - DNA, 771 bp, Zea mays
  misc_feature: Ceres CLONE 1584532
  misc_feature: Encodes the peptide sequence at SEQ ID NO. 94645
  misc_feature (509)..(509): n is a, c, t, g, unknown, or other
  misc_feature (510)..(510): n is a, c, t, g, unknown, or other
  misc_feature (677)..(677): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
acccgcggtggcggccgctctagaactagtggatcccccgggctgcaggaattcgtctcacccctagaaaaactctttccagccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgactttcgaagaccctcccgtcttccaagaaaggaaaaaggggggccccctgggccggggcctttgaaggaagttttatttggggaaggggcctcggggaaaaaaagaaaaaactttgttttccccccccgttggtttcccccggggggggccccttctttgggggggggaattcccaaaaaaannatttccgggggggggtaaaaacccggcgggggggggggggggccccccccagaggggggggccctctgcggggcaaaaaaaaccccccacaaaaaaaaattttgtggggagaaaaaaaaaaaccccccccccctttttttttgtgggggggggggggcacaacacancccgccccaggaaaataaaacacttttcgggggggggggcgtggtnnnncacaaaaaaaaaaatgtggttgggggtccccccccccccccccac

SEQ ID NO: 94645 - protein, 136 aa, Zea mays
  misc_feature: Ceres CLONE 1584532
  misc_feature (131)..(131): Xaa is any aa, unknown, or other
MAAATSSSTYLAIGRKTLNPAPSVATAATSVSFPATQHPCLVAASADRRRAVAAKVSSPSVIGTAMPSLDFRRPSRLPRKEKGGPPGPGPLKEVLFGEGASGKKRKNFVFPPRWFPPGGAPSLGGGIPKKXISGGG

SEQ ID NO: 94646 - DNA, 891 bp, Zea mays
  misc_feature: Ceres CLONE 1584534
  misc_feature: Encodes the peptide sequence at SEQ ID NO. 94647
  misc_feature (535)..(535): n is a, c, t, g, unknown, or other
ggagctccccgcggtggcggccgctctagaactagtggatcccccgggctgcaggaattcgtctcacccctagaaaaaactccttttttctcctctcaatctcccccgtctcccccctccctctcccttgcttccctctccagtccccagcgcgcgcgacacgacacgggccaatcacccagccgccgccgccggcgatcgccggaactcggcgccggtgcttccgagcacgctccgctcggaaccatggtgaggagcgggagcatacggcggtccgcggtgcccgcgcctatgccggcgccggcgtttaccgtgtctcccgccgactacaggctgctggaggaagtgggatacggcgccaacgccgtcgtataccgcgcggagttcattcccaccggccggacggtcgctgtgaagtgtctggatctcgatcgggtcaacagtaacctcgatgatgtaagaaaggagactcaaactatgagcttgatagatcaccctaatgtcatcaggtcttactgctcatttgttgtgggtncataatctttgggtggtaatgccattcatgtcagagggttcatgcttgcacctaatggaggttgcatatccccgatggttttgaggagcccattattggcctctattctaaaggaaacactcaaagctctagactacctccataggcaaggacatattcatcgtgatgtgaaggcaggtaatatccttatggataatcctggtgtagtcagctcgggggactttggtgtctctgcttgcatgtttgataagagcgatagacaaaggctaggaatacattggttggaacacatgctggaatgcaccagaagtctccagcctggaactgatataattcaagcctgaaaatggtcgttg

SEQ ID NO: 94647 - protein, 96 aa, Zea mays
  misc_feature: Ceres CLONE 1584534
  misc_feature: SWISSPROT Homolog: EC 2.7.11.1 Non-specific serine/threonine protein kinase
MVRSGSIRRSAVPAPMPAPAFTVSPADYRLLEEVGYGANAVVYRAEFIPTGRTVAVKCLDLDRVNSNLDDVRKETQTMSLIDHPNVIRSYCSFVVG

SEQ ID NO: 94648 - DNA, 853 bp, Zea mays
  misc_feature: Ceres CLONE 1584537
  misc_feature: Encodes the peptide sequence at SEQ ID NO. 94649
  misc_feature (423)..(423): n is a, c, t, g, unknown, or other
  misc_feature (512)..(512): n is a, c, t, g, unknown, or other
  misc_feature (530)..(530): n is a, c, t, g, unknown, or other
  misc_feature (531)..(531): n is a, c, t, g, unknown, or other
aaagctggagctccccgcggtggcggccgctctagaactagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacagaccnacaccgaagcggcgccggccagcgaccccgacaagctcttgagcctgctgccgtcgccgcccatgaagctccccatcatcgggcacctngcacctgatgggggacanntccctacgtgtccctcgccgcgctcgccaccaggtacggcccggaactgatgctgctccgcctcggcgcgtgccgaaccgtggtggtctcgtccgcgcgcgtcgccgaaggcgtgctccgacctacgaacacgtttttctctcccgccggggtccttggggtcgaaatcatcatgtacggggcccccgaattggggctttggcccaaagggaacactttcgaaagggccgaaaactggcacccggacactgctaaaccaaaaaggggggtccaaggcccccgggaaaaaaaaaaaaaggccccgcggcccccaaaaagggct

SEQ ID NO: 94649 - protein, 91 aa, Zea mays
  misc_feature: Ceres CLONE 1584537
MLLRLGACRTVVVSSARVAEGVLRPTNTFFSPAGVLGVEIIMYGAPELGLWPKGNTFERAENWHPDTAKPKRGVQGPREKKKKAPRPPKRA

SEQ ID NO: 94650 - DNA, 802 bp, Zea mays
  misc_feature: Ceres CLONE 1584538
  misc_feature: Encodes the peptide sequence at SEQ ID NO. 94651
  misc_feature (747)..(747): n is a, c, t, g, unknown, or other
ggagctccccgcggtggcggccgctctagaactagtggatcccccgggctgcaggaattcgtctcacccctagaaaaactctcaatctctctcttctcctcgcctcgccttggtgttcacgccgtcgctagcgcctgccgcggcgaagcttctgccctccccggcgccgggctcgggtcgtcgtcggccaggaagatggctggcggcttcagggtactgcatctggtcaggccttttcttgctttcttgccagaggtgcagagcgcggataggaagataccgttcagagaaaaagttatctacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagatcattgaagttgacaacagtgtgagagaggatcgtgctctgctgaatggtgcacaaaagttgcttggtatcctgattgctattggggaagctgtggcatatgtcctgtctggaatgtatggcagtgtaagccaacttgggacagggaatgctatcctcattatacttcagcttttctttactggcatcattggcatctgtcctgatgaacttctccagaaggttatggctggggatctggcatttctctgntcattgctacaatatctgcgagatttcatctgggaggcatttagccccccaacaa

SEQ ID NO: 94651 - protein, 202 aa, Zea mays
  misc_feature: Ceres CLONE 1584538
  misc_feature (184)..(184): Xaa is any aa, unknown, or other
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFTGIIGICPDELLQKVMAGDLAFLXSLLQYLRDFIWEAFSPPT

SEQ ID NO: 94652 - DNA, 747 bp, Zea mays
  misc_feature: Ceres CLONE 1584541
  misc_feature: Encodes the peptide sequence at SEQ ID NO. 94653
  misc_feature (613)..(613): n is a, c, t, g, unknown, or other
ctggagctcaccgcggtggcggccgctctagaactagtggatcccccgggctgcaggaattcgtctcacccctagaaaaagtccgcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaagttgagctggaggaccctgtggaaaacattggagctaatttggtcaggcaagctgcagctaagacaacgatcttgctggagatgggacaaccacctctgtggtccttgctcangggctgatgctgagggtgttaaggtcgtagcagctggggctaatccctgtcagattacccgtggtattgagaaacagctaaagactagttgaaaaactcggaagttgctaagggagtgaaaaaaaggaacctgc

SEQ ID NO: 94653 - protein, 132 aa, Zea mays
  misc_feature: Ceres CLONE 1584541
  misc_feature (131)..(131): Xaa is any aa, unknown, or other
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGANLVRQAAAKTTILLEMGQPPLWSLLXG

SEQ ID NO: 94654 - DNA, 867 bp, Zea mays
  misc_feature: Ceres CLONE 1584542
aaagctggagctccccgcggtggcggccgctctagaactagtggatcccccgggctgcaggaattcgtctcacccctagaaaaaatcgcatcgcgtcaccgccggcctctcgctttctcccctctcccccctactgcgtctccgaggcgcggacgacggcgacgaagcgaacggccccgccgcctaggcacatttgctgggaattagggcaatcgaatttgaagtacatttggtgtacactgtttgattattactgagattcagtcatttggttggatgagagttctggctggagacttacgagtgtagcactgttgtcggcttgtgattaaatagcatcacttcacatacagcactggataatggatcgtagggatacttcagggtttgttagtggagggtgcaaacataatgaagcctactaatttctgtagatcttctaaattggtagctttgttgacaattatttaacccagaagtgaggccagctggtacttgccataaagcttggttaggagcaatggatcccaggcacgggcgttcagcattcactataagtttctcaaatccaaatggctttgcgtatcagtgcactcccattccagccgtcagttattcagcaactggttctagccagcttgatgtgctagctcctagaggttgcaagagaaagtggactgagttggccctaggtctgggtgactcatcaagctcagacagcagcaagaggagcatgggtactggctgcactgtatcttctgcccaaggaagcgatgacgtctcatgtatggactacgacataggttttgagctatctctcgggcatggaggtacttcgaggctgtgtaaacaggcctgtgactctaa

SEQ ID NO: 94655 - DNA, 872 bp, Zea mays
  misc_feature: Ceres CLONE 1584543
ctccccgcggtggcggccgctctagaactagtggatcccccgggctgcaggaattcgtctcacccctagaaaaattgaaaataagcctactatccggagattcccaaataggtacaacctctttgaactgcctgctgattccatagagcacgcgacatgtactacctgccgaactgaaacatcttagtaccccgaggaaaataaagcacaagcgattcccatattagctgcgagcgaaatgcgagcatgcctaaaccgtgcaataacggggtcgtgggagagcaatactagcgttgtgctgataggcgatagcggttgagtgccgcaccctagatggctaaagtccagcagcggagagcatcactagcttacgctctgacccgagtagcatggggctcgtgacatcgcgtgtgaatcagccaggaccaccgtgcaaggctaaatactcctgagtgagcgatagcctaccaatatcgtgagggataggtgtacagatcccccagagggtagtgtaatagaacctgaaaccatgctgagcatccaagcagtgggaggggatagtgatctctacacgcatgcctgttgaaaatagaacccgccatccataggccgtggcttgggttaagggtatggaaccccacctaagcccttgccaaaagggaaccaaaccaagttccctcttatggcccaagccttttttcataaccgcccaaattccccccattcaaaaaaaaaaaaaggaaaagttttccttcaatgggatgccttttaacaaaatttttaaaacccccgcgcctattattttttttcccaaagagaaaccgcgcccccgaaatattctcccccccctctttaaaacaaactgggggcgg

SEQ ID NO: 94656 - DNA, 1003 bp, Zea mays
  misc_feature: Ceres CLONE 1584544
ggagctccccgcggtggcggccgctctagaactagtggatcccccgggctgcaggaattcgtctcacccctagaaaaatagtcttcagctcaggtcaggggcttacgagtccagccaatgacccgcctggcctccatgcacagtgagcacgcccatctgtctctctgtccgctcacccccacctatccgcccccgtctccgtccggacccgtgcgcctccgacttccccgtgggccagccggatgcggagccgaactcgaccttgttcgggaaggagagcccgaaccgcggcgggcgggagggctatgtttaggttgacgcgcctgaggtcagccgatccatgggacaatgagctgagcgcgctactgatcatctcatcgaccggcgggaacgctctagcggaggttggacatagtgagcggtgctagcaaataaggaaagcagggcttggggtgaatcactattgaaagcatctccgctttgacatgtaatccttggaccaaagatccgattaagaatgagttaactaaagtaaaggttggtttccaatagtggaaggatgggggatttagtgcataggaaaaaaaaaggccacggaaatttaaacgtcccaattggcaacgggaattttggttccccttcaggttagttttaaagggcgtctttattgggaaaaggggctacacaatgcccagagtataaggccggaagtttacggggggttgcattccggtaaaaaaggcatttcttgggattgggggctaaaggcacgtggagggtccttaataaactcccaaatgaaccacgcccacaccatggtttaggagaaataaggggcctttagggaaagaaactctcgttccgggacatgcccattatcttttgaaaaaaggtgtggaacagagggcgggaaacagagccccttggggggggaatatggcgcagagaagacaccccccctcttttaggggaaaaagtctctggcgctcttcgttagaaaaag

SEQ ID NO: 94657 - DNA, 834 bp, Zea mays
  misc_feature: Ceres CLONE 1584545
  misc_feature: Encodes the peptide sequence at SEQ ID NO. 94658
ctcaccgcggtggcggccgctctagaactagtggatcccccgggctgcaggaattcgtctcacccctagaaaaaacctagaaaaaacccttcatccaccagccgctcctcgagcacccccgtcccgcgccgcctccggctccggcgagatgtcacgcttcggtcgatccggcccgccgccgccgatccgcgacacgtactcactcctcgtcctcaacatcaccttccgcacaactgctgatgacctcttccctctcttcgacaagtacggcgagattgtcgacatctacatcccaagggaccgccggactggtgactcgcgcggattcgcgttcgtgaggtacaagtacgaggacgaggcacagaaggcagttgaaaggctcgatgggagattggtagaccggagggagatcatggtgcagtttgccaagtacggccccaatgctgaacggattaataaagggagattagtggagccagttccaagaccaggggggcgttccaggagtcacagtccaagacggaggtaccgtgatgattatcgagatgaccatgatagagactatagaaagcgaagtcgtagccggagtagagatagatacacccgtgacaggtaccggtataggggataccgccaatcgtagcccgagtcgcagctacagtcctgatggattacaagaagcgtggggagagaccgtttgtcccccggagccgaaaaacccctcgtcgtaagcggcagtcctgagtatttccaagaggcgttgggaggaaacatggccatcccccagcaagttagaaggcccttagtcgctttcccaccctcggcaggagggtt

SEQ ID NO: 94658 - protein, 164 aa, Zea mays
  misc_feature: Ceres CLONE 1584545
  misc_feature (19)..(90): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSRFGRSGPPPPIRDTYSLLVLNITFRTTADDLFPLFDKYGEIVDIYIPRDRRTGDSRGFAFVRYKYEDEAQKAVERLDGRLVDRREIMVQFAKYGPNAERINKGRLVEPVPRPGGRSRSHSPRRRYRDDYRDDHDRDYRKRSRSRSRDRYTRDRYRYRGYRQS

SEQ ID NO: 94659 - DNA, 824 bp, Zea mays
  misc_feature: Ceres CLONE 1584547
  misc_feature: Encodes the peptide sequence at SEQ ID NO. 94660
atagctggagctcaccgcggtggcggccgctctagaactagtggatcccccgggctgcaggaattcgtctcacccctagaaaaataccgtgagggaaaggtgaaaagaacccccagtgggtagtgaaatagaacgtgaaaccgtgctgagctcccaagcagtgggaggggaaagtgatctctgaccgcgtgcctgttgaagaatgagccggcgactcataggcagtggcttggttaagggaatggaacccaccggagccgtagcgaaagcgagtcttcatagggcgattgtcactgcttatggacccgaacctgggtgatctatccatgaccaggatgaagcttggatgaaactaagcagaggtccgaaccgactgatgttgaagaatcagcggatgagttgtggttaggggtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatacctagatatgacccataaataacaggagtcaaggtcggccagtgagacgatgggggataagcttcatcgtcgagagggaaacagcccggatcaccagctaaggcccctaaatgaccgctcagtgataaaggaggtggggggtgcaaaaacaagccaggaagtttgccctaaaaacaccaccccttttaaagagtgcgctaatagctccacttgatcgaggcggcccttgcccttgaagtataaaccggggctaaaccgatcctgcccaaaac

SEQ ID NO: 94660 - protein, 46 aa, Zea mays
  misc_feature: Ceres CLONE 1584547
MPLEPRASWFSPKCVEAQQLTGHLGVKHCFGAGCASGTKSRQTLNT

SEQ ID NO: 94661 - DNA, 1223 bp, Zea mays
  misc_feature: Ceres CLONE 1584548
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (45)..(45): n is a, c, t, g, unknown, or other
  misc_feature (48)..(48): n is a, c, t, g, unknown, or other
  misc_feature (735)..(735): n is a, c, t, g, unknown, or other
  misc_feature (804)..(804): n is a, c, t, g, unknown, or other
  misc_feature (835)..(835): n is a, c, t, g, unknown, or other
  misc_feature (860)..(860): n is a, c, t, g, unknown, or other
  misc_feature (909)..(909): n is a, c, t, g, unknown, or other
  misc_feature (929)..(929): n is a, c, t, g, unknown, or other
  misc_feature (979)..(979): n is a, c, t, g, unknown, or other
  misc_feature (1013)..(1013): n is a, c, t, g, unknown, or other
  misc_feature (1089)..(1089): n is a, c, t, g, unknown, or other
ggggggggggntnnnnnttttgcagagccaacatattataacctnctntataacaggcgttagatcgaaaaaaaataaaaactggagctccccacggtggcggccgctctagaactagtggatcccccgggctgcatgaattcgtctcacccctagaaaaaagttcccgagccctccaaagcaaaaataagatatcatggaagactacaggatttacctcatcgatagaatatagaatctcaaaaagggagcgaaatatgtgttccctttttgcagctccgtcgtctaccaacctccaccgatacggccgccgcatcggacccgaattgtcccctctctaacttctgcggacggctagagggtgtttcaagcggcctcgatctgctcctctccgctgaggaaggataccaagccggtgctcaggggctgggggatgcattaagggattcttcgtgattcagattgagaactacgggtaggacacatgtgcgtcaaaagacttctgtcaaccacaaaaattagcaccccggtgggaaaacaccctccgtccaggcattctttataaagaaatcccaccaactccccaatgcgaacaatagtaaggggaaatggcccctctaaatcgccccgcccaatgccttgtctgagttaaacaaacggaatcgtaaccctcaacccctgttgttgaacaagaacacaatggcctgacaacggaaaaaagatgggcgaggaatntaacgatctaatgaggggacaaagatagaaacaatctcttccgcatgtagtggtatctcacgccaagantgggatagaacacactaagtctgcgaaggcngtgggacaaaaacgagccagggctnatgaaaatttcctagagggttacgcgggcgtctctttatcgagcttaantcgaaaacacataatatcancgtagataagtatcttgagtttttctcttgaggggaggaagaggctgggngcgaccggtttacccttcctgcaaaaatatgggngtgtttttctaataagtgacccgtggcatggtatctgagcgttgccgggtcctggggggataaattgttaacatantaccgctatgcacagggcggtgtaacgccctaatagacttagtagagcccttgggagaaaatattttgatccggggcgccatcatgaaaagtataccgccacaaataatttctgtgtgcgctagccacaaagag

SEQ ID NO: 94662 - DNA, 798 bp, Zea mays
  misc_feature: Ceres CLONE 1584552
  misc_feature: Encodes the peptide sequence at SEQ ID NO. 94663
  misc_feature (280)..(280): n is a, c, t, g, unknown, or other
  misc_feature (762)..(762): n is a, c, t, g, unknown, or other
gagctccccgcggtggcggccgctctagaactagtggatcccccgggctgcaggaattcgtctcacccctagaaaaagctcttgtcttcggaagtttcagatcctcgcatcgtccgcaccttatcctctcgactttacagtacctgctctcagctcctccctatctcaatggcatccgcgaatgccatctccaccgcctccctcctccggcccctctctcagggcagggcgacgaggtcacagcggttcgtggtgcgtgcgaacgccaaagacattgccntttgaccagaaatcaagggcagcgcttgcaggcccgggcgtcaagaaacctggcaaaaccgccgtcgggtgtcacccttcgggcccaccaagggaaaggaaatgggggtgcttccaatgaagtaccgcaaacccccaaaagtttgggaaatggaatgggaggcccccttttttggcccgggggctttatttgggccttgttttgtaccccccaggggaaaaaaaagtgtggggggggccaccccaattttatatttttccctcgggggggggggttttcctaaaaaaaaacacacaaaaattattccccgggggggggggggggggggagaaaaaaaaggggggggccccccccccctttttgtttgggaaaaaaaaaaaaaaaaaaaaaggggggcccttttttaaaagaagaaaaaaacaccggggggggaaagaaaacttttttttttttttttttaaaaaaggggggggggggcccanaaccaaaaatgggggggggggggcgtgttttattaa

SEQ ID NO: 94663 - protein, 37 aa, Zea mays
  misc_feature: Ceres CLONE 1584552
MASANAISTASLLRPLSQGRATRSQRFVVRANAKDIA

SEQ ID NO: 94664 - DNA, 1172 bp, Zea mays
  misc_feature: Ceres CLONE 1584553
  misc_feature: Encodes the peptide sequence at SEQ ID NO. 94665
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (42)..(42): n is a, c, t, g, unknown, or other
  misc_feature (47)..(47): n is a, c, t, g, unknown, or other
  misc_feature (49)..(49): n is a, c, t, g, unknown, or other
  misc_feature (73)..(73): n is a, c, t, g, unknown, or other
  misc_feature (77)..(77): n is a, c, t, g, unknown, or other
  misc_feature (477)..(477): n is a, c, t, g, unknown, or other
nnnnccccccccccccccgggaggacccacatcaaaacctcngcccnancagcaatagagaaggtgtcggttntgtnaaaactggaactccccgcggtggcggccgctctagaactagtggatcccccgggctgcaggaattcgtctcacccctagaaaaagcaccccaccttgcacctccagtcctccattcccagtctagatctcgatccacctccatggcggatctcgccacggacctcttcggggagccgatcgaggcgcaccctccctggttcaagcccgacgccttcctccgcgccagcttcgatccggacgcctacgtcgccgagctccgctcctacgtcccgctcgagagcctcgccgccgagctccgcgcccacctcgacgcgctccgcgccgagctcgtcggcctcatcaaccgcgactacgccgacttcgtaggcctcagcgcgcgccttatgggcgtcgatgccncccccgcgcggatgcgcaccccgctcgccgacctcagggacaaggtcgccgtccttcctgcgcggggggcatcaagccggcgcctcacccgcgcttccggggagggggaactcgaagcaggtagagcccgcccggttcgccccgaccgacgcgggcgaaggcgtgcatttccaaggcttcctttgacattcggaaacaccccttttcccccccctttccgtttcccttcccctaaagagggtttttgaaaaccaataagactttgggaaatttcccaaaaaggggggataaatacgttaatcccccaaaaaaagccttgggggccgcgccccccaaatttctgggggggaaaatctttttaatttcgcccaaaaaattgtgccctgtgagaaaaagatgtttctccctcttaaaaaacatggctggggcacacacaccgtggtgggagaaaaccaccccccaaaaaattgtggtggggttgggggcgtatttgtgggaaaaaaagatgggtgggggtcacagggcgaagaaaaacacacaagaagccccattttccacacccttaagaaaaaagggaaatttggcccaaggggggagaaatatgaaaacccggggcttttaaattttccaccactaaagtgccaagggcagagtgaaacccctcacccttttttattggaggaaaacatgtggaa

SEQ ID NO: 94665 - protein, 168 aa, Zea mays
  misc_feature: Ceres CLONE 1584553
  misc_feature (87)..(87): Xaa is any aa, unknown, or other
MADLATDLFGEPIEAHPPWFKPDAFLRASFDPDAYVAELRSYVPLESLAAELRAHLDALRAELVGLINRDYADFVGLSARLMGVDAXPARMRTPLADLRDKVAVLPARGASSRRLTRASGEGELEAGRARPVRPDRRGRRRAFPRLPLTFGNTPFPPPFRFPSPKEGF

SEQ ID NO: 94666 - DNA, 1015 bp, Zea mays
  misc_feature: Ceres CLONE 1584556
  misc_feature: Encodes the peptide sequence at SEQ ID NO. 94667
  misc_feature (395)..(395): n is a, c, t, g, unknown, or other
  misc_feature (400)..(400): n is a, c, t, g, unknown, or other
  misc_feature (1015)..(1015): n is a, c, t, g, unknown, or other
ctccccgcggtggcggccgctctagaactagtggatcccccgggctgcaggaattcgtctcacccctagaaaaaaagaagagcacgcccactcctctccggctcctcttcttctccaccacaccacaggcaccggcaccagcaccgcctcctccctccctccctcttgccaccgcgcggccccccagccacagcacagcacagcaatggcgggcaacggcgccatcgtggagagcgacccgctgaactggggcgcggcggcggcggagctggcggggagccacctggacgaggtgaagcgcatggtggcgcaggcccggcagccggtcgtgaagatcgagggatccacgctccgcgtcggccaggtgggcgcccgtcgcgtccgccagggacgcntcccngcttcgccgttaaactcgaaaaggaaggcccccccccccgttaagggccacaccgaaggggatccccgaatgggtttcccccaaggggggggaaaaattacggggggtacccaacggggttttgggggggaccctccccaacgcgcggaaaaaaagggaaggggcgcgcgccgcccacgggggaaaaggctgttttaggggtattttaaaaacccgggaaaaattttttgcgacactgggggaacgagaaatgggccacacaaccacttcgtcatctgtggaggaggtaaccaccggggggggggggagaaatatggggtggtgacaaattaacaaacactcctccttctaggggggatcattcgcggggaagcaccatctataaaagaaattctgggagggcgatcataccaaaagttctcatacaacacggggggagacaagcacaagcatccttcaagtgggggagaaaaaaatccagtaggggggaaaagatgagccaccccttttaataatatgggaggtaagagaagggggtccccaaaaagagggggccagccttcttagagggggagggaggggcctccaataatataaatcactcggggggggggn

SEQ ID NO: 94667 - protein, 130 aa, Zea mays
  misc_feature: Ceres CLONE 1584556
  misc_feature: SWISSPROT Homolog: EC 4.3.1.5 Phenylalanine ammonia-lyase
  misc_feature (64)..(64): Xaa is any aa, unknown, or other
MAGNGAIVESDPLNWGAAAAELAGSHLDEVKRMVAQARQPVVKIEGSTLRVGQVGARRVRQGRXPASPLNSKRKAPPPVKGHTEGDPRMGFPQGGGKITGGTQRGFGGDPPQRAEKKGRGARRPRGKRLF

SEQ ID NO: 94668 - DNA, 851 bp, Zea mays
  misc_feature: Ceres CLONE 1584563
  misc_feature: Translation starting site: 165
  misc_feature: SWISSPROT Homolog: EC 1.4.1.2 Glutamate dehydrogenase
  misc_feature (447)..(447): n is a, c, t, g, unknown, or other
  misc_feature (499)..(499): n is a, c, t, g, unknown, or other
  misc_feature (605)..(605): n is a, c, t, g, unknown, or other
ctggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccnttcaggtcatttctgggcctggtgagaagcctatgatttgtgtccagcacangggtgaggagaagcagtttgcagctgaagagatctcctctatgggttctattcagatgcgtgagattgctgaagcttaccttggtagcacgatcaagaatgctgtngtcacagtccctgcctactttcatgactcacagaggcaaggcacaaaagatgcctggggtgattgctggccttaaattggcgcgtattcatcacgaggcaacagctgcagctattcgctaatggctttgacaagaggcttccaatttctggtaaaaaaaatgccctaacctttaaccttgggagggggcccctttgatgctccccccccccccctggggaagggaacctttaggtccagggccccc

SEQ ID NO: 94669 - DNA, 912 bp, Zea mays
  misc_feature: Ceres CLONE 1584565
  misc_feature: Encodes the peptide sequence at SEQ ID NO. 94670
  misc_feature (338)..(338): n is a, c, t, g, unknown, or other
  misc_feature (339)..(339): n is a, c, t, g, unknown, or other
ctggagctccccgcggtggcggccgctctagaactagtggatcccccgggctgcaggaattcgtctcacccctagaaaaaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaagggacagtacgtggacctcggttgtgtcgtcgtcaagcgcaagctcctctggtgggccnntgtgtgcgtcgtcgccgctttcgtcctcatcgggctccccatcatcatcgccaagtccatcccgcaaccagaagccaggcccggccgcccgccgaatcagtaacccaaaggccccttgcaaaagggcgcttcctctttctttcagggcccccaaaaattcgggccccccttcccaagaaaaaatgggctttcaggtgggcccgggggaacttttggcctttttaaaaaggggtctcccaaccccaaggggacttccaggggggggggccctttttggggggggttatttaaaaaaaacgttgggggaaaaaaaataaaaagtttcccccttttcccggggggggccttttctccctaaaaaccttttttaaaaagggggggggggggagaaaaaaaaaacacccccccccaaaaaaaaaaaggcgtttgggggggggggtattttaccccttttttgggggggggcttccctccttctgtgggggggggggccccaaaaaatatgttgtgaaaacaccccccataaaaaatcctctttggttgtttccccccagagggagaaagaggtgttcc

SEQ ID NO: 94670 - protein, 111 aa, Zea mays
  misc_feature: Ceres CLONE 1584565
  misc_feature: SWISSPROT Homolog: EC 3.2.1.4 Cellulase
  misc_feature (78)..(78): Xaa is any aa, unknown, or other
MYSANHWGGSFEIADGAAEDDHSRNMDLDRGALSARQHHELDETQQSWLLGPPEAKKKGQYVDLGCVVVKRKLLWWAXVCVVAAFVLIGLPIIIAKSIPQPEARPGRPPNQ

SEQ ID NO: 94671 - DNA, 879 bp, Zea mays
  misc_feature: Ceres CLONE 1584566
  misc_feature: Translation starting site: 508
  misc_feature (35)..(35): n is a, c, t, g, unknown, or other
  misc_feature (377)..(377): n is a, c, t, g, unknown, or other
ctctcgcggtggcggccgctctagactagtggatntcctgggctgcaggaattcgtctcaccccctagaaaaagccaccagctgtccagctccacctcgtcgactcctccccgcacaagacaaaaaaaccctcgccttggagggtggaggcgcgtgagcccgacacccagagcgaaaaaagcaaggggtctgaccgccggcgatggcgtccatctccggagcggcggcggcgccatcttccgctgcgtgccggctgcggctgcgtaggcacatcctgctgcggccctcgcacctccgcctccgcgcgccccactccatcgccgacctctcccgctcctccagctcctctagttccggccgcggggcgggcccagccnctgggctccaggccggagaacggcggcggcgtccgctcggtggagaaggacccgatcaagctgtgggagcgctacgtcgagtggctctaccagcacaaggagctcggcctcttcgtcgacgtcagcccggatgggggttcacggaggacttcctgcgcccgatggaacccccgaatgcacggggcccttcgccgccaggcgggaggctcgaggaggggcgcccttccgcacacccggaagaagggtctccttggtggggccactgactgggcttccggaaccatgacccctcggggccgaagatcctttcctcccggaggggaggaccgggggcgcgcgcctcgggcaggagggcgtggtgtcggtcttccccaggaaggaggcgtctcctgcgcaaaggaattcaagtcccccactccctggtcgcgctttctcacttttcaagatgtctcctcgtatacatgaaaatgtgtgacgggcgggtcacaatgtgtgaggggcg

SEQ ID NO: 94672 - DNA, 1248 bp, Zea mays
  misc_feature: Ceres CLONE 1584570
  misc_feature: Encodes the peptide sequence at SEQ ID NO. 94673
  misc_feature (69)..(69): n is a, c, t, g, unknown, or other
  misc_feature (963)..(963): n is a, c, t, g, unknown, or other
  misc_feature (1051)..(1051): n is a, c, t, g, unknown, or other
tttttttttcgccccgttttgggtgagacacggggagtatatattaaaaatgattcccttcgccggccnttcccccagctgggactccccgcggtggcggccgctctagaactagtggatcccccgggctgcaggaattcgtctcacccctagaaaaaaggtcgccacgcccgccacaagaagcagcagccttacccgaaccgaagacgaaccctaccgcgccttgatatcatatcgtctccgtgtcgttctcgcagcgcagcgagcgagccacgcgctcctgcgcagtagcgtaatggcggtgcaaggcggcgaggagagggagagcggaaagggcgccgccccggcggtggtgtcaggcggcgaggcgggcccgccgggccggaggacggcgaggggccacccgctcctgcgcggcgggtggaggcgcgaccggtacacgcacgggatgcggccggcgcagatggaggcactccgcgccatgtgcggcgcgctcatcccctcgctgcccgccgacgccgacgcctgccgcggcgaacccgccccggcggcaaggaccttcgaagcgcttctaccctcgcgctccggcgggccggaatcccacccatcccccaaacgaaggtccgcgggaagcttgatgggtgaaacgccggtggcaattctcctccaagggacgggttgggcaccccttggccctggggagtggggtgggcttctttgagggggcgcctcggaaatcacaccattcttgggccggggggacaaccccacgtgtggcttctgacttggtgtgcgcgaggggcacacgtgatctatcataaatcccactacctgagagagccccccgcggggatcttttccccccctcattaccgattggtaccggccggggggggtttcgccgcccccgaacacaatggtggggggtccaccggggaggttacctgtacccgtgagaatggnttggatctcacttttttccgggtcgagtctgtggggacaacacacgggggatggggcgcgcctggatgatttctttatcgcgcagggntcctcggcatattgtgatccttggggacaaaatattgtgttggagaatatttcttgttgggggccccatgagaaggttgtctacaataatacactggtgtgggaaaccaaaaaaactcttccagagaagatctgcaactctgggataaaagcgcataaggaaataacggtctgtgtgaaaaaaaccccccgagaagt

SEQ ID NO: 94673 - protein, 141 aa, Zea mays
  misc_feature: Ceres CLONE 1584570
MAVQGGEERESGKGAAPAVVSGGEAGPPGRRTARGHPLLRGGWRRDRYTHGMRPAQMEALRAMCGALIPSLPADADACRGEPAPAARTFEALLPSRSGGPESHPSPKRRSAGSLMGETPVAILLQGTGWAPLGPGEWGGLL

SEQ ID NO: 94674 - DNA, 866 bp, Zea mays
  misc_feature: Ceres CLONE 1584573
  misc_feature: Encodes the peptide sequence at SEQ ID NO. 94675
  misc_feature (825)..(825): n is a, c, t, g, unknown, or other
tggagctccccgcggtggcggccgctctagaactagtggatcccccgggctgcaggaattcgtctcacccctagaaaaagcttgtctgcgcgcccggttcttcgatctccgactcatcagacttcgcaagggtctgctaagaggtctcgaagtctttcaggactttgacgacacaatactccccaccatctcctcagcgatccaacatccccttatcaccgcgtcacatacacctcaccggccatgggcgcgtcctccgctactggtaacccgtccccagaggcatacgagcaacatgagcatgagacccacgcctccgccgacctctccctcccgctcctacgggccgacttctcccagcgtccgtccgccaacgtcgctgacagatgcccacatcgccgccgcccacctccttacgtcagcccagatacgcggcaccgacaccgacgtacatatgagacatcctcggggggctcgatcccgccagcgcactacaatactatgatcaccaagttgtcccagtgtaagagcgaagcgccgggagggtccagtaccgcaaggggttcaatggatgttgcacacttcgaacgagttcacaatgcgatgaaatgacttttcattatgaactctgtcactcagagcaaggaagagggtaccacgtcagtctgcctctctagcagacgaggatgctggtgaccataatggaaatggtctggtggagctcctttcagaaggtatcacatggatcttctggtgtgctgggtagtgtagtctactgctacaggctcgagagacgtatttgatctacgagatgacttgatcccntcgcgtgatctgccgtgagacacgctacgcatgctggttgg

SEQ ID NO: 94675 - protein, 122 aa, Zea mays
  misc_feature: Ceres CLONE 1584573
MGASSATGNPSPEAYEQHEHETHASADLSLPLLRADFSQRPSANVADRCPHRRRPPPYVSPDTRHRHRRTYETSSGGSIPPAHYNTMITKLSQCKSEAPGGSSTARGSMDVAHFERVHNAMK

SEQ ID NO: 94676 - DNA, 816 bp, Zea mays
  misc_feature: Ceres CLONE 1584574
  misc_feature: Encodes the peptide sequence at SEQ ID NO. 94677
  misc_feature (703)..(703): n is a, c, t, g, unknown, or other
acccgcggtggcggccgctctagaactagtggatcccccgggctgcaggaattcgtctcacccctagaaaaaagcgacgcgcatctggcctgcccatctctttcgtgctcctacccctcaagccttcttccgcccgccgcctcagccctcaaggcttttccttctcatcttcttctcagaccggggacgggcccgacggggacagggacaaaaggtggtgcgatcttgttgggcacactccgcctccgcgcgcgggaagagagagagagagagagagagagagagagagagagagagagagagaaggacggagggtggcagggccgccgcgccggtgagccgacccccagccatggcattgccggctccccccgtccgcctggcgctgctgctgctcgtcgcgctgccattctgcgccgcgcatcccgggccgggggccttcaacgctcctcgccacttccagacgcccgcgctccactctgatggatttggcttggtggcaagaaggtcggttgctgaagctcctgctgacatcaacgtcactaccaatagctcctttgtgctggcggcagataggacatatcgaagggaccctttgaatggcttcaggaaatacccgggcggctggaatatcagtgaagtgcactatttcgcttccgtcggatatacagccattccgctgttcgccattgctctcgtgtgntttgtgatcttcttcctggttatgcttgggatttgctgccgtcattgctggtgcccgcatcacacctacaagtatttccgaaacagcatatgctctatcattgaaaccttcta

SEQ ID NO: 94677 - protein, 154 aa, Zea mays
  misc_feature: Ceres CLONE 1584574
  misc_feature (117)..(117): Xaa is any aa, unknown, or other
MALPAPPVRLALLLLVALPFCAAHPGPGAFNAPRHFQTPALHSDGFGLVARRSVAEAPADINVTTNSSFVLAADRTYRRDPLNGFRKYPGGWNISEVHYFASVGYTAIPLFAIALVXFVIFFLVMLGICCRHCWCPHHTYKYFRNSICSIIETF

SEQ ID NO: 94678 - DNA, 830 bp, Zea mays
  misc_feature: Ceres CLONE 1584576
  misc_feature: Encodes the peptide sequence at SEQ ID NO. 94679
  misc_feature (830)..(830): n is a, c, t, g, unknown, or other
cccgcggtggcggccgctcttgaatagtggatcccccgggctgcaggaattcgtctcacccctagaaaaaagcgacgcgcatctggcctgcccatctctttcgtgctcctacccctcaagccttcttccgcccgccgcctcagccctcaaggcttttccttctcatcttcttctcagaccggggacgggcccgacggggacagggacaaaaggtggtgcgatcttgttgggcacactccgcctccgcgcgcgggaagagagagagagagagagagagagagagagagagagagagagagagaaggacggagggtggcagggccgccgcgccggtgagccgacccccagccatggcattgccggctccccccgtccgcctggcgctgctggtgctcccccccctgccattctgcgccgcgcatcccgggccgggggacctcaactctcctcgccacttccagacgcccgcgctccactctgatggatttggcttggtggcaagaagggcggttgctaaaactcctggcgacatcaacgtcactaccgatagctcctttgtgctggcggcagataggacatagcggaagggaccctttgaatggcttcaggaaattaccaggggggctcgaaaatacagtgaaagggcactattttcgcttccggccggaaaataagcccctgtgcgcggggtcgctcttttcacctcggggtggggtttgggagtcttttttcccccgggaaaaggccctggcagattctggttgcccggtattgttcgtgtatggactcacggggagaagaacctctaagaggaggtttcgtgcaaaaan

SEQ ID NO: 94679 - protein, 76 aa, Zea mays
  misc_feature: Ceres CLONE 1584576
MALPAPPVRLALLVLPPLPFCAAHPGPGDLNSPRHFQTPALHSDGFGLVARRAVAKTPGDINVTTDSSFVLAADRT

SEQ ID NO: 94680 - DNA, 741 bp, Zea mays
  misc_feature: Ceres CLONE 1584580
  misc_feature: Encodes the peptide sequence at SEQ ID NO. 94681
  misc_feature (647)..(647): n is a, c, t, g, unknown, or other
  misc_feature (685)..(685): n is a, c, t, g, unknown, or other
ctggagctccccgcggtggcggccgctctagaactagtggatcccccgggctgcaggaattcgtctcacccctagaaaaaactcccgtttcattccattcccccccagacgccgctaccgccgccgccgcacgcacgcttgccccgggatctggagatctggtagcgccagggggatggaggccagcgccgggctggtcgccggctcgcacaaccggaacgagctcgtcgtcatccgccgcgatggcgagccggggccgaagcccatggaccagcggaacggccaggtgtgccagatttgcggcgacgacgtggggcgcaaccccgacggggagccgttcgtggcctgcaacgagtgcgccttccccatctgccgggactgctacgagtacgagcgccgcgagggcacgcagaactgcccccagtgcaagacccgcttcaagcgcctcaaggggtgcgcgcgcgtgcccggggacgaggaggaggacggcgtcgacgacctggagaacgagtcaactggacccgacagcacgactcccagtacctcgccgagtccatgctccacgcccacatgagctacggccgcggcgccgacctcgacggcgtgccgcagccattccagcccatcccccatggtcccctcctcancaaccgacagatggtcgatgacatcccgcccgaacagnaacgccttgtgcctccgtcctgggtggcgggggggaaaaaagattcaccctctccc

SEQ ID NO: 94681 - protein, 132 aa, Zea mays
  misc_feature: Ceres CLONE 1584580
  misc_feature: SWISSPROT Homolog: EC 2.4.1.12 Cellulose synthase (UDP-forming)
MEASAGLVAGSHNRNELVVIRRDGEPGPKPMDQRNGQVCQICGDDVGRNPDGEPFVACNECAFPICRDCYEYERREGTQNCPQCKTRFKRLKGCARVPGDEEEDGVDDLENESTGPDSTTPSTSPSPCSTPT

SEQ ID NO: 94682 - DNA, 815 bp, Zea mays
  misc_feature: Ceres CLONE 1584583
  misc_feature: Translation starting site: 180
  misc_feature: Pfam Name: NGP1NT Pfam Description: NGP1NT (NUC091) domain
ctccccgcggtggcggccgctctagaactagtggatcccccgggctgcaggaattcgtctcacccctagaaaaaatcgtcggctcctctctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgcctgtggcgggagccggtccgcggctaccgtgcggcggctcaagatgtacaagacgcggcccaagagggaccgcgtccgggaaggtgctcatgaacgatttccagtctaaagagctccccaacacccgcatcgagcccgaccgccggtggttcggcaatactcgcgttgtgggccagccacagcttgaaatgttccgggaggaactccagagtcggctttccgacaacttcagtgtcatcctgaaagaacggaagctgccactatcgctcctgcaagatcatcaaaagcaagcgaaggcacatctgcttgaaagtgaacccttttgagcatgcttttggggcaaagggcaagaggaaacgtccgaaactaactgctcttgactacgaatctttgctgaagagagctgatgattcccaagatgtgtttgagcaaaagttgcctcatcaaagttgccaaggggaggaagagaagatggcttacgtgatctagtgagggcttcaatgtttgaaaagggaacgagcaaaagaaccggggg

SEQ ID NO: 94683 - DNA, 863 bp, Zea mays
  misc_feature: Ceres CLONE 1584585
  misc_feature: Encodes the peptide sequence at SEQ ID NO. 94684
ctggagctccccgcggtggcggccgctctagaactagtggatcccccgggctgcaggaattcgtctcacccctagaaaaagcagaaggcatgtttccgatggcgtcttcctcactgtcgtcgccgccgctatcacttatcctcctccggccgctcccgtgcatacccgtcctcctcttgagacaaaggaagccattcccagctgtccgcgtagaagcaaggtctcagcagcggttgcagcggaggccggtgactggccagtggaggaggagctgcagaaggggcggaggctacgcgtgtttctcctacaatgccaagaacaagacgcccccgccttcagataagagttcagacgagtgggcgatcgttcgccgatgggatgtgccatgggaatggcaaactgttgtgctcagcatggtaggctgtgtagtaaggtaagccataacctttgcgcatcaggtatttgaattttatgttgtatagagtgaggctcgcaagtttgattttactgtacatgtgtattgaataaatcattctgagtgttctttagacagctttgttctgacaggattggttgagcaattggctttgcaagaactgggatttaaagctgtggaggcaactatagatgagaaggcagaaatactcttctttgggcagctgtatgatacatgttttttatgcatatgtgcacaagacctttcaattcccttgatggcaagctgatttatctcccatcactaatgacatcacaaattgccaaaaaagattatattttgcttttgtactggtctgtgcaggagtgtgacaagtagtagtgcttggtggtatatttggcatcaccacacttttcgacatttccag

SEQ ID NO: 94684 - protein, 115 aa, Zea mays
  misc_feature: Ceres CLONE 1584585
MFPMASSSLSSPPLSLILLRPLPCIPVLLLRQRKPFPAVRVEARSQQRLQRRPVTGQWRRSCRRGGGYACFSYNAKNKTPPPSDKSSDEWAIVRRWDVPWEWQTVVLSMVGCVVR

SEQ ID NO: 94685 - DNA, 950 bp, Zea mays
  misc_feature: Ceres CLONE 1584586
  misc_feature: Encodes the peptide sequence at SEQ ID NO. 94686
ctcaccgcggtggcggccgctctagaactagtggatcccccgggctgcaggaattcgtctcacccctagaaaaatcgtcggctcctctctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgccggtggcgggagccggtccgcggctaccgtgcggcggctcaagatgtacaagacgcgggccaagagggaccgcgccgggaaggtgctcatgaaggatttccagtctaaagagctccccaacacccgcatcgagcccgaccgccggtggttcggcaatactcgcgttgtggggccgccacagcttgaaatgttcccgggagggaaactccagagtcgggttttccgacaacttcaggggtcatcccggaaaagaacgggaagcttgcccactaatccgcttcctggcaaagaatcatccaaaaagcaaagcgtaaggggaccctcctggcttggaaaggttgaaaacaccttttggaagcaatggccttttttggggcccaaaggggcgcaaagaagggaaaccgttcccgaaaaccaaacctggctcttgtgaccaacgaaatccctttggcccggaagaaagaggctttattcattttccccaaggaagggggttttggggccaaaaggtttggcttttccttcaaaaggttgccccatgggggagggagagaaaaaaattggggctaccgtgtgatccaaaggtggggcctctcaatagtgtttgggaaaagggggtccggaccgaaaaaaaactctgggggggggaactttcacaaagagtctttgag

SEQ ID NO: 94686 - protein, 177 aa, Zea mays
  misc_feature: Ceres CLONE 1584586
  misc_feature (49)..(175): Pfam Name: NGP1NT Pfam Description: NGP1NT (NUC091) domain
MAKKKEKAVNVSGKPRHSNDVNRPNDKKGAGGGAGGGSRSAATVRRLKMYKTRAKRDRAGKVLMKDFQSKELPNTRIEPDRRWFGNTRVVGPPQLEMFPGGKLQSRVFRQLQGSSRKRTGSLPTNPLPGKESSKKQSVRGPSWLGKVENTFWKQWPFLGPKGAQRRETVPENQTWLL

SEQ ID NO: 94687 - DNA, 915 bp, Zea mays
  misc_feature: Ceres CLONE 1584589
  misc_feature: Encodes the peptide sequence at SEQ ID NO. 94688
  misc_feature (484)..(484): n is a, c, t, g, unknown, or other
  misc_feature (554)..(554): n is a, c, t, g, unknown, or other
ctccccgcggtggcggccgctctagaactagtggatcccccgggctgcaggaattcgtctcacccctagaaaaagtgcaccctcattcgtctcgcctgcactgtttctaaaatcaacccgtcccccacctcctcgccgcctcgcatcctttttcccctccgcaagaaagaaagcgaagcaactctccgccgcctccattcctccacagcccacaccaaccaaacctctcgccgacaacagcctcggtccccgcgccaccatccgcaatcatgtaccgcgcggccgctagcctcgcctccaaggcgcggcaagccgggagcagctccgccgctcgccaggttggaagcaggcttgcctggagcaggaactatgctgccaaggacatcaagtttggtgttgaggcctgtgctctgatgttgaggggtgttgaggagttggcagacgctgtcaaagtgaacatggggtcctaggggcgcaatgtggntattgagcaaagcttcggtgcaccgaaagtcacaagggatggtgtgactgttgcaaaaagctttgatttnaagatgaggaaagaatgtgggtgcaagccttgggaaacaggttgctaatgcaataaaggaccgggcgggggagggaccccatgggcacctgttttgacaaagccaaatttcctggggggggcaaaattttttcggctgggataaaaaccagggttttaaggggggaaatccaaggggggggtaggggggggggccacaccaaaggggggtggcccaaaatttaccccttcaaaaaaaattccgggggggggccaattcccacaaaggaaaaaggaaatttggggttcttttcgccccctttaagaaagggggtgaaaaaagggggtgttttattttgtgggggggaccccccttttataag

SEQ ID NO: 94688 - protein, 66 aa, Zea mays
  misc_feature: Ceres CLONE 1584589
MYRAAASLASKARQAGSSSAARQVGSRLAWSRNYAAKDIKFGVEACALMLRGVEELADAVKVNMGS

SEQ ID NO: 94689 - DNA, 930 bp, Zea mays
  misc_feature: Ceres CLONE 1584591
  misc_feature: Encodes the peptide sequence at SEQ ID NO. 94690
  misc_feature (273)..(273): n is a, c, t, g, unknown, or other
  misc_feature (299)..(299): n is a, c, t, g, unknown, or other
  misc_feature (304)..(304): n is a, c, t, g, unknown, or other
  misc_feature (339)..(339): n is a, c, t, g, unknown, or other
  misc_feature (342)..(342): n is a, c, t, g, unknown, or other
  misc_feature (343)..(343): n is a, c, t, g, unknown, or other
  misc_feature (632)..(632): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (720)..(720): n is a, c, t, g, unknown, or other
  misc_feature (731)..(731): n is a, c, t, g, unknown, or other
  misc_feature (754)..(754): n is a, c, t, g, unknown, or other
  misc_feature (768)..(768): n is a, c, t, g, unknown, or other
  misc_feature (777)..(777): n is a, c, t, g, unknown, or other
  misc_feature (778)..(778): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (847)..(847): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (872)..(872): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
ccgctctagaactagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagatctcggacggaagcgctcgtanccaaccgggtctcgtcgacggccggnccccngcgggcgcgccgcaaaccaacccaacccagacacnaanncgcattgggggtttgaaccccctaaggggggggcggggcccccagaccggggggtttttttttccctttgggggggggcccccccccgaaaaaaaccccccgggggggggttccccccaaaaaaagaggggggcaacactttttttttaaaaaaggcgcccctcttttgttttctccccccccgcggggggggggaaaaaaaaaaaaatttttttttccctcctgcaaaaagaaaagggacccccccccccccccgcgggggggggggggggaaaaagaaaaaaaaagnatttttttttttttcttcgcccgggggcgggccccccnnnnnccccgcnnngggaggggggggggcgaccaaaaaaaaatattttttnaaaaagagggnggggcccccccgcccggcccccntatagagggggggnggggggggnnggggggggaaagaggggttttttattaacccaccacccaaaaaagnnncccccctccccccctcnnncntgttttttgatgnnnggggtggggnggtttttttgtttttcaacacccacggggggnnnatggtggtgggggcggcacccccc

SEQ ID NO: 94690 - protein, 117 aa, Zea mays
  misc_feature: Ceres CLONE 1584591
  misc_feature (45)..(45): Xaa is any aa, unknown, or other
  misc_feature (54)..(54): Xaa is any aa, unknown, or other
  misc_feature (67)..(67): Xaa is any aa, unknown, or other
  misc_feature (68)..(68): Xaa is any aa, unknown, or other
MAYYQEVDYCSEEVRSVAPAGFGRHGGGVQQHVVKEKISDGSARXQPGLVDGRXPAGAPQTNPTQTXXRIGGLNPLRGGRGPQTGGFFFPFGGGPPPEKNPPGGGSPQKKRGATLFF

SEQ ID NO: 94691 - DNA, 811 bp, Zea mays
  misc_feature: Ceres CLONE 1584593
  misc_feature: Encodes the peptide sequence at SEQ ID NO. 94692
tggagctccccgcggtggcggccgctctagaactagtggatcccccgggctgcaggaattcgtctcacccctagaaaaacacatccgcacacatttttacccctcgcggcggccccaccgaccgccggggcgcagcggcgtcgccgcgggcaacgccgtcacgtcacgtgcatcacgacaatctcctcctccgcctcgtcttcctgccaggccgcgggagcaccagcccagcggcagatcagtcgaggcgggcgattccagggtttagagaggagcggagatggtgaaggtcatccaggggcgcccggccgagatggggttccggatgccggcggagtgggagccgcacgagcagtgctggatgggatggcctgagcgtccagataactggagggagaatgctggtccagctcaagaggtatttgctagaactgcaattgccatttcaaagtttgaacccgtcacgttatgtgcaagtgccaagcagtaccccaaagtccacgagctgatggaacatcaaaccaacatcagggtcgttgagatgagcatgaacgattcctgggtccgcgacatgggccccacttttgtcacctgtaaagggggatcaagaaatgcagaaaaaaagctttacccaggaaagcatcgccctctctttctcaaagtttcggagtcgaggccgccgccccagaccggctcccccttcccggcttcgggtgcccaagggcaagccaacaggtttttgaggtggtaatgggcggaaacaggctaaccaaaccaccggtccttcaaaagcctagggggccagttccac

SEQ ID NO: 94692 - protein, 156 aa, Zea mays
  misc_feature: Ceres CLONE 1584593
  misc_feature (14)..(150): Pfam Name: PAD_porph Pfam Description: Porphyromonas-type peptidyl-arginine deiminase
  misc_feature: SWISSPROT Homolog: EC 3.5.3.12 Agmatine deiminase
MVKVIQGRPAEMGFRMPAEWEPHEQCWMGWPERPDNWRENAGPAQEVFARTAIAISKFEPVTLCASAKQYPKVHELMEHQTNIRVVEMSMNDSWVRDMGPTFVTCKGGSRNAEKKLYPGKHRPLFLKVSESRPPPQTGSPFPASGAQGQANRFLRW

SEQ ID NO: 94693 - DNA, 835 bp, Zea mays
  misc_feature: Ceres CLONE 1584599
  misc_feature: Encodes the peptide sequence at SEQ ID NO. 94694
aaagctggagctccccgcggtggcggccgctctagaactagtggatcccccgggctgcaggaattcgtctcacccctagaaaaaagtcccccataggccgtagaccagagcagtagaccgccatggcgaaccgcagcaggcagctcgttaccaccgcactgccgctcgcggcggcagcagacacctcgctcgccgtcgtgctcctgctctgctccacgggctcatcggaagccgacggatacctcgggcgcgtgggtgcgccgtggggccgtaccctcacggtcctcccattcagccccgcggacctgctgcccctcatgccgcggggcgtcaccatggccgcgctacgggcgctccgcggcgtctcggacatcttcccggtgttcgtcggcgccacgtcggccggcgggtcgggctcggtgcccggcagcggggggacggtgagatggaagggggcctgcttctacgagaacgaggcgtggctggtgttccacaacgagaccgggtgcaagtacggcggcggcacgcgtcatatcaagacatccaaagcgcacagctggacttgcatagatctgtatgtatttgcaacaccatacagagttacatgggattactacttcttggggcgagagcacactcttgatatcaaagaatgggaaagcgatgctgagtatgagtatgtgaaaacggaatggtgaggtccattttccccatgccatatggaacaatgggcacactttcaacaaatctggggaggtgctcccttcgggtcacaaataacggatgggggggaaaaaccacaaatccttggcttttcctgagaaagcaaaaggga

SEQ ID NO: 94694 - protein, 191 aa, Zea mays
  misc_feature: Ceres CLONE 1584599
MANRSRQLVTTALPLAAAADTSLAVVLLLCSTGSSEADGYLGRVGAPWGRTLTVLPFSPADLLPLMPRGVTMAALRALRGVSDIFPVFVGATSAGGSGSVPGSGGTVRWKGACFYENEAWLVFHNETGCKYGGGTRHIKTSKAHSWTCIDLYVFATPYRVTWDYYFLGREHTLDIKEWESDAEYEYVKTEW

SEQ ID NO: 94695 - DNA, 1333 bp, Zea mays
  misc_feature: Ceres CLONE 1584602
  misc_feature: Encodes the peptide sequence at SEQ ID NO. 94696
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (783)..(783): n is a, c, t, g, unknown, or other
  misc_feature (1022)..(1022): n is a, c, t, g, unknown, or other
  misc_feature (1039)..(1039): n is a, c, t, g, unknown, or other
  misc_feature (1081)..(1081): n is a, c, t, g, unknown, or other
  misc_feature (1155)..(1155): n is a, c, t, g, unknown, or other
  misc_feature (1221)..(1221): n is a, c, t, g, unknown, or other
gcgggtgacgcccaacaacaaaattacctaaatcccacaacaacaacaacaacacnnnnnnnnnnnnnncnnncaaagctggagctccccgcggtggcggccgctctagaactagtggatcccccgggctgcatgaattcgtctcacccctagaaaaaagggcgcggcgacgacacccacaggccacagccacaggccacacgacaccaccgctcggtctcggcgtccgcctccacgcacgcttcctcccgcaggccatccacccgatccgatccgatccgagcgtccaccatgtgggtgacgtcgatgccgcatgtttgggacgaggagggcacggccaaaggcagcgcggtgaccccggcgccggccgcggccatgctgggctcgctagcgggatggctgtcccggaccatgcagccgatgccgcctgcgccccgggtgtgcagtaaccggaggggggtcttccagaaaaccgggacattccccaaaaacaaaaaaggtcgaacaccttcctcttcttgcaaaaacggcgatgcccccgggaaccaggcgcaaggtttgtccggccaacattcccccccccgaaattcaacacggcttccctcccgaaggaaacaaacataccagctccctccccagaaaaaacctgtataattaaaagggcaccccccctttcagatataaacccctccggtaatttttagaagattcacaaaggggtccactcagaaaacgtccgggggaacaatattactcgcccccgcatttgtggtgactcgaaancacacgtcgcgagagtatcttctgtgttggtgcgcgcacaattgacaggtataacatttttgatctccataggggtggccctccacgctatcgtcttgcgaatcacggggggaggtggaggctcttctctcatccacttaaataaaatccagcgcgtccatagggtagtgcaaccacacgacactgttttaactttcataccgcgttaacacagatagataactcagggtttctcatcntggtgttgagcgtgggnacagaggcgatcgaacttcgacaaactaatgtgattataccncatttctcatctctctaggtgagacgtgacagctgccatgtctcacagaagtgggtgtatctcatgtgcacacncgcgtcgattctccacgcgctgtggatgaagacaagcgcgcagaacgtcctgttgtacaagacacnataacgatacgtcacagtttacgactcaggagaatagaccttccctcttatattaagcgggccacgcaatgtacgttctatatgtacgtataacaagccaacacctcaatta

SEQ ID NO: 94696 - protein, 120 aa, Zea mays
  misc_feature: Ceres CLONE 1584602
MWVTSMPHVWDEEGTAKGSAVTPAPAAAMLGSLAGWLSRTMQPMPPAPRVCSNRRGVFQKTGTFPKNKKGRTPSSSCKNGDAPGNQAQGLSGQHSPPRNSTRLPSRRKQTYQLPPQKKPV

SEQ ID NO: 94697 - DNA, 803 bp, Zea mays
  misc_feature: Ceres CLONE 1584604
  misc_feature: Translation starting site: 113
gcggtggcggccgctctagaactagtggatcccccgggctgcaggaattcgtctcacccctagaaaaagcatccagcagaccgcagacgacgactacctcagccgccttccaatggcgcccctctcctgccgcgaccttcccgcccggctaccgactcttccccaccatgctagcactcacccacacctctccttcctatcgggcccagcccctcgccgatggcgatcactcaccacctcaaacactctgcggcttcgcttggcggccactaaggacgacacggtcgcctccctcgtcggaaggctcgaacacgacgttgcgaactcccagtaccgcgacgacgttctggaagaagaagaagacgaagagcagcgggaggaggaagaagaggagcagcagttccttgaccttgacgacgacaacgctcggcgccgcggcgcggggaagcatcgggacgagctgcgcagtcggtggcgcgagatccacgggtgcgacgactgggcggggctcctggaccccatggacccgctgctgcggtcggagctgatccggtacggcgagctggcgcaggcctgctacgacgccttcgactacgacccgtcgtcccgctactgcggcagctgcaagtactcgcggcgcgacttgttcgagcggctgggcatggcggacgcggcgcgcggctacgtggtgtcccggtacctgttcgcgacgtccaacatccggttccccaacttgttcccgcagtcccgggcgggcgccaggatctggagccagagcgcgagctggatcgggtacgtggccg

SEQ ID NO: 94698 - DNA, 859 bp, Zea mays
  misc_feature: Ceres CLONE 1584605
  misc_feature: Encodes the peptide sequence at SEQ ID NO. 94699
gcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaagtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctctttcccttttatcgcggtcgctgggctctttctcctcttccgccgcgcgcagggcgggccccgcgcccgggcctggtgggctccgcgggccaatggacttcgggccgctccagagcaagtttcaggaagtgccctgagacggttgtcaacctttctcgaagtttgcggct

SEQ ID NO: 94699 - protein, 239 aa, Zea mays
  misc_feature: Ceres CLONE 1584605
  misc_feature (103)..(232): Pfam Name: FtsH_ext Pfam Description: FtsH Extracellular
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGFVAFVGNLLFPFYRGRWALSPLPPRAGRAPRPGLVGSAGQWTSGRSRASFRKCPETVVNLSRSLR

SEQ ID NO: 94700 - DNA, 801 bp, Zea mays
  misc_feature: Ceres CLONE 1584607
  misc_feature: Encodes the peptide sequence at SEQ ID NO. 94701
  misc_feature (684)..(684): n is a, c, t, g, unknown, or other
  misc_feature (693)..(693): n is a, c, t, g, unknown, or other
ctggagctccccgcggtggcggccgctctagaactagtggatcccccgggctgcaggaattcgtctcacccctagaaaagttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccagggctgcctgcgcggatgtcctcgcctgcttcgtgctctccgccgcggactcgccggcatctgcggcacgcaacgatggcgcgcgcctccgactgtcctcgcgctcaccgcacgtctggaccgacctcacgttcaactggcgggtggtggtcgccaccgtcgtcgggttcctcggttccgcgtttggcaccatcagcggcgtctgcggaggcgggatcttcgtgcccatgctcaacctcgtcgtcggcttcgacaccaaatccgccgccgcgctctccaaatgcatgatcatgggggcctcggcgtcatcggtttggtacaacctccaggtgtcgcacccgaccaaggaagcgcccgtcatcgactactagctcgcgttgctcttccagcccatgcttatgctcggcataaccatcggcgtagagctcagcgtctctncccgatacntggctgatcactgtcctcattataatcctcttcgtaggcacctcgtcgagatccttctacaagggaattctgatgtgggaggggaggtagacaggattctgacggaga

SEQ ID NO: 94701 - protein, 151 aa, Zea mays
  misc_feature: Ceres CLONE 1584607
MVMEGRTGSLYGRLNKSSTRGFLAYTAARAACADVLACFVLSAADSPASAARNDGARLRLSSRSPHVWTDLTFNWRVVVATVVGFLGSAFGTISGVCGGGIFVPMLNLVVGFDTKSAAALSKCMIMGASASSVWYNLQVSHPTKEAPVIDY

SEQ ID NO: 94702 - DNA, 885 bp, Zea mays
  misc_feature: Ceres CLONE 1584608
  misc_feature: Encodes the peptide sequence at SEQ ID NO. 94703
ctccccgcggtggcggccgctctagaactagtggatcccccgggctgcaggaattcgtctcacccctagaaaaagagtgaggcggagtgagcaacgagaccctctccccacatggcgccaccgccgctgcccctcttctccccgtccctaaaggccccgccgccgccgccatggctccacgggtcctccacccaaagccgcgactccgcacccccggtgcctccactccccgccgaggcaactccttccaggttccgcaccgacagctccaaaccggcaccggcaaggaaaacacaaaacaacagccaagcccctcactgcccgagtccccgggaggcgcacccaaccgagcggtctcgggatcattccagggcgtccgctccttcaaactctccgaatgctccgaatcccaaattcgtccacaccagccaaccggccgtggccgccgccgccgcattccacccttacgatccgagctgtcccccgccgcggggaccaggccaaatatggtggttgaaaaaaagaaaaatcaccgggcctggttccctggggcggctgccaagggacgaagggccctcaaggttggccccgccggcggggagaaaaaaccccccgggaagccaacccccgccggaaaaccaagcttgaaaacccccgaacttggttccccccttgcggggtttggccccccggaaaaagcaaggttgggcccggggcaaaaaagggccgaatccccccgaacaaggtaatcaaaggagggggcctaagggaaatgggccccattgggggaaggaaacctccccccccctggcccattattcaaaccacctcccgccggggcccatgggattccgccccaagggaaattctttggaaattaaaaca

SEQ ID NO: 94703 - protein, 178 aa, Zea mays
  misc_feature: Ceres CLONE 1584608
MAPPPLPLFSPSLKAPPPPPWLHGSSTQSRDSAPPVPPLPAEATPSRFRTDSSKPAPARKTQNNSQAPHCPSPREAHPTERSRDHSRASAPSNSPNAPNPKFVHTSQPAVAAAAAFHPYDPSCPPPRGPGQIWWLKKRKITGPGSLGRLPRDEGPSRLAPPAGRKNPPGSQPPPENQA

SEQ ID NO: 94704 - DNA, 907 bp, Zea mays
  misc_feature: Ceres CLONE 1584609
  misc_feature: Encodes the peptide sequence at SEQ ID NO. 94705
aagctggagctccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtcttcgagggcgagtcggcgggccccgggcggcttctttcgccttcgtcgggcaacctccctcttccctttaatcggggttcgctgggcctcttctttctccttccgccccgccgcaaggggcgggcccggggctccggggccttggtgggcctcggggcggggcccaatgtgaacttcgggccggcccccaagaaaaaaaattctccgggaagggggccctggaaaaacggggggttcacacctttccttcgaaggtttga

SEQ ID NO: 94705 - protein, 250 aa, Zea mays
  misc_feature: Ceres CLONE 1584609
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVFEGESAGPGRLLSPSSGNLPLPFNRGSLGLFFLLPPRRKGRARGSGALVGLGAGPNVNFGPAPKKKNSPGRGPWKNGGFTPFLRRF

SEQ ID NO: 94706 - DNA, 851 bp, Zea mays
  misc_feature: Ceres CLONE 1584612
  misc_feature: Encodes the peptide sequence at SEQ ID NO. 94707
gctccccgcggtggcggccgctctagaactagtggatcccccgggctgcaggaattcgtctcacccctagaaaaatagaaaaaagaaccagctcgccccggccgccgcgaccgtcccccctcatcgactcgaggcaacgaagcggccggatgggagcagcagcctgaccctgacgcgatgagcccgcccgccatgctgctgcccgtctgctccgccgcgcccagctgctcccccctctgcccggtgacggcctcgcacgtcgtcgcgcgggtggcgcggagggtggacgtcggcgccgcgctcaggtcctacgccgactcgctcgtcgcgcaggtgcccgaccgcccgccgctcgccgactcctccatactctccccctacatcgccgcgccggacgacatcgcgcgagccttcggcgcccccgcctccgagctcccgccgctccccagcgccgaccccagccctgggctatgttgcacgggcaccgaccagccgctggcggcagtcgcggacctggccgcaactgccgtggtcaactcggctcccaccgacgccgcggagcgggccctgtcggacgcgccgttccccagcacgttcccgtctgacgcgtccgaggtcgaggactccgtggcccagctcatcgataaggtcggcaagcaggtcttccagggcggagacgcgctcaccgaggcctacgaacagctggagctgtccgcgtacaaaccccttcgtgcttgaaggagacgggtcccaaccccataagtgggttcaggcgtcggtcaaccccgaagcaacagcccccggaggggtccggatgcttcgggccgttgcccgaaaaggggcccgagctg

SEQ ID NO: 94707 - protein, 181 aa, Zea mays
  misc_feature: Ceres CLONE 1584612
MLLPVCSAAPSCSPLCPVTASHVVARVARRVDVGAALRSYADSLVAQVPDRPPLADSSILSPYIAAPDDIARAFGAPASELPPLPSADPSPGLCCTGTDQPLAAVADLAATAVVNSAPTDAAERALSDAPFPSTFPSDASEVEDSVAQLIDKVGKQVFQGGDALTEAYEQLELSAYKPLRA

SEQ ID NO: 94708 - DNA, 1239 bp, Zea mays
  misc_feature: Ceres CLONE 1584613
  misc_feature: Encodes the peptide sequence at SEQ ID NO. 94709
  misc_feature (1)..(1): n is a, c, t, g, unknown, or other
  misc_feature (17)..(17): n is a, c, t, g, unknown, or other
  misc_feature (69)..(69): n is a, c, t, g, unknown, or other
  misc_feature (72)..(72): n is a, c, t, g, unknown, or other
  misc_feature (808)..(808): n is a, c, t, g, unknown, or other
  misc_feature (824)..(824): n is a, c, t, g, unknown, or other
nttgtgtttgtgttttntttctttgttctacgttgctttttacttgttttcggaggaaataaacctggngtngcaaactgggagctcaccgcggtggcggccgctctagaactagtggatcccccgggctgcaggaattcgtctcacccctagaaaaagcactcttgggttcttgcatcccgcataccctcgaaatctcgaaagatcccgcggcgcagcagccacccttctctcctctccgctcccaatcgtatcgtcgcctccctcgaagtcgccgctgccttcattccaccatggctcttcacgccccggtccacgtgatgaaggactcgctgaatcgggagtctggtgcgaaagttcaccaacccaacatccaggtggccaaggctgttgccgacatcattctcacgacattgggtcccaaatccttgctgaaaaatgcttcttggaactggtgcagatcttgtcggtcaccaagtgatggggaacttcaactttggaaggcaaaaaaaaacatcgataaaccccggagtgccaaagcctaatgaattgaaaacaaaagtctaaacccctaagaatcaaaaaaaagttggggggaatggagcactaacattcctggtctattatgtttcccaacccatgggaaaaaaaaagtacacaacacccttccttggcccctaaagagcgtatttccattttaggcaacaagagtacaagcttaccgctaattgcttttaaagttgggtactaattttttgggattcggaaaatcacaacaatcgctctaccccctaaaaaaaactggggntcttccggggcgtatnaaaaaatgtctcgttatatctcacgccagtttgataacacctggtggacaacccataactcaactatgtcggcgaaatattgaccctaatggcatcctagacatcgctatttagaaatagtcaaatcatacatgtacggagtacgcacaaatgtgcatattgatggatttcactatcgtggtgaaaaaaaaggtcttcatcccaatgtgggggtgcgaccaaagagaattatgaccccccggaacaccagactcgtacgtgtggttaatctcttaacattatactccgcgaacccaacccgcaccctttatttagaaattaatcctccagattccatgaccagctctgtgttgtagtatctaccgcctatttatataactatgctgaatactaaccggttataatacatatcaca

SEQ ID NO: 94709 - protein, 83 aa, Zea mays
  misc_feature: Ceres CLONE 1584613
MALHAPVHVMKDSLNRESGAKVHQPNIQVAKAVADIILTTLGPKSLLKNASWNWCRSCRSPSDGELQLWKAKKNIDKPRSAKA

SEQ ID NO: 94710 - DNA, 826 bp, Zea mays
  misc_feature: Ceres CLONE 1584618
  misc_feature: Translation starting site: 189
  misc_feature: SWISSPROT Homolog: EC 2.7.11.1 Non-specific serine/threonine protein kinase
cccgcggtggcggccgctctagaactagtggatcccccgggctgcaggaattcgtctcacccctagaaaaaatagctgtagctttcaccccactccctccacggcaccgcgcctccctcccccccttccccaaatcctcctcccctccccaattgggccaatagcccgctccgtctccgtcgccggcgatgagctgcttcgtctgcttcgggtcgggccggatcgcgcagtggctcgcgtcggatcagataaatcaagatcacagggtggaccagactctaagaaggatctaattatccataaggatgggaatagtcaaaatattgcagcacagactttcacttttcgtgagctcgctgcagccactaagaacttcaggcaagattgccttttaggagagggaggttttggtcgtgtatataaaggacgcttggagaatgggcaggctgttgctgtgaaacaacttgatcgtaatggtctccaaggaaacagggaatttctggttgaggttctcatgctcagtctcttacatcacactaacctggtcaatctaattggctactgtgctgatggtgaccaacgccttcttgtttatgagtttatgccattggggtcactagaagatcatctgcatgatctgccaccagataaagagcctcttgattggaacacacggatgaagatagctgcaggtgcagctaagggcttagaacaccttcatgacaaggcgagtcctcctggtgattaccggggattttaaagtcatcaaacatttcttcttgggagaaaggatttcattccggaagctatcgggactttgggccta

SEQ ID NO: 94711 - DNA, 789 bp, Zea mays
  misc_feature: Ceres CLONE 1584623
  misc_feature: Encodes the peptide sequence at SEQ ID NO. 94712
  misc_feature (751)..(751): n is a, c, t, g, unknown, or other
ctggagctccccgcggtggcggccgctctagaactagtggatcccccgggctgcaggaattcgtctcacccctagaaaaagatagggaagtattcgtgttcgtgtccgactccagtggacaaggcatggcggggagaggcggcggcggcaaaggcgccgcagggaggatgatgtcgctgcaggaattcgtgtcctgcatgcagccgctcatcgatctcgagaaggcggcggagatatcggcggagtccgagacgagcgctaagagcctggagaggagggggtgcgtcattgccaacctcaagtgcactgatgcccagacgggactgatggggaagacgctcctggagttccaacccaacaaaggcgacgttctcccgtctcacaagtttggaacacatgatgtggttgccctgaagccaaataaggcagatgctggatctgcttcacttggtcaaggtgtagtttatcgcttaaaggattcttccattactgttgcttttgatgatattcctgaagatggcttaaacagccctctgcgtcttgagaagcttgcaaatgaggtcacttatcgcaggatgaaggatgcactaattgaacttagcaaggctgtccaaacaggaccttgtgcaaaccttgttcctgttttatttggagagaaggcacccatgcgctccaaggatgctatgaaattcagtccattcaacaagaacttggatgattcacagaaagaagctatttcgaaggctctggnatcaagggatgttttcttgcttcacggacctcctggaa

SEQ ID NO: 94712 - protein, 221 aa, Zea mays
  misc_feature: Ceres CLONE 1584623
  misc_feature (209)..(209): Xaa is any aa, unknown, or other
MAGRGGGGKGAAGRMMSLQEFVSCMQPLIDLEKAAEISAESETSAKSLERRGCVIANLKCTDAQTGLMGKTLLEFQPNKGDVLPSHKFGTHDVVALKPNKADAGSASLGQGVVYRLKDSSITVAFDDIPEDGLNSPLRLEKLANEVTYRRMKDALIELSKAVQTGPCANLVPVLFGEKAPMRSKDAMKFSPFNKNLDDSQKEAISKALXSRDVFLLHGPPG

SEQ ID NO: 94713 - DNA, 862 bp, Zea mays
  misc_feature: Ceres CLONE 1584624
  misc_feature: Encodes the peptide sequence at SEQ ID NO. 94714
  misc_feature (677)..(677): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
ctggagctccccgcggtggcggccgctctagaactagtggatcccccgggctgcaggaattcgtctcacccctagaaaaaatttttttcgaccgccgccgcccccagtccccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggcgctgatcctcctcgcagggcgcttcatggggaagagagtggtgtttctcaagcagctcaagtccggcctgctccttatctctggtgagccacgcttggttcgctgcctctgatcacagcataagttctgagtggaatgtgagatgtaaatgtctacgcgctggttggctcaatctgtaaactatattattttgatagtggttaaagaatcagaattcagtctggactataggacctgcatgcgtgatataagggcatccaggttttggtgaagagatttgcggcgggggaantcnnnnncgccccccgaaaattaaatggttctaggccgcttcgacgcaagaatctcgcctctccatcttacaggggggaacggaatttcttagcttttggccgggcatgccaatggaaaaatttccgaattccttcggggaataattccaaggccccaaaggggaatggtggcttggccctccac

SEQ ID NO: 94714 - protein, 116 aa, Zea mays
  misc_feature: Ceres CLONE 1584624
  misc_feature (1)..(49): Pfam Name: Ribosomal_L6e_N Pfam Description: Ribosomal protein L6, N-terminal domain
MAPTSKLSTGIKRASRSHAYHRRGLWAIKAKNGGAFPKADKAAAAVEPKFYPADDVKPRVPSTRKPKPTKLRSSITPGTALILLAGRFMGKRVVFLKQLKSGLLLISGEPRLVRCL

SEQ ID NO: 94715 - DNA, 879 bp, Zea mays
  misc_feature: Ceres CLONE 1584626
  misc_feature: Encodes the peptide sequence at SEQ ID NO. 94716
ctggagctccccgcggtggcggccgctctagaactagtggatcccccgggctgcaggaattcgtctcacccctagaaaaaaagaagagtacgcccactcctccggctcttcttctccaccggcaccagtccaccacctcctgccaccgcgcggccccaaccaaccacaccgcagcgcatcaatggcgggcaacggcgccatcgtggagagcgacccgctgaactggggcgcggcggcagaagagctggccgggagccacctggacgaggtgaagcgcatggtggcacacgcccggcagcccgtggtcaagatcgagggctccaccctccgcgtcggccaggtggccgccgtcacctccacgaaggacgcgtccggcgtcgccgtcgagctcgacgaggaggcccgcccccgcgtcaaagacagcagcgagtggatcctcgactgcatcgcccacggcggcgacatctacggcgtcaccaccggcttcggcggcacctcccaacgccgcaccaaggacgggcccgcgctccaggtcgagctgcccatgcatctcaacgccggaatcttcggcaccggcagcgacgggcacacactgccgttggaaggtcacccccgcggaccatgctggtgcgaatcaaaaccctcctccagggctacaccggcaacatgctttggagaattcccgaagggccttcacgaaactgcttcaaacaccggtggtaaacaccctggcatgccgcttccggggcaccaatcaacatcttccgggcaaaactgggtcccggatctccctaaattcgccgggccttcatgaaaggggccgaccccacaaggggaagggccggtctcccgttccaccggaaaagaaagggggggaac

SEQ ID NO: 94716 - protein, 210 aa, Zea mays
  misc_feature: Ceres CLONE 1584626
  misc_feature: SWISSPROT Homolog: EC 4.3.1.5 Phenylalanine ammonia-lyase
MAGNGAIVESDPLNWGAAAEELAGSHLDEVKRMVAHARQPVVKIEGSTLRVGQVAAVTSTKDASGVAVELDEEARPRVKDSSEWILDCIAHGGDIYGVTTGFGGTSQRRTKDGPALQVELPMHLNAGIFGTGSDGHTLPLEGHPRGPCWCESKPSSRATPATCFGEFPKGLHETASNTGGKHPGMPLPGHQSTSSGQNWVPDLPKFAGPS

SEQ ID NO: 94717 - DNA, 807 bp, Zea mays
  misc_feature: Ceres CLONE 1584627
  misc_feature: Translation starting site: 219
  misc_feature (569)..(569): n is a, c, t, g, unknown, or other
ctggagctccccgcggtggcggccgctctagaactagtggatcccccgggctgcaggaattcgtctcacccctagaaaaactttttcctggcaaaccctgcacgcctccgcaaccgcgtcgtcggcgtgcgcgatcccgagaggcccagccatcagcttccttggcggggtgtgtatgcgcgtacgtcggccgtgaccagatcggctgagccaaggccatggcggaaccggccctcctcgcgccggaccccttcgcggacctccccttccccgaatttcaggcgcccatcgacggcgacagtttcgcgctcgaggacttcgatctggaggatctggacctggacgtggacttcgacctcgacctcttcgcctcggacgggcaaccctcgcaaccgcccccgctcgcgacctcgtcctcctcggccgggtctccggttggaggctcgtcctcttccggtgccgtcggggacggcagagggctgaggaatgaggagtcttcggagtcgtcttcgaggagcgcgagcggcacgaggccagccgggcaaagggaaagggggaggaggacaaancgaagcggcgcgcgcggcatgtacgcaaccgcgagagcgcgcacctgtcgcggcagaggaagaagcagtacgtggaggagttagaggggtaagggtgaggccatgcaggccaccatcgccgacctctccgccaggatctcctgcgtcaccgccgaagacgccgctctcaaacagcacctgggtggcgctgctggggccgcgccgcgccgatgccgatgtaccccgcgatgtattcttt

SEQ ID NO: 94718 - DNA, 838 bp, Zea mays
  misc_feature: Ceres CLONE 1584628
  misc_feature: Encodes the peptide sequence at SEQ ID NO. 94719
  misc_feature (798)..(798): n is a, c, t, g, unknown, or other
  misc_feature (801)..(801): n is a, c, t, g, unknown, or other
ctccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccacttccgcaaggcgcgaaagctggtcaccgtgcacctgctcaacgccagcaaagtgcggtcncancgcctccggaaaaaaaaaaaaaagtcccccccccccc

SEQ ID NO: 94719 - protein, 197 aa, Zea mays
  misc_feature: Ceres CLONE 1584628
  misc_feature: SWISSPROT Homolog: EC 1.14.13.68 4-hydroxyphenylacetaldehyde oxime monooxygenase
  misc_feature (185)..(185): Xaa is any aa, unknown, or other
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYDHVFSSRPRSLVSDIIMYGATDSCFAPYGDHFRKARKLVTVHLLNASKVRSXRLRKKKKKSPPP

SEQ ID NO: 94720 - DNA, 853 bp, Zea mays
  misc_feature: Ceres CLONE 1584629
  misc_feature: Encodes the peptide sequence at SEQ ID NO. 94721
  misc_feature (594)..(594): n is a, c, t, g, unknown, or other
  misc_feature (743)..(743): n is a, c, t, g, unknown, or other
ctggagctccccgcggtggcggccgctctagaactagtggatcccccgggctgcaggaattcgtctcacccctagaaaaaagtatcgcctttgcccgcacacacggctcccattccatttccgctgcttgacgcgcacccacaccaccacagcacgcgacgcgagaccgaatccatccgtccgacgccgcctcgcctccctcagccctccgcagctcggcctctgcttgcgttgcgttgcgttgcgtgtgtatgtagtggccgcaacacaaaatcaagagacgtgatatatgcgacccccaacagccaacgaccggcctccaagcggtgggggtggagcagcagcagctggtgcagcagcaggggacgacgacttcgccttctactactcctacctccaggacgccgacgccgccgccgcctcagcgacgtcgacgctcgccctcgccgtcgacgaccccaaccccagcgccgcagggatgacgaacggccggcgccggaagcagcgcggggcagaagacgccgggtcccgcagggaatgtgagggaggcggccagaatgacgggcagaagctgtccatcgccaagctgctcanctcgctgggcgcgctggaggcggaagagcacgccgaccgcgcgggcgccgcggacgcgtccaggcgggagctggggctgctcaagtcaaaggcggaacccggtcgcagggcaccatggactactacgccaagaatgggaagaagctttnaaccccacggcggaatcccaaagcccccgccagggtcaagggcctccagggttgcccgggtgggccccccacccgggcctttttgggcccggggaaagagggttcaccgc

SEQ ID NO: 94721 - protein, 125 aa, Zea mays
  misc_feature: Ceres CLONE 1584629
  misc_feature (39)..(39): Xaa is any aa, unknown, or other
  misc_feature (89)..(89): Xaa is any aa, unknown, or other
MTNGRRRKQRGAEDAGSRRECEGGGQNDGQKLSIAKLLXSLGALEAEEHADRAGAADASRRELGLLKSKAEPGRRAPWTTTPRMGRSFXPHGGIPKPPPGSRASRVARVGPPPGPFWARGKRVHR

SEQ ID NO: 94722 - DNA, 842 bp, Zea mays
  misc_feature: Ceres CLONE 1584633
  misc_feature: Encodes the peptide sequence at SEQ ID NO. 94723
  misc_feature (777)..(777): n is a, c, t, g, unknown, or other
  misc_feature (800)..(800): n is a, c, t, g, unknown, or other
ctggagctccccgcggtggcggccgctctagaactagtggatcccccgggctgcaggaattcgtctcacccctagaaaaagcaagactcaatacacaagcagagctcaaacaattcttgcttcccgctagctagctcgcaagaaataatggctccacttcttcttgcttctcgcacagcctgtcgtcctggccttacaagccgccatgcccatgataatggccggcacggcctgtcttcttcaccaccaggaagtcgtagtaagcgaagccgtagccttagcttgaggccacgagctgaaaagacgacgacaggcggtgggggtcatgttgtgagcgaaaagctgagcccctggcaaatccccaggagggagtggttcccccctagctttatctttggtgctgccacttcagcataccaaattgaaggggcttggaacgaaggtggaaaggggccaagcacttgggacgacttctgccacaaccatccggagtggatagcggacgggagcagtggggatgttggagcaaactcctactatctgtatagggaggacgtcagattgctgaaggaaatgggtatggacgcctacaggttctccatctcttggcccagaatattgccaaaggggacactcgagggaggcattaaccataaaagcatcgagtactacaaaaagctgatcaactttgttgaaagagacggcatagaaacatatgtgacacttttccactgggacacacctcaagcactggtggaacagctaccggtggcttcntagaatgaaaagaattggtaaangactacacagactttcgccaaagtggtgctttgttgcacttc

SEQ ID NO: 94723 - protein, 210 aa, Zea mays
  misc_feature: Ceres CLONE 1584633
  misc_feature (73)..(210): Pfam Name: Glyco_hydro_1 Pfam Description: Glycosyl hydrolase family 1
  misc_feature: SWISSPROT Homolog: EC 3.2.1.21 Beta-glucosidase
MAPLLLASRTACRPGLTSRHAHDNGRHGLSSSPPGSRSKRSRSLSLRPRAEKTTTGGGGHVVSEKLSPWQIPRREWFPPSFIFGAATSAYQIEGAWNEGGKGPSTWDDFCHNHPEWIADGSSGDVGANSYYLYREDVRLLKEMGMDAYRFSISWPRILPKGTLEGGINHKSIEYYKKLINFVERDGIETYVTLFHWDTPQALVEQLPVAS

SEQ ID NO: 94724 - DNA, 975 bp, Zea mays
  misc_feature: Ceres CLONE 1584634
  misc_feature: Encodes the peptide sequence at SEQ ID NO. 94725
  misc_feature (974)..(974): n is a, c, t, g, unknown, or other
  misc_feature (975)..(975): n is a, c, t, g, unknown, or other
gcggtggcggccgctctagaactagtggatcccccgggctgcaggaattcgtctcacccctagaaaatagaaaaaagaaccagctcgccccggccgccgcgaccgtcccccctcatcgactcgaggcaacgaagcggccggatgggagcagcagcctgaccctgacgcgatgagcccgcccgccatgctgctgcccgtctgctccgccgcgcccagctgctcccccctctgcccggtgacggcctcgcacgtcgtctcgcgggtggcgcggagggtggacgtcggcgccgcgctcaggtcctacgccgactcgctcgtcgcgcaggtgcccgaacggcccgccggctcgcccgacttcttcagactcgtccccctacatcgccgcgcccggacgacttttggtgggaggctttccccccccccccgccctccgagaatccccgccggtttcccaaggggccaaaccccaggcccctgggtctttagtttggacggggccacccaaccacaccccctggggggggagtttccgggaaccttggcccccaaattggcccggggggtaaaatccggggttcccacccctaaagccccccgggaaaagcggggcccccttgtcgggaaaaccgccctttttccccacaaagaagaattccccgcggtttgaaaacctttcccgaaggtgcggaaggagaaccccttggggcccgggggttatattcccatagaggggggggcaaaaagggggggcttttccggggcgggagggaagcccccgttcccccgaggggcccccccacaaacacgctgagggggggtgttctccgatttaaaaaaccgccctcgtgtggttttttgtgtaaaaaaaaaaagtgggcccccccaccgctaataaagtgtgggggataaaagagcgataggcgaacacacccccgagaataacaaaaaaggccgcctcgcagagagagctgccnn

SEQ ID NO: 94725 - protein, 160 aa, Zea mays
  misc_feature: Ceres CLONE 1584634
MLLPVCSAAPSCSPLCPVTASHVVSRVARRVDVGAALRSYADSLVAQVPERPAGSPDFFRLVPLHRRARTTFGGRLSPPPRPPRIPAGFPRGQTPGPWVFSLDGATQPHPLGGEFPGTLAPKLARGVKSGVPTPKAPREKRGPLVGKTALFPHKEEFPAV

SEQ ID NO: 94726 - DNA, 865 bp, Zea mays
  misc_feature: Ceres CLONE 1584640
ctggagctcaccgcggtggcggccgctctagactagtggatcccccgggctgcaggaattcgtctcacccctagaaaaaatcagcgcgctggaccctttccactcccctcacctctctctaccatgaccactggcacggatccataccagctgcagcagctgggcgtgggagctagcttcggacggtcgattaatcgatagatggctccgtcatcatgactcgagcagatcaagcactgctgctcgacagagatcgtgaaacgcgacggtggaccgtcagggccagagcacggtgtctcctgccttcacggcgcgcgtgcaccacctcctgccggacctccagggctgcgggaacctcagcgacgtgcgtgctcgggtacgactacctcatcagtcaactgtcaccacctggccactatccaagtcatcgggctggagagcggtggcggactgggccgcctcaggcctgacgagctgaggcgcaaggagtggggggaaggccctttccacagggtcaacgggggcgatgtgctcgcggaacacccgtaggcgatccccctcctaattggaggccaagaccgggacgggtaacccctgggccatgggatgataccttgcggcgcgactggctcagggggccccaagggggtaaggaaacaaaccgggggggccgggtcgggataggtagggaccaagggcgtccgggggtagaccaagggggggtgttccggggcaaaacccagggatagaaggggcaaacccccaaaggagcccctcgcgaaagctatttaaaaaaacaaaccggccatgggggggaacacccgtgtaacggagaggggccgagcccacaagagcctatcgagga

SEQ ID NO: 94727 - DNA, 945 bp, Zea mays
  misc_feature: Ceres CLONE 1584641
  misc_feature: Encodes the peptide sequence at SEQ ID NO. 94728
  misc_feature (20)..(20): n is a, c, t, g, unknown, or other
  misc_feature (103)..(103): n is a, c, t, g, unknown, or other
  misc_feature (104)..(104): n is a, c, t, g, unknown, or other
  misc_feature (110)..(110): n is a, c, t, g, unknown, or other
  misc_feature (517)..(517): n is a, c, t, g, unknown, or other
ctgaagctcaccgcggtggncggccgctctagaactagtgtatcccccgggctgcaggaattcgtctcacccctagaaaaaaaaaaaaaaaaaaaaaaaaatnncgtctngtcggaaaaaaataaaaaaaaaaaaagaaaagaaataaataggttccttttccccatctcccaaataaaattggggagttctccctcctctgccgcaatggggctctctggggaaaaaaccccgtcgggacgggagaaaaaggtaaaggatttctcgaagggggacttcggccccctcaaaattgagctggccaaggtcaaaatgcccggcctcatggggtgccgcgccaagttcggcccgtcaaaacccttcgccggggctaggatctgggggtctccccaaatgaccatcgagaccccccccctaatcgaaaccctaaccgggctcggcgccaaggcccgctggggctcctgaaaaattttctccaagaaggaaaaagcggcggccggcattggggcgaaactanggccgccgggtttcgccctggaaagggggaaaacacccaagagaaaatggggggggggaacagaagggagggccctcaaattggggggaaagagaggggggggtcccaaaaactttaataggttaaaaaaaaagggggggaaaaaaccacagggtggttaaattaaaaagaagagggggttaaagggccccaggggggggattttccaaaaaaagacgggggaaagaaacccccgaaacccggggaggtccccccgaaaaaaagggcgaaaattaaaaaaaatggggcaaaacccaaattttctcgaaaaaaggggtttaaggggtgtgaacacccaaaaaaatatcccccaaagaaaaaataaaaaaaagagtttgttccgcgctcttctcttaaaagaaaaaccaaacccaggggtgtgttaaaaa

SEQ ID NO: 94728 - protein, 85 aa, Zea mays
  misc_feature: Ceres CLONE 1584641
  misc_feature (12)..(86): Pfam Name: AdoHcyase Pfam Description: S-adenosyl-L-homocysteine hydrolase
  misc_feature: SWISSPROT Homolog: EC 3.3.1.1 Adenosylhomocysteinase
MGLSGEKTPSGREKKVKDFSKGDFGPLKIELAKVKMPGLMGCRAKFGPSKPFAGARIWGSPQMTIETPPLIETLTGLGAKARWGS

SEQ ID NO: 94729 - DNA, 773 bp, Zea mays
  misc_feature: Ceres CLONE 1584642
  misc_feature: Encodes the peptide sequence at SEQ ID NO. 94730
tggagctccccgcggtggcggccgctctagaactagtggatcccccgggctgcaggaattcgtctcacccctagaaaaatcgcgctccgttcacccaaaatttccccatctccgacctcccccttcctctccccctgccgctccccgcgccgagaaggagaaccccagccgccgcgcagcgcgccgcccatggcctcctcgtcggagaacgcggctgtgccgccggaggaggagccccaggccccgccgccgccggacacagagcctaccgaggcggcgcccggcgaggcggaggatgagccgcaaaccctagagcgggcgcaggagctcttcgacaggggttccaaggccatcgaggatgaggacttcgtcgacgccgtagactgtctcagccgagcgctcgagatcagggcttcacattatggagagctcgcaccggagtgtgccagcacatacttcaaatatggatgtgccctgctatacaaagctcaggaggagagtgatgttttgggaaatgttcccaagagcttgccaaatgaagactcagtgaagagtacagctactaaagatgacagtggaacctcaaaggtctctggtacggatgcggaggatgctgcgtcatcagaaaaaagtgatgctgaaggaggtcccaactcaaatggcaaaaatcaaggagaatgggaatggtgaaagttgaaaagatgattgaccacctcgacaatgatggaaaaattggaaattgaaaaggataaaggtttgggatccttccctgg

SEQ ID NO: 94730 - protein, 166 aa, Zea mays
  misc_feature: Ceres CLONE 1584642
MASSSENAAVPPEEEPQAPPPPDTEPTEAAPGEAEDEPQTLERAQELFDRGSKAIEDEDFVDAVDCLSRALEIRASHYGELAPECASTYFKYGCALLYKAQEESDVLGNVPKSLPNEDSVKSTATKDDSGTSKVSGTDAEDAASSEKSDAEGGPNSNGKNQGEWEW

SEQ ID NO: 94731 - DNA, 983 bp, Zea mays
  misc_feature: Ceres CLONE 1584645
  misc_feature: Encodes the peptide sequence at SEQ ID NO. 94732
  misc_feature (388)..(388): n is a, c, t, g, unknown, or other
  misc_feature (397)..(397): n is a, c, t, g, unknown, or other
ctccccgcggtggcggccgctctagaactagtggatcccccgggctgcaggaattcgtctcacccctagaaaaagtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgctgggagctgtcggcgtggctcagcccctcccgaccacgtcgctctacgtgggcgaccnccccccccnccgtctcggactcgcagctgtacgaactcttcagccaggcggggcaggtggtgtcggtgcgcgtctgcagggatgtcacctcgcggcgctcgctcggatacgccttacgttcaactacagcaatccctttggatgctgcgagagcattgggaagtgctgaacttttgctgctccttaacaacaaagcctatcccggggggatgtatttcaaaccggtgaatccaaagcaggcccccagggagggggaaactgcctaacctttttcaaataaacaaatcttgggccaggcccattgggccattaaaaaccccctttcatggagaaactttttctttcaatttggggacccctttcccctcttgttaagggtagcctccgggaaataaaaccggggcccaatcccaaagggctttggggttttgggtccggtggtgcacaaaaaaaaaaacttgccccaaaaccctattaaaaagtttttaaacggggggtcttttaaaaagaaaaagccgtggtttttgttgggacattttgtttcccaagggagagagaagaaaactttctcttttgaaacagaaaagatttaaga

SEQ ID NO: 94732 - protein, 119 aa, Zea mays
  misc_feature: Ceres CLONE 1584645
  misc_feature (32)..(32): Xaa is any aa, unknown, or other
  misc_feature (35)..(35): Xaa is any aa, unknown, or other
MGARALSPRWCRWELSAWLSPSRPRRSTWATXPPXVSDSQLYELFSQAGQVVSVRVCRDVTSRRSLGYALRSTTAIPLDAARALGSAELLLLLNNKAYPGGMYFKPVNPKQAPREGETA

SEQ ID NO: 94733 - DNA, 853 bp, Zea mays
  misc_feature: Ceres CLONE 1584652
  misc_feature: Translation starting site: 384
  misc_feature: SWISSPROT Homolog: EC 1.2.1.70 Glutamyl-tRNA reductase
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
ctccccgcggtggcggccgctctagaactagtggatcccccgggctgcaggaattcgtctcacccctagaaaaaacgccctcgtggacaccgacaactgagcggggagagaggtagagaggttcgcgcacgacagtttctgctcctctctcggctcgcctccgtctgctttcctctctggttctctctctgcgattctcatcgcattggttcccgttccctcgcgaatggcggtggctctctgtcttccctgatctatctagataatggcgaccacgacgtcggcgagctccgccgccgcagcagccgccaccgccgccaagccgcgggggtcgtcgtcaggcctctgccagatggtggcctgcggcagcgtgctgctctcccatgtggtgctgtgctacgcctccctgcgtggatgccctggcgcaggccgtggcaaaggctgccagcgtcgccgccctcgagcagttggagatatccgccgaccggtacatgaaggataggagtaccatagctgtgataggcctcagtgtacacacagaagcctgtggagatgcgtgaaaaacttgctgttgcataggaactgtggccccgtgctattcgagaactcactagcctgatccatatgtgagaagctgctgttcttaggggcgtgctatagactggatatttatgtggtgggcgctatcatggaaccgtgctatcacaggagcagtggtactggatgtcgaaataatactgagattcccgcttccttagttacgggagcacctggtttggggnnnnnnnnnnnnnnnnnnnnnnnnnnnnnnnnnnnnnnnnnnnnnnnnnnnnnnnnnnnnnnnnnnnnnnnt

SEQ ID NO: 94734 - DNA, 866 bp, Zea mays
  misc_feature: Ceres CLONE 1584655
  misc_feature: Encodes the peptide sequence at SEQ ID NO. 94735
caagctggagctccccgcggtggcggccgctctacaaccacggatcccccgggctgtaggattcgtcttcccctagaaaaaaactctctactagagctcaagctctagctgtagataccccgccaatgcgggaaaaatggctccacttctcgctgctgacgataaccaggatgccccccatcatgggctcatgaaccacctactaggacccaacgatgacactttctcacggctgcacctgccgtcctcttctccccagacccgcaggcgaatgtgtaaccttagctttcctacacgatctgcaacactaggcagccacaaatggaggactgatgttgagcccctccgaaatcccacaaagggactggttcccctctgacttaaccttcggtgccaccacaccaccgcatcaaatagaacgtgctcggaatgaacatggtaaagcggaaagctactgggatcacttctgccacaatcatccagaaacgatactgtactgcagcagttcacaccttctagcgaattcttaccatatgtacaatacccacgtctgattgctcaaggaaatgggcatggacgcctatacgttctctatctccttgcccagaacacctgccaaatgggcacctaggagggaagtattgaccccggatgggcttcaggtactacagaaaaccctcttccactttgttggctccgaaaaaccggggtattagcccctttggctgaaaaattttttccccctggcgggatgattcccccaaacgcctccgggaaaagaagaaagtttcccgggccggccttttcccttataaatatagagaagtccaatataaagaaaacctattgtttaaaaaaatagaaat

SEQ ID NO: 94735 - protein, 73 aa, Zea mays
  misc_feature: Ceres CLONE 1584655
  misc_feature: SWISSPROT Homolog: EC 3.2.1.21 Beta-glucosidase
MLSPSEIPQRDWFPSDLTFGATTPPHQIERARNEHGKAESYWDHFCHNHPETILYCSSSHLLANSYHMYNTHV

SEQ ID NO: 94736 - DNA, 841 bp, Zea mays
  misc_feature: Ceres CLONE 1584659
  misc_feature: Encodes the peptide sequence at SEQ ID NO. 94737
ctggagctccccgcggtggcggccgctctagaactagtggatcccccgggctgcaggaattcgtctcacccctagttattgacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgggggcacggcgctgcgccgcgcccgcagcgtcacagacgacgacctcgacgagctccgcggctgcatcgacctgggcttcagcttcaagccggcgcccgccgccgcgtgcgcctgcacctgcgcctgcgccgggaggaaccgcctcctggagacgctgccggcgctcgacctctactacgccgtccacggcgggcccggcggaggggccgcccctgctcgagcggcgccgcgtcggaggcgtcctcgtccgaagagtcgcccctccgcagccccatgtccatactctctccaggcgacacccctggaaaccgtgaagatgccgccccaaccagtgggcgccagtggctgcgctgtccatgctgaacccccactgatcccccccagccaccgccgccgcataccttgtcgcattgtgagaagaaaaaaaaaaaccattcctggacctccccaccgccgaaagaaaggaacctccagccgtcgcccccgccgggaaatagacgagcaaaaaaaaaacccccttggggttgg

SEQ ID NO: 94737 - protein, 224 aa, Zea mays
  misc_feature: Ceres CLONE 1584659
  misc_feature (21)..(135): Pfam Name: DUF1685 Pfam Description: Protein of unknown function (DUF1685)
MEKAGQQRHVIGGGGKKAPALGLQKQNSWSPDIERDEAWERRRRGMRRGGTALRRARSVTDDDLDELRGCIDLGFSFKPAPAAACACTCACAGRNRLLETLPALDLYYAVHGGPGGGAAPARAAPRRRRPRPKSRPSAAPCPYSLQATPLETVKMPPQPVGASGCAVHAEPPLIPPSHRRRIPCRIVRRKKKTIPGPPHRRKKGTSSRRPRREIDEQKKNPLGV

SEQ ID NO: 94738 - DNA, 829 bp, Zea mays
  misc_feature: Ceres CLONE 1584663
  misc_feature: Encodes the peptide sequence at SEQ ID NO. 94739
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
ctggagctccccgcggtggcggccgctctagaactagtggatcccccgggctgcaggaattcgtctcacccctagaaaagactggtcactgtgccattgccgccgtccgtcctaggctcctagctagctagctagcaagctccgccgacgacggtacgtcaatcgagctagccctgcccatccactacactaccgcagcggcaagcaatggcgtgcggctctgctaccgccgctcgaccagcagcccgcctctggctgctggcggcggtggtggtggcgacctccttcctcgccgtcgcggcgccgccgggcgcgctggtgacgagcgtcccggggttcggcaacaagcagcagctgccgtcgaagcactacgccgggtacgtgacggtggacgagcggcacggcaggcggctgttctactacctggtggagtcggagcgcgacccggcccgggaccccgtcgtgctctggctcaacggcgggcccggctgctccagcttcgacggcttcgtctacgagcacgggccattcagctttgagccatcaggagggtcagctgggagcctgccaaagcttcatctcaacccttatagctggtctaaggtgtcgagtgtgatatacttggactcccctgccggcgtcgggctttcctactcaaacaacgtttcggactacgagactggcgacttcaagaccgccgccgattcgcacactttcctgctcaagtggttcccaaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 94739 - protein, 178 aa, Zea mays
  misc_feature: Ceres CLONE 1584663
  misc_feature (42)..(207): Pfam Name: Peptidase_S10 Pfam Description: Serine carboxypeptidase
  misc_feature: SWISSPROT Homolog: EC 3.4.16.5 Carboxypeptidase C
MACGSATAARPAARLWLLAAVVVATSFLAVAAPPGALVTSVPGFGNKQQLPSKHYAGYVTVDERHGRRLFYYLVESERDPARDPVVLWLNGGPGCSSFDGFVYEHGPFSFEPSGGSAGSLPKLHLNPYSWSKVSSVIYLDSPAGVGLSYSNNVSDYETGDFKTAADSHTFLLKWFPKG

SEQ ID NO: 94740 - DNA, 871 bp, Zea mays
  misc_feature: Ceres CLONE 1584668
  misc_feature: Encodes the peptide sequence at SEQ ID NO. 94741
ctggagctccccgcggtggcggccgctctagaactagtggatcccccgggctgcaggaattcgtctcacccctagaaaaagacgctcacctctactgtcttggttgctcaagctccaagcaggcggaagatgatggaggtggcgggggctcacgcccgcgcggttcccctcctgctccgcaacaccgcctccctgcggacctccgtctccgtctcctgcacgggctcccgccggagctgggtggcggcggccacggcggagggggacgagacccgcggcttcgacaaggtgcccatggacacccccggcgcgtaccgcctggtagaccgggacaccggccgcagcgtcatcgtgtggggcggcaccgacgacagcgacgaggcctccatgccgtcccccgcggtgctctcccggacacccgacggcgccacagccaaagggtttgggggaggtaacggtttcggggatttccgccgggtcaaggccccaaaaaaaaaaatcctggggccccaagggcccctcccccccaaaagggaaaattttaatccccccaaaccccgccgggggcggagaaaacccctcttcccaagggcctctaagaattaaaaaaaaaactttttttgaaaaaaaaaaaaagggtttcaaaatctgtaaacccccccccaaaaaaaaacgggggcccccccaaaagtgaaaaaccccagggggcccccctcccgagaaccgctttttgggccccccccgggggggggggtggttaaacccccccccggggggaaaaaaaaccttcttgggtccacaaaagaggggaaatttttcccccccttttttttttgggggggcggaaataaataaaagaggggacccccct

SEQ ID NO: 94741 - protein, 157 aa, Zea mays
  misc_feature: Ceres CLONE 1584668
MEVAGAHARAVPLLLRNTASLRTSVSVSCTGSRRSWVAAATAEGDETRGFDKVPMDTPGAYRLVDRDTGRSVIVWGGTDDSDEASMPSPAVLSRTPDGATAKGFGGGNGFGDFRRVKAPKKKILGPQGPLPPKRENFNPPKPRRGRRKPLFPRASKN

SEQ ID NO: 94742 - DNA, 917 bp, Zea mays
  misc_feature: Ceres CLONE 1584669
  misc_feature: Encodes the peptide sequence at SEQ ID NO. 94743
  misc_feature (76)..(76): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (289)..(289): n is a, c, t, g, unknown, or other
  misc_feature (297)..(297): n is a, c, t, g, unknown, or other
  misc_feature (299)..(299): n is a, c, t, g, unknown, or other
  misc_feature (302)..(302): n is a, c, t, g, unknown, or other
  misc_feature (304)..(304): n is a, c, t, g, unknown, or other
  misc_feature (380)..(380): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (403)..(403): n is a, c, t, g, unknown, or other
  misc_feature (404)..(404): n is a, c, t, g, unknown, or other
  misc_feature (437)..(437): n is a, c, t, g, unknown, or other
  misc_feature (646)..(646): n is a, c, t, g, unknown, or other
  misc_feature (796)..(796): n is a, c, t, g, unknown, or other
acccggcgggtggcgggccgggctctagaactagtgggatcccccggggctgcagggaattcgtctcacccctagnaaaactccttcctccattcctccagccacgccacacctcggcgcgtcccgccaaaaccccatcgatacccaaacgctagccagcccctctcccacgcggctatggtccggtcgcgtctggcggcggggcgggggggccttccccttcattggggcttgttttcccttgggttttcttcggggtcccccagaggannnnnnttnnngggggcgntcggcggngnggntntttgggggcgccgttttgtgggggttgtggggtggtggtgggggcgcgctggggccggggggggggggggttgcgnttcgcgttgggggcggcnnngcnnccccctcctcgcttgggtcggctgcctctccgntgggggcccggggggggggcggggggggggggggggcgtccggggaggggtggggggggggggggggggccggggcgggggcgggggtgcgtgcgttggcggggggggggggggtgttctgctctggggggcgtgtggggggggtgggcccggggcgggggaggctcgtgggcttgtgtgtcttgcttctgaaatgatggaggtggggnaggggggtttggggtgggggggtgggggggggtgggggggagcgtgagggcgctcattggtgtctatcggggtcgcgggtcgtcgcgggccctttgggggggtggggcccgctgccgggcgggcgggggggggcgggcgggggcgggggntctgtccccgcggggccgctgggccctgggagagccgccctcggccgggcgtggggtgcgtcccgggggggggccgggggcgcgagcggttatcctcgctcggtgtcctgcgggggccggg

SEQ ID NO: 94743 - protein, 171 aa, Zea mays
  misc_feature: Ceres CLONE 1584669
  misc_feature (32)..(32): Xaa is any aa, unknown, or other
  misc_feature (33)..(33): Xaa is any aa, unknown, or other
  misc_feature (34)..(34): Xaa is any aa, unknown, or other
  misc_feature (35)..(35): Xaa is any aa, unknown, or other
  misc_feature (38)..(38): Xaa is any aa, unknown, or other
  misc_feature (41)..(41): Xaa is any aa, unknown, or other
  misc_feature (42)..(42): Xaa is any aa, unknown, or other
  misc_feature (43)..(43): Xaa is any aa, unknown, or other
  misc_feature (68)..(68): Xaa is any aa, unknown, or other
  misc_feature (74)..(74): Xaa is any aa, unknown, or other
  misc_feature (75)..(75): Xaa is any aa, unknown, or other
  misc_feature (76)..(76): Xaa is any aa, unknown, or other
  misc_feature (87)..(87): Xaa is any aa, unknown, or other
  misc_feature (157)..(157): Xaa is any aa, unknown, or other
MVRSRLAAGRGGLPLHWGLFSLGFSSGSPRGXXXXGAXGGXXXWGRRFVGVVGWWWGRAGAGGGGGCXSRWGRXXXPLLAWVGCLSXGGPGGGRGGGGGVRGGVGGGGGGRGGGGGACVGGGGGGVLLWGACGGGGPGAGEARGLVCLASEMMEVGXGGLGWGGGGGWGGA

SEQ ID NO: 94744 - DNA, 1044 bp, Zea mays
  misc_feature: Ceres CLONE 1584673
  misc_feature (21)..(21): n is a, c, t, g, unknown, or other
  misc_feature (22)..(22): n is a, c, t, g, unknown, or other
  misc_feature (45)..(45): n is a, c, t, g, unknown, or other
  misc_feature (49)..(49): n is a, c, t, g, unknown, or other
  misc_feature (50)..(50): n is a, c, t, g, unknown, or other
  misc_feature (58)..(58): n is a, c, t, g, unknown, or other
  misc_feature (59)..(59): n is a, c, t, g, unknown, or other
  misc_feature (65)..(65): n is a, c, t, g, unknown, or other
  misc_feature (66)..(66): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (362)..(362): n is a, c, t, g, unknown, or other
  misc_feature (382)..(382): n is a, c, t, g, unknown, or other
  misc_feature (384)..(384): n is a, c, t, g, unknown, or other
  misc_feature (402)..(402): n is a, c, t, g, unknown, or other
  misc_feature (403)..(403): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (432)..(432): n is a, c, t, g, unknown, or other
  misc_feature (435)..(435): n is a, c, t, g, unknown, or other
  misc_feature (454)..(454): n is a, c, t, g, unknown, or other
  misc_feature (455)..(455): n is a, c, t, g, unknown, or other
  misc_feature (475)..(475): n is a, c, t, g, unknown, or other
  misc_feature (485)..(485): n is a, c, t, g, unknown, or other
  misc_feature (487)..(487): n is a, c, t, g, unknown, or other
  misc_feature (488)..(488): n is a, c, t, g, unknown, or other
  misc_feature (490)..(490): n is a, c, t, g, unknown, or other
  misc_feature (585)..(585): n is a, c, t, g, unknown, or other
  misc_feature (716)..(716): n is a, c, t, g, unknown, or other
  misc_feature (860)..(860): n is a, c, t, g, unknown, or other
  misc_feature (893)..(893): n is a, c, t, g, unknown, or other
  misc_feature (911)..(911): n is a, c, t, g, unknown, or other
  misc_feature (920)..(920): n is a, c, t, g, unknown, or other
  misc_feature (944)..(944): n is a, c, t, g, unknown, or other
  misc_feature (976)..(976): n is a, c, t, g, unknown, or other
  misc_feature (992)..(992): n is a, c, t, g, unknown, or other
ctcaccgccggtggcggccgnnctctagaactagtggatcccccngggnnctgcaggnnaattcnngtctcacccctagaaaaaaaaatttccacttcagtcgaggccacctcctccccctttcggcacgcagccatgggcaaccgtgcgtcgcgccaccaccgccacgccaccgagcagcagccagtagacgcctgaacccttccctaagccccagaaatccagccgcnnncgccggccgccgaaacgcagacgcagcagtaccagcatgccccgccgccgacgaagcgaagcggcggcggactctagggctggtggggcccctgcttgggggccccccctgggggggatcttgggggggncccacccactccctcccccncnccaaagaaataacgggannagtagagtttgtnnnnnnnnagataagtnttntatcctttatcttcccccnnccgaaggagatcaggccgcncgcaggcacncnncncaggcgcctccgacgcccccctcggcgcccccgcctccgcactccccccccgggtaccgacgcgggcgagacggagttattgcgacccccctgcnttcccgtgaacggcggacgcgggcggccccccttccgccgttcccactccgcttgggcggccttcgcggcgcaccaggcgcccggtgcggcagggagcgggattcgggtggtggactgccggggtcggtgntgggcgcggtgccgggggtgggtgtggggccggggtaggggcgcgacggtgcccgcgcgccgggacggcgggcagccgtagagggcggggacgcgttgcccgcgtttcgctcgcggattaagaagaggccggggtccagtgggnaagggggaggagggccgcccgcctataccgacntagacccgccgacacgtnatcgccgtntcctccctacttccgacgccttantatctaggcgagcgccgtgtcgcgctgggatntgagcgcggcgcgcanaggcgggcccagaactacacctgcatagacggaggcgatatatgcgacaact

SEQ ID NO: 94745 - DNA, 868 bp, Zea mays
  misc_feature: Ceres CLONE 1584676
  misc_feature: Encodes the peptide sequence at SEQ ID NO. 94746
  misc_feature (799)..(799): n is a, c, t, g, unknown, or other
ctggagctccccgcggtggcggccgctctagaactagtggatcccccgggctgcaggaattcgtctcacccctagaaaaaacttgcctgccccccacttctccgatctccgccccatcggacttcccaagggtcggctaggtggtctccaagctttccgcctttccacgccaccattctccccacccgcgcctcagcaatccagcatcgccgtttcgccgcggcaccgacacctcaccggccatgggcgcgtcctcctcgactggtaacccgtccccagaggcgcacgagcagcgggagcaggagaccctcgcctccgccgccctctccctcccgctcctccgcgccgccttctcccgctccgccgccaacgcgctgtcggatgccctcgcgccgccgcccgcctcctttcgtctgcccggatccccggcgccgccgccgccgcacttccacgacatcctcggggggctcggccccgccatcgcctcccaattctttggccacgaagctgccgcggtgacggacgggggcgccgggtgggtccagttcctcagggggttcaaccgctgctgcgcgcgcgtgacggcctcccgctcgctcgcactgctcctccgcgtgtacgctgccgcctgcgccggcgcgggggcaccctgcggcgtccagctccagccggacgagggcggtggtgacgaggatgggaaagtcgtgggggagctcgcgccggaagagatcgcagtgttcctctgggtgtgctggggtcatggcgtgaagcgcttcgggctcgagggtggtcagtgacnggaggagataaatcggaagccgtgcaccgtgctcctccccggacgtgacgcaacctggtgctgtcggcc

SEQ ID NO: 94746 - protein, 184 aa, Zea mays
  misc_feature: Ceres CLONE 1584676
MGASSSTGNPSPEAHEQREQETLASAALSLPLLRAAFSRSAANALSDALAPPPASFRLPGSPAPPPPHFHDILGGLGPAIASQFFGHEAAAVTDGGAGWVQFLRGFNRCCARVTASRSLALLLRVYAAACAGAGAPCGVQLQPDEGGGDEDGKVVGELAPEEIAVFLWVCWGHGVKRFGLEGGQ

SEQ ID NO: 94747 - DNA, 894 bp, Zea mays
  misc_feature: Ceres CLONE 1584679
  misc_feature: Encodes the peptide sequence at SEQ ID NO. 94748
  misc_feature (715)..(715): n is a, c, t, g, unknown, or other
ctggagctccccgcggtggcggccgctctagaactagtggatcccccgggctgcaggaattcgtctcacccctagaaaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcacgggcggcatgcacatatttgtgaagactctgactggtcagactatcacccttgaggtcgagtcttctgataccatcgactatgtcaaggccaagatccaggacgaaganggcatccctccggaacagcagcggctcatttttgtcggcaagcagctcgaagacgggcgcacgctggccgactacaacatgcagaaggagagcacccttccacttgttgctgcgtactcaggggtggcatgcagatctttcgtgaagacacttactggcaagacggatcacccttgaag

SEQ ID NO: 94748 - protein, 244 aa, Zea mays
  misc_feature: Ceres CLONE 1584679
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(226): Pfam Name: ubiquitin Pfam Description: Ubiquitin family
  misc_feature (186)..(186): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLTGGMHIFVKTLTGQTITLEVESSDTIDYVKAKIQDEXGIPPEQQRLIFVGKQLEDGRTLADYNMQKESTLPLVAAYSGVACRSFVKTLTGKTDHP

SEQ ID NO: 94749 - DNA, 914 bp, Zea mays
  misc_feature: Ceres CLONE 1584680
ctggagctccccgcggtggcggccgctctagaactagtggatcccccgggctgcaggaattcgtctcacccctagaaaaaaatcctctttctttagctcaagaccggcgactaaatttggcgccagccggcagcagggggtataagtagtcgccgccgccgtcttcctcgcacctccccgctccgctctcccttgtcgagttctcagcaccggccgatccatcctcctccgcctccctcggttcggcctctggcctgcacaccatgaactctcgcttccggagcctctggagagacatggctggggctttgcagccgccgtgccgcctcggagctgccgcgtgtagcttgctcgctaagcagcagctatagtagctgagcgagtgtgtacatcgatcagagtcgtccacctccgtctcgctttgcgattcggcgtcgtgaactcgtgttcttgagagtgggggcaagggggcagagcaacagggaaacacttctttcttcttctttacaacaaataagaaagcaacggccatggagggaggtggtctgcagtgacagttacacgagccatggattccgaggccattcctgcggttcttaattggggaacctcggtttgaactttcccgggggggaaacctatcaaggggggcgggccgggttttgcaatgggaaaaaccgggtggggggggtttccgggtgaaaaccgctccgggggcccctgggtcaaatccccggggattaacccttgaacccattttccaaagggggggggttttttctcccccaggagaacccaaacctcagggggctgtggtgggccccggggggaatttttggggccccccccgggttcgtggggcctttgaggggacgcggtgggtaaaaaaaagtgggccgttatattgtgttttt

SEQ ID NO: 94750 - DNA, 809 bp, Zea mays
  misc_feature: Ceres CLONE 1584684
  misc_feature: Encodes the peptide sequence at SEQ ID NO. 94751
  misc_feature (702)..(702): n is a, c, t, g, unknown, or other
  misc_feature (721)..(721): n is a, c, t, g, unknown, or other
  misc_feature (773)..(773): n is a, c, t, g, unknown, or other
ctcaccgcggtggcggccgctctagaactagtggatcccccgggctgcaggaattcgtctcacccctagaaaaaccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaggtgtgggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaggacagccctggcgttccaagtcgcgtctgctggccaagtccggcatcggncgacgagtcgtacaggccngcgctgcgtgttcgagcccacggcagctgcgccaccattgtatgaggggcgncgccgatgccgtccacgggcatgttcgcgggcgctg

SEQ ID NO: 94751 - protein, 193 aa, Zea mays
  misc_feature: Ceres CLONE 1584684
  misc_feature: SWISSPROT Homolog: EC 2.3.1.119 Icosanoyl-CoA synthase
  misc_feature (173)..(173): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELWRRCGGEATYDLATVLAFLAVLAFTISVYIMSRPRPVYLIDFACYKPADELKVSKAEFIDLARKSGKFDEDSPGVPSRVCWPSPASXDESYRPALRVRAHGSCATIV

SEQ ID NO: 94752 - DNA, 858 bp, Zea mays
  misc_feature: Ceres CLONE 1584685
  misc_feature: Encodes the peptide sequence at SEQ ID NO. 94753
ggagctccccgcggtggcggccgctctagaactagtggatcccccgggctgcaggaattcgtctcacccctagaaaaagcctcgcctttgttgatcttttccccttccagtctcccacattcccctcccccggccctcgccatcctctcccgctaaccccaccccgtcgccccggcctcctcggtccagcggcgagcgggtccgtccggtcccgacgccgcaccacatcaccgcctgctcccacggccgtcctcactcgacctcgatcggaacccccggatcggaggtaccttcgcgcgcggctccgctccgacctcgtcctccatcggttggcatcggaagcggcggcggcggcgggttcccagccagctttcgaaagggcaatcaatcgtcaggctttttgggagctgtgttggggggaccggggggaagagtgaagttactgcagaggctaacatttaggttgtcgagtgatggcgcaaggcgccaattttccctggtttcattggcgccgtgggtggccatggatggcggtgtggaacttgggcgggaacttctggtgacatggcctttctaccaaaagcttgggggagggcttcaaactggtcgggttgaccgcccttcaaaagcatgcaaaaccggcatggcatggggggatccatccccaatggtctggggaacaacaacagacggtggttggctccctaacagggaccccccccacggggaagggtttggaaaattcccgggtcctaaaaggggcctggttcttttggggggaagctccccccgggtgggggaaaaagattattcccggggcgggggggggggggcccccaagcctgtgaaggggaaggg

SEQ ID NO: 94753 - protein, 111 aa, Zea mays
  misc_feature: Ceres CLONE 1584685
MDGGVELGRELLVTWPFYQKLGGGLQTGRVDRPSKACKTGMAWGDPSPMVWGTTTDGGWLPNRDPPHGEGFGKFPGPKRGLVLLGGSSPRVGEKDYSRGGGGGAPKPVKGK

SEQ ID NO: 94754 - DNA, 891 bp, Zea mays
  misc_feature: Ceres CLONE 1584689
  misc_feature (413)..(413): n is a, c, t, g, unknown, or other
  misc_feature (424)..(424): n is a, c, t, g, unknown, or other
ctggagctccccgcggtggcggccgctctagaactagtggatcccccgggctgcaggaattcgtctcacccctagaaaaaatatttctctttgtccgtactcgggtcttccattttttccctcttgcccgagtcgctagcctccctgccactgcccctgccccgactcctcccgtggaccacttcctgcacctgcgcttctataccatgctaacatctgactcagcttaagtcgtcctccgtcgcatatagatggagggagcggagaagagaccggaaggtctgatataacctgccatcaaccaccaaccaatagccatgctctcgtccggggcagaatccgctgctgccctgtgacatctacatgaaaccaccacttccggttgtactagttttgtatgtcccacccccacnccaccaggcgnctcagcgaggacaacgaacatgcctctccatcaagataccccaacgccctgggcgcagggatgaccaacagccgcatcaccgatcccacggggaagtagataaatccccgggcgatctggaaatgttagtaggcaaggtcacacagacaggaagaaaaggtccatcgacgaacctgttcatcctcgaaggtccgccatcgatagcctaggatcaccccgcacaccttgggtttccacggtagttagtcagctccccgaactggtctcggcccccacgtcaaactttgtagctctccggctcaaaggccccccattggtacgaactacccccccataattgttgaattgggttttcgcggggccttctccacagagtagtattgccaaccaagccaacactcgccttgggacaaacccagccttgtcctggaaaccctatccggaaaatctctccggggcactaaggg

SEQ ID NO: 94755 - DNA, 874 bp, Zea mays
  misc_feature: Ceres CLONE 1584690
  misc_feature: Encodes the peptide sequence at SEQ ID NO. 94756
ctccccgcggtggcggccgctctagaactagtggatcccccgggctgcaggaattcgtctcacccctagaaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaccatccccaactccagtttgaggctgcatgggcactcaccaacattgcatcaggcacatcagagaacactaaggtggtggttgagaagtgtgctgtgcccatctttgtcaagctactcaactccttcagcgaggatgttcgtgaacaagctgtatgggctttaggtaatgttgctggggactccccaaagtgcgtgatctggtacttggtcatggtgggctatacctttgctgcagcagctaatgagcagctaga

SEQ ID NO: 94756 - protein, 214 aa, Zea mays
  misc_feature: Ceres CLONE 1584690
  misc_feature (4)..(97): Pfam Name: IBB Pfam Description: Importin beta binding domain
  misc_feature (106)..(147): Pfam Name: Arm Pfam Description: Armadillo/beta-catenin-like repeat
  misc_feature (149)..(189): Pfam Name: Arm Pfam Description: Armadillo/beta-catenin-like repeat
MSLRPSEREQMRKGNYKQTVDAEESRRRREGQMVDIRKAKREESLQKKRRDGFPASAAGVPPMGHSTALQQKLDGLPAMVQAVHSNDPSVQLEATTQFRKLLSIERSPPIEEVISTGVVPRFIEFLTREDHPQLQFEAAWALTNIASGTSENTKVVVEKCAVPIFVKLLNSFSEDVREQAVWALGNVAGDSPKCVIWYLVMVGYTFAAAANEQL

SEQ ID NO: 94757 - DNA, 876 bp, Zea mays
  misc_feature: Ceres CLONE 1584692
  misc_feature: Encodes the peptide sequence at SEQ ID NO. 94758
  misc_feature (781)..(781): n is a, c, t, g, unknown, or other
  misc_feature (782)..(782): n is a, c, t, g, unknown, or other
  misc_feature (823)..(823): n is a, c, t, g, unknown, or other
  misc_feature (824)..(824): n is a, c, t, g, unknown, or other
ctcctcggtggcggccgctctagaactagtggatcccccgggctgcaggaattcgtctcgcccctagaaaaagcgccccgtaaaccctagccgcgattcatggcccgcaagcgccgcgcgccttcgcctcctccgcctccgcaggaggagtcgtcctctgaggaatctggctccgaagagttggaggagcctcctcggcctccccgagctccgtagtcctccgcaggccgcggccaacaacgccgactcgtcggaggcggacacggactccgacaccgacgctcaagctttccagatgcgccaggtgccccgctccctcactaagcatacgcatccagttccccagccagaatccgatcccgaagaggaggagggcgagtcatcggagtcggagcacgacaaccctgtgcctgtggttcagaagaaggctgcggcggcggccgtgttgtccaaggcagagcaggaaaggaagagaccccgctcggatgctgctcctaccgggaaggcaaaatagatgaaggctgtggctacccctcttgccaaggcgaagaagggcaaggccgagctttagaagccggcgcctgagggccctccagctggaaaatggaaagaagggcaaagctgagctagagaagccgacctttgatgcccttccagcggggaaaggcaaacaagggcaaggccaagggaggcagctccctgaaggcccgcccctcaggcaaggggaaaaaaaggtgggggaccaaactagaggaagtcagccagcggcttagaccccgtnncatttaagaacaggcaaggccttaaataagcctgggtgggnncccccattgggggggaaaaggaggtttgaagatggatatttatttgggaagg

SEQ ID NO: 94758 - protein, 72 aa, Zea mays
  misc_feature: Ceres CLONE 1584692
MRQVPRSLTKHTHPVPQPESDPEEEEGESSESEHDNPVPVVQKKAAAAAVLSKAEQERKRPRSDAAPTGKAK

SEQ ID NO: 94759 - DNA, 856 bp, Zea mays
  misc_feature: Ceres CLONE 1584696
  misc_feature: Encodes the peptide sequence at SEQ ID NO. 94760
  misc_feature (494)..(494): n is a, c, t, g, unknown, or other
  misc_feature (495)..(495): n is a, c, t, g, unknown, or other
  misc_feature (501)..(501): n is a, c, t, g, unknown, or other
  misc_feature (502)..(502): n is a, c, t, g, unknown, or other
  misc_feature (505)..(505): n is a, c, t, g, unknown, or other
  misc_feature (522)..(522): n is a, c, t, g, unknown, or other
  misc_feature (523)..(523): n is a, c, t, g, unknown, or other
  misc_feature (535)..(535): n is a, c, t, g, unknown, or other
  misc_feature (539)..(539): n is a, c, t, g, unknown, or other
ctggagctccccgcggtggcggccgctctagaactagtggatcccccgggctgcaggaattcgtctcacccctagaaaaaattccgttcggatttcgcttttcccccgtggggtctcgactgcctgagggggaggaggacatggatttggcgtcggtcaacgaggagctggccgagatcgacgggcagatcggcgatatcctccgcgtattgcaaaatgggttccagaagctggagaagatcaaggatgccaaccgccgcagcaggcagcttgaagagcttacagataagatgcgagactgcaagaggttgctcaatgtcttattctcttccattccctctcagcactactatatatagcttttagcatcgcccccttcataaaacagagatggccgtaaggctaaacgcaggttatgctgatggaatgagtatataagttgcattgtggtgctggtgctgcttacctcacctatgccccggtttttgggaaannctcccnnctngcctcccgcttcttccnngacccctccccncccngtttccaaaaaaaaaaaactcccaacaaaaaaccccctgggaactggaaccctttttttaaaggaggacccgagccaaaaaaaatggctccctagcggctccctctctccgcgtcaaggggaaccggtttggccaaacgatttggttaaaaaaacccccggcccccttagaagggccccttcttggaagaaaacccggagcccggagtctttttttaaaagggccgggacccggggccaaaaagggcccaaaaactgccttgaagttgggtcccaaacaaacgggttcccggatctcttggaaaaatattatggcct

SEQ ID NO: 94760 - protein, 118 aa, Zea mays
  misc_feature: Ceres CLONE 1584696
GAPRGGGRSRTSGSPGLQEFVSPLEKIPFGFRFSPVGSRLPEGEEDMDLASVNEELAEIDGQIGDILRVLQNGFQKLEKIKDANRRSRQLEELTDKMRDCKRLLNVLFSSIPSQHYYI

SEQ ID NO: 94761 - DNA, 847 bp, Zea mays
  misc_feature: Ceres CLONE 1584697
  misc_feature: Encodes the peptide sequence at SEQ ID NO. 94762
ggagctccccgcggtggcggccgctctagaactagtggatcccccgggctgcaggaattcgtctcacccctagaaaaaacgaagccgagatcgagcagctacctctccgatccgaggactgagcgagcgagctgaggactgcagcctatataatatctagactatagtacaccacaacgacgaggcacatatatatacacgcggcggcggccagatccatcttggtatacacgtaatatatatacacgcacgatgggcagcgccggcggcggtggcgagagcaagctggagagcccgctgctgggcgcgtcgtctacgggccacggcgaggcggtggtgagcgggcagctggagagcatcctgggcgacgcgtccgtgccgtgggggacgcagatggcgtcagcgtccgcggtggacatgcagctgctggtgcgcctggccgcgcccgccgtgctcgtgtacatgatcaactacctcatgtccatgtccacgcagatcttctcgggccacctcggtacgatcgagctcgccgccgcctcgctcggcaacaccggcatccaggtcttcgcctacggcctcatgctgggcatggggagcgcgctggagacactgtgcgggcatgcgtacggggcgcacaagtacgacatgctgggaatctacctgcagcgatccaccgtcctgctgatggccactggtagggcacctggcgagcgttataccacttgctccgcccccgtcctgctcctgctggggggagtccccccgagaatcaagtccgaccgccgcccatcttcgtgttacggccttgatcccggcaaaatcttcgccttacagccggcaactttca

SEQ ID NO: 94762 - protein, 198 aa, Zea mays
  misc_feature: Ceres CLONE 1584697
  misc_feature (65)..(198): Pfam Name: MatE Pfam Description: MatE
MGSAGGGGESKLESPLLGASSTGHGEAVVSGQLESILGDASVPWGTQMASASAVDMQLLVRLAAPAVLVYMINYLMSMSTQIFSGHLGTIELAAASLGNTGIQVFAYGLMLGMGSALETLCGHAYGAHKYDMLGIYLQRSTVLLMATGRAPGERYTTCSAPVLLLLGGVPPRIKSDRRPSSCYGLDPGKIFALQPATF

SEQ ID NO: 94763 - DNA, 1053 bp, Zea mays
  misc_feature: Ceres CLONE 1584698
  misc_feature: Encodes the peptide sequence at SEQ ID NO. 94764
  misc_feature (76)..(76): n is a, c, t, g, unknown, or other
  misc_feature (557)..(557): n is a, c, t, g, unknown, or other
tttgtttttttttttttcgtcgcgtgggtggtgctggtggtgcccattcccccccggcgcccgcaactgggggtgnaaaaatataacgccccgcggtggcggccgctctagaactagtggatcccccgggctgcaggaattcgtctcacccctagaaaaattccgttcggatttcgcttttcccccgtggggtctcgactgcctgagggggaggaggacatggatttggcgtcggtcaacgaggagctggccgagatcgacgggcagatcggcgatatcctccgcgtattgcaaaatgggttccagaagctggagaagatcaaggatgccaaccgccgcagcaggcagcttgaagagcttacagataagatgcgagactgcaagaggttgctcaatgtcttattctcttccattccctctcagcactactatatatagcttttagcatcgcccccttcataaaacagagatggccgtaaggctaaacgcaagttatgctgatggaatgagtatataagttgcattgtggtgctggtgctgcttacctcacactaatngccccggttttggggagggccccaataggaaacatttcaagtttattggtgttgactggattgggtgaaaacaaatatccttggggaccctgggaaaatttacggggttctcccggggaaagggggaaaattcccttggttggggcataaagtgtggtcttcaaaacacacgggccctcttgtggagggaaagatttccagcccccataaacccctcgtgtttgggcgccaagatcaaccggatttggatgtggtggggtgaaactacgatttaatgtggggaaactctggcccccaaaagtgaacgagaaatctatacacctgggggaacactcacggcgcaaaataaacgtgcttaaacaagcggcgataaatgaatttattcctggcagccccttctgcggaaaggaaaacctcccgagcgcgcgtacggggatactgtccacaatttctcaacgggcgcgttgataaaaggctcctcccgtggccctaggtt

SEQ ID NO: 94764 - protein, 72 aa, Zea mays
  misc_feature: Ceres CLONE 1584698
MDLASVNEELAEIDGQIGDILRVLQNGFQKLEKIKDANRRSRQLEELTDKMRDCKRLLNVLFSSIPSQHYYI

SEQ ID NO: 94765 - DNA, 870 bp, Zea mays
  misc_feature: Ceres CLONE 1584699
  misc_feature (1)..(1): n is a, c, t, g, unknown, or other
  misc_feature (11)..(11): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (59)..(59): n is a, c, t, g, unknown, or other
  misc_feature (61)..(61): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (708)..(708): n is a, c, t, g, unknown, or other
  misc_feature (757)..(757): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (803)..(803): n is a, c, t, g, unknown, or other
ngggggggggnttttttgnngngtgnnnnnnnnnnnnggnnnntnnntnnnncnnnttntnttnnnnnngggccnnnnngaacaagctggaactccccgcggtggcggccgctctagaactagtggatcccccgggctgcaggaattcgtctcacccctagaaaaaacccctcctcattgcccccctctcacacacgcacacacactctctctctccccattgtgtcactgtaactagcaattgagctcttaaaattttggttgaggtgcagtagcaaggcacactactacgatctacaaacaagatgatcagttgatgcccggtgtcttcaggatcttttcaagttcgcgaagtcccattttgcttctcccccccgggctttgcaatttgcgttttgagtggcacctccggaagctttggggtggggcccctcccgccgggggtacttaaaaccccccccccccccgttccacaggggggttgggaactcccctccctaaagggggggccccccccgggggggggggcccccccccccaaaaaaaaaacagcccccccgcggctnnntttgtggaaaaaatatttatttcccccccccccccctccttttttnnnaaaaaaaaaaaaaaaaagcggcccccccccccccccnnnnnaaaaaaaaaagaggaggggcccccccagaaaaaaaaaaaaattattttttnaccccccccccgggggggggggttttttttttttgggggaggggggggnttttttttttttttcttcttcctgggtgggggggggnnnnaaaaantaaaaaaaaccccccccccccccaggaagaaaaataatatataaatttatatcggcccccccccgcc

SEQ ID NO: 94766 - DNA, 792 bp, Zea mays
  misc_feature: Ceres CLONE 1584700
  misc_feature: Translation starting site: 117
  misc_feature: SWISSPROT Homolog: EC 3.6.4.3 Microtubule-severing ATPase
  misc_feature (388)..(388): n is a, c, t, g, unknown, or other
  misc_feature (494)..(494): n is a, c, t, g, unknown, or other
  misc_feature (618)..(618): n is a, c, t, g, unknown, or other
  misc_feature (704)..(704): n is a, c, t, g, unknown, or other
ctggagctccccgcggtggcggccgctctagaactagtggatcccccgggctgcaggaattcgtctcacccctagaaaaacaagaggtcaatctagtgcaaggaagtcctcccaagatggagcctgggcacgtggttcatcaaggactggaacacctagtcgaagcgcaaaacctaatgggattaaaggaggtgctgttaaatcaactgcctctaacagttctgtaaggaaagggaaacaaagttcaagcaaggctgattcaacgagtagtgatgctgaggaaggtaagtccaagaagggtcagtatgaagggccagatatggacttagctgcaatgcttgaaagggatgttctggattctactccaggagtaagaatgggatgatgnttgccggacttagtgaggccaaacgactcctcgagggaagcagttgttcttcctctctggatgcctgaatattttcagggtattcgtcgaccttggaaaggagttncttatgtttggtccaccagcacgggaaagactcttttggcaaagcagtggctaccgaatgtggaacaacattcttttatgtttcctctgcacactagcctctaatggcgtggcgagaatgagcncatgggcccgtggtttatttgatcttgcgagggcctatggctccaggacaattttcttgatgaaaaatgacccctatgcacattcncgcggtgcctctggcgaacataatcgtcaaaaaaaaggggaaggaatcctgactcatggccaaatgtatgtgttacattaactcccca

SEQ ID NO: 94767 - DNA, 841 bp, Zea mays
  misc_feature: Ceres CLONE 1584702
  misc_feature: Translation starting site: 345
  misc_feature: SWISSPROT Homolog: EC 1.3.1.34 2,4-dienoyl-CoA reductase (NADPH)
  misc_feature (646)..(646): n is a, c, t, g, unknown, or other
  misc_feature (700)..(700): n is a, c, t, g, unknown, or other
  misc_feature (751)..(751): n is a, c, t, g, unknown, or other
  misc_feature (784)..(784): n is a, c, t, g, unknown, or other
ctggagctccccgcggtggcggccgctctagaactagtggatcccccgggctgcaggaattcgtctcacccctagaaaaaaccgtacctccggcgcctccgactccggtcctccggcctgcgcaggctagctagctctatttaggtccaccgtgcccccgccgcgcaggcaggggagatccaagggtccgagcagaaggccgccggcggcgagccagccagccagctaaagcgatccatatatacatatatactatcgagcaacacgtaaggaaggaaggaagaaagaagccaagcccaccagggccagggaagagagcatagctaaggaaggaaggaaggaagatgatgagcaaggaggcagtggtgaacgcgttcctgggctgcttcatgcacgtggggctggcgctggtgctcgccgtctacctccccgtggcctttgtgtgccgcctcctccaccgcctcctcgtccgccccttcgccaggggcgaggacctccgcggcaaggtcatcctcgtcaccggcgcgtcctccggcatcggcgagcacctggtgtacgagtacgcgaggcacggcgcgtgcgtggcgctggtggcgcgcacggaaggtggcgctgcgcgccgtggccaaggcggcgcgcgacctgngcgcccccgacgtgctggtcgtgccggccgacgtcaccaaggtcgacgacgccnagcgcgccgtcgaggagaccgtcgcgcacttcggcaaactgaatcactggntggccaacgccggggatctgggtcagctgcttnctttgaagagatcaccaacataaacggccttccataatgggtattgatctcaacctg

SEQ ID NO: 94768 - DNA, 879 bp, Zea mays
  misc_feature: Ceres CLONE 1584703
  misc_feature: Encodes the peptide sequence at SEQ ID NO. 94769
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
gaaagctggagctccccgcggtggcggccgctctagaactagtggatcccccgggctgcaggaattcgtctcacccctagaaaaaatccatgccccgcagccccggcccctaccttttccttccgcttccctcccacccaccccacaccgcaagcccaaacaaaacgcaacgcgaaccagccacacgaatccaccagcgcacgcgcaccgtcacgcgaggggcccttctcgccccgtccggacccccgcccgtcgccgtctctcccgtcgcgcgcgccacgcgaacggcacctaggcgaagcggcgcacgatgaggccgggcgggccgccgaactcgcgggcgctgcagccgccgggcacgccggggcggtcgcgccggcgcccggacctcaccctgccgctgccgcagcgggatctgacctccctcgccgtgcctctgcccctccctcccccgccgtcgtcggggtcgctgtcggcgccggcgtcgctcggcgcgccgaacccgccgacctcggccggcgccgcgccgccgaacccgccgccgctgtgcgagctggagcgcgtgcggcgcgtcgggagcggcgcgggcgggacggtgtggatggtgcgccaccgccccacgggccgcgcctacgcgctcaaggtgctctacggcaaccacgagacggcggcataggaatgctccaccaacggggtcgagaaggacacggagagcatggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 94769 - protein, 121 aa, Zea mays
  misc_feature: Ceres CLONE 1584703
  misc_feature: SWISSPROT Homolog: EC 2.7.12.2 Mitogen-activated protein kinase kinase
MRPGGPPNSRALQPPGTPGRSRRRPDLTLPLPQRDLTSLAVPLPLPPPPSSGSLSAPASLGAPNPPTSAGAAPPNPPPLCELERVRRVGSGAGGTVWMVRHRPTGRAYALKVLYGNHETAA

SEQ ID NO: 94770 - DNA, 862 bp, Zea mays
  misc_feature: Ceres CLONE 1584704
  misc_feature (544)..(544): n is a, c, t, g, unknown, or other
  misc_feature (582)..(582): n is a, c, t, g, unknown, or other
ctggagctccccgcggtggcggccgctctagaactagtggatcccccgggctgcaggaattcgtctcacccctagaaaaaattatttcttccttccgctcgcttcgcttccttcctcgctgctaccccacgaaaattctcgaatcccccccgaacccaagggcggcagaggagtcgtgctccggtgacgggcttggtttcgttcgcttccctctcgcagtctcgctgctgattcgccgccctgttcgcttgtttctcatgttcggaacgcggttactctctgtgggtttcgtcgtcttctgtgctgttttttttcgtgggagatcggtggcattttagtggcggaacctggggcttctcgcacgaatcgtttgcagcggggcgcaagtgctcttgagatggaagttgaattgcatctgttgataatttctatcccatcctcccctttttgggagagattgggggtgcattcggaccatttccttcgtcttttgcagtatgttattttgcgttagccctatgattggttcaattgcataccctantgttgatacactattttcatctggattttttgtgctanttttgagggtgaacatcatggtcaattttgcgtatacttcacatatagtccaatctgtgtatatagtactccgaccaagtcttgtacaagtgcaattctccatgcacctaatctcttagtcaatgttgcaacttgttttggacctataacttcagagccctgggtcttttactttcaacattttctagctccataatggcttcttggctgtgcccgctgctgaaactgtacctaaattcacatccggtaattttttgaacgcttggtggggaattgaaaa

SEQ ID NO: 94771 - DNA, 996 bp, Zea mays
  misc_feature: Ceres CLONE 1584705
  misc_feature (388)..(388): n is a, c, t, g, unknown, or other
  misc_feature (392)..(392): n is a, c, t, g, unknown, or other
  misc_feature (721)..(721): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (911)..(911): n is a, c, t, g, unknown, or other
  misc_feature (914)..(914): n is a, c, t, g, unknown, or other
ctggagctccccgcggtggcggccgctctagaactagtggatcccccgggctgcaggaattcgtctcacccctagaaaaaaaccttgctcgacccttgcccgccgcctgaactcgcctcccccgcggccggtcccctgcatctgttcgccgcgccgcaacccggaggagactacgactacgagcaccaccaggtagcagcaactgttttgctgcaatctgacaaagtggagggtttaagagtcgctgcttcttttatgtctgaacaatctttgctttatttgggattgctgggagagtattcttgcgcgacgaggaaaggcacaagtttctgctccactgcatgcatcaagagcccatccggtttccttgttctgaggtgttcattcnctantgctcagaagcccggttggtttttctcgaagatcagcagccacttcttgatttccggacctttgtcacacctgagaaggcatctagttaatacacccttttatcccagaatggcacttgcaaaacaattgggtgccttccaaacaggggaatgatggcccttccacccgggaaccaaaatgcccccggattgatttaccagaaaataaaaaagggccgggggggaaaagggaattccaaaaaaaaaaattttggtggaaacactggtttggaacttatcccaaaaagacccttttgtccggggccttgccttttcccttttaaaaccancaaaaattttttttgagaaggtgaggccactctgtgggcccccaccccccacaaatttatannnnnnnnttttgagaaaatagggggttttcctttgtttaaaggggggctcctgaaatttttctcaaaggggggggggggccccctggggggtttccttccaaaagtattttccccccgggggtttttnttngggggggggggggggggaacttgggatcccggcgagaaattttttatttaaaaaagaaaaaaagaggttcccggggagggag

SEQ ID NO: 94772 - DNA, 1169 bp, Zea mays
  misc_feature: Ceres CLONE 1584710
  misc_feature: Translation starting site: 231
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (1112)..(1112): n is a, c, t, g, unknown, or other
gagggataggttgcgctagtagagtgaggcagcgaacatcatttgagttgtggttgttgaggacgacnnnncaaagctggagctccccgcggtggcggccgctctagaatagtggatcccccgggctgcaggaattcgtctcacccctagaaaaaagagagtcatcgcggcgtgttcaaatcccacaatcttcttgtagcacaccactgtcttcgtccaactcggcggcgatgtctgggcgcggcaagggcggcaaggggctgggcaagggtggtgcgaaacgccaccgtaaggttctccgcgacaacatccagggtatcacgaagccggcaatcccgacgctggcgaggaggggcggcgtgaagcgtatctccgggcttatctacgaggagacccgcggcgtgctcaagatcttcctcgagaatgtcatccgacgacgcggtcacatacaccgagcacgatcgccgcaacaccctcaccgccatggatgttgtgtacgccctcaagcgcccggggccgcactctggaccgggttccggtggttgaacgcaatctcttcccttcgtctgcagccggctggccggggggcggtttcccccatttccctcctggccttggcttggggccttgaaggtaggagaagtttttcccgaattaaaaaaaagtcctcctggaaggtggcattcccttttaattggggggtgggaaaataacatgctggttcccccaaagccaaagggtctttggggtaaaaaattccggaaggaaattcggagggaatgggggaacttccttctttccctatagtgggcccccgcgataactgggaaacaaattggtgcgttccttgtgcgccaccacacggtggagagaacctctccgcgtttccaccccctcacggggacaagacagtgagatagtttttcaccacttccacctttttctcgtgcgcctccttcccacaaagagagtttgtgggggggagtttcgtctcggtggttcgccggtggaccccgacaccaaaaactcccccgggtgaggcttcagaggctcttttcttgcgtgtggtcttttgttgacgcggggaaaaaagacacgtggtccgagcccgncaaaggaattttttttggtgaaaaaagagctcccccagggcggaacaaattcttttg

SEQ ID NO: 94773 - DNA, 782 bp, Zea mays
  misc_feature: Ceres CLONE 1584716
  misc_feature: Encodes the peptide sequence at SEQ ID NO. 94774
agctctccgcggtggcggccgctctagaactagtggatcccccgggctgcaggaattcgtctcacccctagaaaaaacggtggggtcgcggagcttgccagctttgtggctgcaactcgccagcctgatggggcggcttcgcgcgtgctgccgtctccaccgcttcctcgcgccgccgccggcacaagtgccatcaccgggacaatctctggcccgcgggtccaacaccgctaccgctcacgtagcgcctttctcgaggcttctctcgtcggccgcggccgttgcgccccacgacacacgcgactcgggcctcggcggttcggcgtactgggcctggattcgcgcggcgaccgagtcggccccggctccttcgccgccccaggaggaggaggacgagggcccagcacgctacatccccgtcaaagcctacttcctctccaccagcattgatctgaagagcatgcaagcggagcacgggaatgatattgtacctccgtcgacccgtttgcttaactacattgcgcttcggtactccgagttcccacctgagattatgaacattggagtgaaggataacagattttgctatcgctatgtggttgttttccagtatggttctgctgtgcttttcaacattgctgatcatgaagccgagtactatcttgatataattaggaagcatgcttcaggatggcttccagagatgagaaaagatgattatgcagtggttgaagaaacatccttgacacatggatgaaaggaggacttgattatatagttct

SEQ ID NO: 94774 - protein, 209 aa, Zea mays
  misc_feature: Ceres CLONE 1584716
MGRLRACCRLHRFLAPPPAQVPSPGQSLARGSNTATAHVAPFSRLLSSAAAVAPHDTRDSGLGGSAYWAWIRAATESAPAPSPPQEEEDEGPARYIPVKAYFLSTSIDLKSMQAEHGNDIVPPSTRLLNYIALRYSEFPPEIMNIGVKDNRFCYRYVVVFQYGSAVLFNIADHEAEYYLDIIRKHASGWLPEMRKDDYAVVEETSLTHG

SEQ ID NO: 94775 - DNA, 859 bp, Zea mays
  misc_feature: Ceres CLONE 1584717
  misc_feature: Encodes the peptide sequence at SEQ ID NO. 94776
ctccccgcggtggcggccgctctagaactagtggatcccccgggctgcaggaattcgtctcacccctagaaaaagcgccgccgcctactccagcctccagcgtgatctgagtcctgaccaagccctaaacgccaccgccctcgcaaatctcctttcccttcgatccatggccgccgccgtcgccgcccccgcgccatcccgcaagacggagacctacaccgacaccaagcgccgcgacgacgtgcgcggcgccaacatcgccgctgcgcgcgccgtcgccgacgccgtgcgcacctcgctgggcccccgtggcatggataagatgatcgcttcgggcgaccaggctcaggaggtcatcatcaccaacgacggtgccaccatcctttcccgcatggcgctcctccagcccgccgcgcgcatgctcgccgagctatcccgctcccaggacgccgccgctggggacggcaccactaccgtcgtcgtcctcgctgggatcctcctccgccgcgcccagtcgctcctctccgccggggctcacccaacgccgctgccgaacgcctccaccgtctcggcacgcgcgctggttagatcctccccgcaggggcatccccatcgagctatccgaccgggaaatccccctcaaggtctgcgtccacgggtctcaactccaaagggcggctcccaggactcccacccttttttcgcccctgggccgtcaaaacccccccctttctggtggggaacccccctcaccccggacctttctcgaactccggggaatatccgcatgggggaaaaaaactgggggggcccgcgggaacaaaaacgggggctcctccccggggccccatccttggaa

SEQ ID NO: 94776 - protein, 231 aa, Zea mays
  misc_feature: Ceres CLONE 1584717
MAAAVAAPAPSRKTETYTDTKRRDDVRGANIAAARAVADAVRTSLGPRGMDKMIASGDQAQEVIITNDGATILSRMALLQPAARMLAELSRSQDAAAGDGTTTVVVLAGILLRRAQSLLSAGAHPTPLPNASTVSARALVRSSPQGHPHRAIRPGNPPQGLRPRVSTPKGGSQDSHPFFAPGPSKPPPFWWGTPLTPDLSRTPGNIRMGEKNWGGPREQKRGLLPGAPSLE

SEQ ID NO: 94777 - DNA, 866 bp, Zea mays
  misc_feature: Ceres CLONE 1584719
  misc_feature: Encodes the peptide sequence at SEQ ID NO. 94778
ctggagctccccgcggtggcggccgctctagaactagtggatcccccgggctgcaggaattcgtctcacccctagaaaaagccgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacaacggcgacgatgacagcggcggcttcggtgtaggcctgggcagcactggtggcggtggccgcatcggcggcggaggactcggcttctcgtcctctggcggtggtgggcacgggggcttctatcccacaattatcttctgagagcagcgcacctcagtactcctctttatgtgggatatcagggttacagcaaaaagattgaaaatccaaaatggaaggggttgggggttttcctttggaaaaaggcgggggaaactatttagggtatttcccaactttcaatcagggagcaaaggattccagagtccccaagaagaccctgtgaagcttggaaaccgggggggccccgtaacaggggaaggttttggagctttttttggggaaaaacccgtgggggcggaaattaagacaagaggctggaaaacccgtgtgggtccaaaaagaaaatttttcggggggaaaaagggccccaaatgtttctgtgggag

SEQ ID NO: 94778 - protein, 123 aa, Zea mays
  misc_feature: Ceres CLONE 1584719
MADDHYSSKRKYDDPSPPPRRTGFSSGPPPASPLAGGAPSYNSVPPPPDEIQLAKQRAQEIAARIFNAAEAKRPRVDNGDDDSGGFGVGLGSTGGGGRIGGGGLGFSSSGGGGHGGFYPTIIF

SEQ ID NO: 94779 - DNA, 829 bp, Zea mays
  misc_feature: Ceres CLONE 1584720
ctccccgcggtggcggccgctctagaactagtggatcccccgggctgcaggaattcgtctcacccctagaaaaaatttaaccctggaccgccctgcctactaggctgtggactcctactcctactcctactcctactcctactctctccccttcctcccgttgattgattgaggggattgctactaggcgggcgctagcactgcgaagcatctcgcctcatcgtctcctccgtgctccacttgcccattcttacgcgctaagcaacaggccagccggccgtagctccaaagcgggagccggagccggagccgggagctaaggggggccgtgatgtcgtcgtcgccgacggccgcgccggcgccgaccacgccatcggctccgccggccaacgcgacaaatccgccgcccgcgaccccgtccgcgccgccaccggcggcgcccacgcctcccacgcccaccccgcccacgccgtccccgccgtccccagccgcgccgccgccgtcacccccctccgtcccggcccccgcgccgtcctccaccccggcgaactcctctgcgccctcgccctcctccctttctccccgagaacgccccgcaccccgtcgccgccatcggacaccccgtcgccgccgtcttccgggggaagggggaagtcccccccctcttctgggggcgggcgatacaaggcgtcctcccattgggctccaagtgaatttggcgggggggggggggggggggggaatccccgggccgtctacatccctttgtcggggggggggcccttggggggccccaatttttggtgtgttccccacttttatttgccct

SEQ ID NO: 94780 - DNA, 830 bp, Zea mays
  misc_feature: Ceres CLONE 1584722
  misc_feature: Encodes the peptide sequence at SEQ ID NO. 94781
ctccccgcggtggcggccgctctagaactagtggatcccccgggctgcaggaattcgtctcacccctagaaaaagtgctcgggcactttctttttccttcccccctgtgcgctcggccgcctccgccgctgcctcgctccctccgcgcccaccacggaggcgcacgcgcgggcgcagcgtccctcgcgtgcctcgccttccgcactgctctgtccgcccgcctggctcctgcctcctcctcctcctcctcctctagggttagggcacgcgtcgcgggggcccgtggtgcccggcgcaatgcggaggccgtcgggggccggcgtgccgagccgccgccgccgcgcgatccaggtgctcgtggcggtctccctcgcctacgcggtcgccgtgctgctcctcgagtcgcccctcgtgtccacgtcgctgcccggggcgggggcgtccgccgcggcgtcgcggaagctccacctcgactgcgcgtgggaaggcgcgggacgagcagcgccggcgcgccccgcgaagcacccgcacaggtagaccctctcggcggacgcggggcggggacgggcgcgccagttggcagggatcgtctctggactcgagctccgccacctcaactccacccgctccggctcgatccgtaaggtcgccacggatgccgccgagtcaagagcccgcgtgttctccgacctgtaggctctagcgacggccttgactttctcgggcgattcatcaggggatgaggatgcacaaagccagtgcccgcactcggatcgtcctcagcggcgaaccaattccgggaaagggggccgggccgttggacctaccct

SEQ ID NO: 94781 - protein, 79 aa, Zea mays
  misc_feature: Ceres CLONE 1584722
MRRPSGAGVPSRRRRAIQVLVAVSLAYAVAVLLLESPLVSTSLPGAGASAAASRKLHLDCAWEGAGRAAPARPAKHPHR

SEQ ID NO: 94782 - DNA, 941 bp, Zea mays
  misc_feature: Ceres CLONE 1584724
  misc_feature: Encodes the peptide sequence at SEQ ID NO. 94783
  misc_feature (400)..(400): n is a, c, t, g, unknown, or other
ctccccgcggtggcggccgctctagaactagtggatcccccgggctgcaggaattcgtctcacccctagaaaaactgtcataacgctagcttcccaacgtcgtgcggatcctctctttcacaccgccttcttacagtattcgtcaccctcccctcttccccatcgcgaactctctagagaaccacgtagacgagggagaaggagatggcgaataagaaggagaaggcggtgaacgtgtctggcaagccgcggcactcgtacgacgtctgccgcccctatgaccagaagggcgcgggcggcggcgcccgtggacggagccggtccgccgctgccgagcggcggctctagatgtaaaagatggccggcgagagggaccgctcctggaaggtggtgtggaacnacttttcactgtaaggagctccccgacgcccgcatcgagcccgaccgccggtgggtcggccatactccacgtttgtgggccagcccccagcttgggaatggtccggggggggaaacccgggagtggggcttttccgacaactttccagtgtcgatccctggaaagaaaacggaaagctgaccaactttccgggtccccggaaagaatccgtcgaaaacccaaggccgaaaggggaacaaacttgctcttggaagcttgaaaccctttttttgagccatggcctttttggggggcccaaagggggggtgaaagggtaaaacagcccagaaaaactaaacgggcgtggggggaacttcacaaattcatccggccgggaaaaagagggctgaatgtatttcccctggggatggttcttttgaaacacaaaaagggttggctcctgccttccacaaatttggacaaggggtgaggcaaagattaataatttggcggtaaacggtgttacttatcgcggggggccatagaggtggtttgagaggga

SEQ ID NO: 94783 - protein, 47 aa, Zea mays
  misc_feature: Ceres CLONE 1584724
MANKKEKAVNVSGKPRHSYDVCRPYDQKGAGGGARGRSRSAAAERRL

SEQ ID NO: 94784 - DNA, 926 bp, Zea mays
  misc_feature: Ceres CLONE 1584725
  misc_feature: Encodes the peptide sequence at SEQ ID NO. 94785
  misc_feature (522)..(522): n is a, c, t, g, unknown, or other
ctccccgcggtggcggccgctctagaactagtggatcccccgggctgcaggaattcgtctcacccctagaaaaagctcttgtcttcggaagtttcagatcctcgcatcgtccgcaccttatcctctcgactttacagtacctgctctcagctcctccctatctcaatggcatccgcgaatgccatctccaccgcctccctcctccggcccctctctcagggcagggcgacgaggtcacagcggttcgtggtgcgtgcgaacgccaaagacattgcctttgaccagaaatccagggcagcgctgcaggccggcgtcgagaagctggcaaacgccgtcggtgtcaccctcgggccacgagggaggaatgtggtgctcgatgagtacggcaacccccaaagtgtgaatgatggagtcactattgcccgtgctattgagctgtatgatccaatggaaaaatgctgtgcagcattgattcgtgagggtgctagcaagaccaatgattcagctggtggatgggactancactgcattccgtcttgctcgtgaaatcatcaagctagcccttctgaatggaacatctgggggcaaatcctggttcccttaagaaagggaatgaacaaaattggtccagggccttaattcggggactttggaaaaaactttaaaccctccaggggtgggggggaaaaaaaaagggtgttgactttttcttggggggaaaagaaaaatttttccgaaaccccgtttgttaaacaatattaaaaaagggggcccgaggggggtttaaaaaaaaaaaccccccccccttttaacaacccttttaaatttaaaaaagaggggaatctccccccttttttctccccccttttggaacaccccagaaaaaatgtggggggttaaaaaaaaagggctttttattcaaacaa

SEQ ID NO: 94785 - protein, 126 aa, Zea mays
  misc_feature: Ceres CLONE 1584725
  misc_feature (119)..(119): Xaa is any aa, unknown, or other
MASANAISTASLLRPLSQGRATRSQRFVVRANAKDIAFDQKSRAALQAGVEKLANAVGVTLGPRGRNVVLDEYGNPQSVNDGVTIARAIELYDPMEKCCAALIREGASKTNDSAGGWDXHCIPSCS

SEQ ID NO: 94786 - DNA, 802 bp, Zea mays
  misc_feature: Ceres CLONE 1584729
  misc_feature: Encodes the peptide sequence at SEQ ID NO. 94787
aaagctggagctccccgcggtggcggccgctctagaactagtggatcccccgggctgcaggaattcgtctcacccctagaaaaaaacgggcagcctgtactgtccgcttctagctgcagctaccctccagtcccagttccagccccggccaggcgctcggaaagtgcggagccgccctctcttcgagtcttcgctcgtggtctctatctccaggtcgagcagtacgatccatatcccggagctcttgcgcaagcgaaatgtcctcggcggctggcggtggatacggggctgcgggcggcgccgagcaccaacacctgtatgctggggcaggcctcggggcagctctaccacgagccgcattcacagacgccgcgagaagctgcggttctcgcccgaggcggcccactctcccccgcccagtgcctgaggggagcctccaccattatactcctacgcgtgataatgaacgtcgtcctactcgccacatagcccaacgctggcgcacacgcagctagtggcgcacgcgctacctgccggcgacggggcccagatcccgaggaagaagtttgtgctctcgctctcttcggcgttctcgaaccctacgacctcgccgcggaggcagctctcctcgtgggtagccactaggacgtacggcccgttcatgggctacgggatcgtcctctggcggatcagattcctgggacccgcgcagaagctactccaggaaatctgcgacctgtccggacggccccctcacctgaacgggcgctcggacgaaacagggtatgctccacttggacgc

SEQ ID NO: 94787 - protein, 47 aa, Zea mays
  misc_feature: Ceres CLONE 1584729
MGYGIVLWRIRFLGPAQKLLQEICDLSGRPPHLNGRSDETGYAPLGR

SEQ ID NO: 94788 - DNA, 902 bp, Zea mays
  misc_feature: Ceres CLONE 1584732
  misc_feature: Encodes the peptide sequence at SEQ ID NO. 94789
  misc_feature (729)..(729): n is a, c, t, g, unknown, or other
  misc_feature (775)..(775): n is a, c, t, g, unknown, or other
  misc_feature (776)..(776): n is a, c, t, g, unknown, or other
cagagctggagctccccgcggtggcggccgctctagaactagtggatcccccgggctgcaggaattcgtctcacccctagaaaaaataggagcgagatccgcatgtccgccggcgagcgcacgcatcggcatcgcactgctagagccaccacgggccgaggcccgcatgccgccggcgatcgcacgcatcgggcatcgcattcgcagcgcgtccagccgtccacgtccccaagcgccgtcgcgccatcaccgtcccctccccacccgctctgccgttgcgctgttcccatcccgccgacccgctgcgccaccgccacgctcgccaatctccatccctaaccccaaccccggccggccagccccaccatcaccccacccccacccaccaacccaccacgcgacgcggctgtggcgtccctctaatctcgttcgcttccgctccacgccgcacccccggccgactgcctaacctcgtgttggccgcgatcccgctcccgcccagatctggtggcgccttcgccgctcgagcgcgtgccctcacgggtggagtgcaggcggccgctcggttcagccggctggccgatggtttcggccgcggcgcaggcgggtgtggtcgcggcgtgcgtcgtgctcttcgtccccatggggctggccggctggcacctcagccgcaacaaagtgcttttcttctccggcgcgctcttcatctcgcttgctgtcggggtccanctatccccgtacttccccctcctgccccactcggctccttctttcnntcttcccactccggggccgcggtcgcgtccgcgtcctcctcctcgggggtcttccggcgtcccgtttctgcaccgggggtcgtgggtctgacccgcccggcccgcggaacgacggctcgggaagct

SEQ ID NO: 94789 - protein, 94 aa, Zea mays
  misc_feature: Ceres CLONE 1584732
  misc_feature (49)..(49): Xaa is any aa, unknown, or other
  misc_feature (65)..(65): Xaa is any aa, unknown, or other
MVSAAAQAGVVAACVVLFVPMGLAGWHLSRNKVLFFSGALFISLAVGVXLSPYFPLLPHSAPSFXLPTPGPRSRPRPPPRGSSGVPFLHRGSWV

SEQ ID NO: 94790 - DNA, 942 bp, Zea mays
  misc_feature: Ceres CLONE 1584733
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (109)..(109): n is a, c, t, g, unknown, or other
cgggggggaggggaaggtgaagagaaaacgctcgcggagagtccatgccactcgggcggggttttgggggggnnnnnaaaaactggaactcacgtgagaggctgccgcnctcaaactagtggatgccccgggctgtttgcattcgtctcacccctagaaaaaagctcagctcagccaactgctggagtggtagcggttgcttcctctctcttctcacgtcaccatgatcgataagactagctagaatataggtggctggcagtggcagtggcagcgctatcctatatagtgccccccggccggtgtgctcgcctcgggagctagccttggaagaagaagcagagagcagagacaccgttgcgtagagggaggaggagtgcttcttcgttcgtcgttgcccaaagcagcagcagtcacttggaattggttttttttttgcgcccacccctcccggccggccggtcgacctctgtttgtagcggcggcaccaccagctctcaactgctcaagcaaaccaattaaagcagccagcagtctgtcacacacacaggcggaacccaaccggccaatgtattcttcgtcgcccgcctgggagaagcgcgtgagcagccaagagcaggagccactctttttgcaattgcaactgacgcaagaggtttcacaggtccggcgggtcatctggcaggacgccgcactggaatgggcgacgggcgggcctcctgggcgccttactccctggtcgtcaagcccggcagccccgggcacgggccggcctcgatcgccgctatctttgcttggcccgcccccccgtgtgggaagggaaaaaccggccccgcgggcgcacaagaaacgaacaccgacagaaaaggattcccgaggcacccggggcgaacccaagcacttccggcgcgaggggcacctaagaagggggtggccacaggc

SEQ ID NO: 94791 - DNA, 812 bp, Zea mays
  misc_feature: Ceres CLONE 1584735
  misc_feature: Translation starting site: 222
  misc_feature: SWISSPROT Homolog: EC 1.2.1.3 Aldehyde dehydrogenase (NAD(+))
tcaccgcggtggcggccgctctagaatagtggatcccccgggctgcaggaattcgtctcacccctagaaaaagcctcctctgactgccgcttctcctgctgcgggcgggcactgctggacgtcctagtggaggacatcggcttcctttactgcacctgcagaagatcggacgaactctcttgacaggcttcgattttcggcgggcgctatagatttcccgcatggctccgatgggcccgtcctccctcgtctcccgctgcctcctggcgagggcccctgccggcgcgccgcccgctgccccctctgcgcctcgcaagacagtgcctgctgatgggatgcacatgctgttgccaggtgtccttcagaggttcagcactgcaccagcggtataggagcccatcactccctccgtccatgtgaactacacaaagctcctcattaatgggaactttgttgattccgcatccggcaagaccttcccaactctggaccctcgtacaggggaggtgattgctcatgtggctgatggtgacgcataggacattaaccgtgcagaagctgcggctcgcaaggctttagatgaagggccatggccgaagatgactgcctatgagaggctccgtatcctactgcggtttgctgatttgatacacaaactcaatgtacgagcttgctgctttgtgagacatgcgacaacgggaagccatatgagcaagcaaaccatattgatgtacccttgggggccccgtctttatgccttactttgcctggttgggctgaaaaaatccctgggcctcaatggggccgggctg

SEQ ID NO: 94792 - DNA, 942 bp, Zea mays
  misc_feature: Ceres CLONE 1584736
  misc_feature (597)..(597): n is a, c, t, g, unknown, or other
aagctggagctcaccgcggtggcggccgctctagaactagtggatcccccgggctgcaggaattcgtctcacccctagaaaaaaacctcatcttctctccttttgctcggaacgcacacaccgccccggtctccgatctccgatccccgatcccctcgtcgatcccagatgcagatcttcgtcaagactctcactggaaagactttcaccctccaagtgggagtcttctgaccccattgacaactttcaggccaaattccggacaaaggaagggtttcccccggacaacagggggttaattttcctttggaaaaattttggggggggggcccccttttccaaaataaaattcccaaaggggaggaccctcccccccttttttccccccccggggggggggttgaaaaattttttttaaaaccccttttgggaaaaaattttcccccccccggggggggggtttttttagacccctctaaaaaaattgggggggcgaatattttgggaaagagggggggtgtttctcttatacaaaaaaagggttttttttttttttttgtgggaaattttttgggaggggggggccccctttttccnttttaaaaatttttaagaggggggggggcccccccccccccccggtgggggggttttcggggggggggggggggaatatttttctttaaaaaaatacaaggggggggaaaaaattacccttttgtgggggggggggtgttttttctcttctaaagaaaaagaggggcggggaatctcccccagggagggggggggttttttctctccccaaaaaagggttttttttttttttttttgcacccccggagggaggggggggttttttttttttttttttttttttgagagagagcggcccctctctctttttttttttttgtggggggggggagggggtattaaaaa

SEQ ID NO: 94793 - DNA, 1289 bp, Zea mays
  misc_feature: Ceres CLONE 1584737
  misc_feature: Translation starting site: 164
  misc_feature (29)..(29): n is a, c, t, g, unknown, or other
  misc_feature (58)..(58): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (66)..(66): n is a, c, t, g, unknown, or other
  misc_feature (1050)..(1050): n is a, c, t, g, unknown, or other
  misc_feature (1079)..(1079): n is a, c, t, g, unknown, or other
  misc_feature (1086)..(1086): n is a, c, t, g, unknown, or other
  misc_feature (1095)..(1095): n is a, c, t, g, unknown, or other
  misc_feature (1096)..(1096): n is a, c, t, g, unknown, or other
  misc_feature (1104)..(1104): n is a, c, t, g, unknown, or other
  misc_feature (1105)..(1105): n is a, c, t, g, unknown, or other
  misc_feature (1106)..(1106): n is a, c, t, g, unknown, or other
  misc_feature (1108)..(1108): n is a, c, t, g, unknown, or other
  misc_feature (1192)..(1192): n is a, c, t, g, unknown, or other
tttttttataaaataaaattcttgggtcncccccttttcctcatattgtttttttttntnnnnttnggcaaagctggactcacctcggtggcggccgctctataactagtggatccaccgggctgcatgaatgcgtctcacccctagaaaaagggttctagccatggcgtggagcgccgcctccgtctccaggttcgcagccgcctccccacccgcggcacccatctccgtcacgcttggagccgccgcttctcgctcgtcccgtgtccttctccagtgggcgccgacgccccgtggccgcgtccctctcgacctctgccaccgctgtaaaggaggctgttccgacagagaaggcaccaccagcaactaggcccttattctcaggccatcaaagcaaataatcttgtgtttgtttctggagatcttggcttgaaatccatagacccacaaatttatctctcaaattgttgaggagcacacccacctgggtatgaaaaacatggggcgagagattggaattctagtaggtgggtaacgtattctgggagtttgtgatgcagctactattcatatgttgctagatcctgaatagtatgttaattttacggaaaattgatggaactcagtgacaaaatttttttccacaggttgctcaggaaccattggcatggatctgaatccctttcccgaaggagggcgtgggatggccatggtccatcattgtaaatgttccactgtgttatcggagaagtactttgcacaaccggacaggactgtccgtgtgacgtcagtaacttttacactctggagcggatcgttgggtcccctattgtcgtgcagatctttcggttgagtaatacgtccctcgcattctctatatataatataccgaaaacaccgcacgcgcgggagaaggttactgacgtgtggggttaggaaaataggagctgacccccaaggtggtagcactatgggggctgtcgggttgcgttcgcgtagcattaaatgtacaatgtgttgtcgcgaggaagtagctgagagtgaccggancgtgtcgaaggggaccacgtcgcgaaganttgactngcgcctccnnaagggagnnnanagtgtgtggattcattctcgacgactgttaatatgaacattacagaacctgcaataagatgtacgaccacacaatatcttgaangtggataaatgagtagatgtgatatggatacgaaagagacatagacttggggtgagataggaaaactgaggcacggagcaatggggccgcggagggt

SEQ ID NO: 94794 - DNA, 991 bp, Zea mays
  misc_feature: Ceres CLONE 1584738
  misc_feature: Encodes the peptide sequence at SEQ ID NO. 94795
  misc_feature (920)..(920): n is a, c, t, g, unknown, or other
  misc_feature (941)..(941): n is a, c, t, g, unknown, or other
aaagctggagctccccgcggtggcggccgctctagaactagtggatcccccgggctgcaggaattcgtctcacccctagaaaaacacaaccatccgtcccgatcccgaccagctttgagatcgcgatggcggacggccgctgctgcaccttcctggagatcctcttcgccatcatcctcccgcccctcggcgtcttcctccgattcggctgctgcagaatagagttctgcatctgcctgctgctcacaatccttggctacgtccccggaatcatctacgcgatctatgtccttgttgctctcgactctgaccagcacgagagggaatactacacccttgcttagagcatctggttgtgccaggcgggcctgcacagttgagtcgaaatcagtattttttttctcatgtggattgtctgacatggcataagcggcaatggggtaccaaagtgttgttggtctatattctctgttacccaaacttgggagctctcctttatggtgctccaggttatccaatctgtaaattgggaaacttacaggagaaataagatggcccttgttttccttctaaaaaaaaaaaaaaaaaagggccgggaatcccaattttaacccatgattttcgggagcttttggggtaaaaaaatcccttttttaacccccctttcaaaaaaaaaaaatttttccaaaagcccgcctaagtttggggttttttttggcggggggaccaacggggaaacctcttggcactttgttccgggcttttggaggggggggggggggggggtaaaaaaaacccgcgggtgggttaaacaccccgcggggaaaaaatttttctttcgggcgcaacctgtaaagcaaaatatttttttttgggggggggtttttttttttttttaaaagaaaaatgtttttttttgncaaaaaaaatatcccggttgngaaaaaggggggggggaggaaaattattttggggggggtatttttgggag

SEQ ID NO: 94795 - protein, 72 aa, Zea mays; identical to SEQ ID NO: 51501
  misc_feature: Ceres CLONE 1584738
  misc_feature (7)..(58): Pfam Name: UPF0057 Pfam Description: Uncharacterized protein family UPF0057

SEQ ID NO: 94796 - DNA, 1262 bp, Zea mays
  misc_feature: Ceres CLONE 1584743
  misc_feature: Encodes the peptide sequence at SEQ ID NO. 94797
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (1033)..(1033): n is a, c, t, g, unknown, or other
atggttagtaggcgtggcgcgtttgggtcatttcataaagtgtggtcctctgaannnnnnnnnnnnnnnntaaaaactggaagctcccgcggtggcggccgctctagaactagtggatcccccgggctgcaggaattcgtctcacccctagaaaaagttccctttctcccattcgcacgccgccccgtgccgtcctcctcccagatctcgtggtctcgtggccgtcgccattcccccccgctccgctacacgccgagcgcaccgattgcaaatcagtcgtctccgctgctcctcgccctcgccccgcccgcggcgtggtgaggagaggagatcccccctgaggttgtacgagacggtgcttcaggaccgccctctggcgcggaggacgcataagctcggcggcggcggcggcgacatgaagggctcgaccatcccttcggtcgcgatcatgccctcgccgctcttcctctggcggtttaacgctgtgttgtttcttctatggggcttatgttgttgcaagataagttgggactcagttatgagaatgaggtgttgatctcagagaccctattttctttatgaaggctttcttggtcctataattcctcctttcttccttggagggcttggaaagaattgcggttggtggggggagttaaaaacctattggcggttctttttgccaccggtatcctccttggggggaatttattgtcaaaagaggacggtctggaaattcgtttgctcccccataactaaccaattgttgattcccccctcatccgagcgagaagggaataaactcggaaagtgatccccccgcctttattacgctgcgggaggattattgacaccgtcgatgtatataatgggggtgtccccccccgcattttaaaggtcacattatactaacacgccccccatttacatcttaatgtagccacggcgggagtacgtacaccacgttttgttcaaaagaaaagacgcgtcccccacattttgggctagagcgatgtcttgatacggcgcaggngggggtatgtacagtccccccagaccgccattattatgagcgggtgaatatattctccactgtcgacgccaactttcttgggagcccctcacccggtttgatgtgggcaaggagaggctatcggtgggaagacacgctctggggtgtatcgtcgctcatacgaggtttgtctgaaaatgtgaggtgtgatgttaagtgagtgtttcagacatggaggcgccgtgaacgt

SEQ ID NO: 94797 - protein, 46 aa, Zea mays
  misc_feature: Ceres CLONE 1584743
MKGSTIPSVAIMPSPLFLWRFNAVLFLLWGLCCCKISWDSVMRMRC

SEQ ID NO: 94798 - DNA, 803 bp, Zea mays
  misc_feature: Ceres CLONE 1584744
  misc_feature: Encodes the peptide sequence at SEQ ID NO. 94799
aagctggagctcaccgcggtggcggccgctctagaactagtggatcccccgggctgcaggaattcgtctcacccctagaaaaaatcgcaagcgcgaggtgagtccgcagcccgagctcccgcgctccttcctcgcctccccctctaattagaggctcctccgcgctctcggcgggggtttagctgccgtggcctgaggatttgtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcccacccaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtggtagcagctggtgctaatcctgttcagattactcgtggtattgagaaaacagctaaagcactagttgaagaactacggaagttgtctaaggaggttgaagatagtgagcttgcagatgttgctgcagttagtgctggcaacaactatgaaattggtaacctgatagcagagg

SEQ ID NO: 94799 - protein, 197 aa, Zea mays
  misc_feature: Ceres CLONE 1584744
MASTFGATSTVGLMAAPTGKNVRLQRRANFRVKAAKELYFNKDGSAIKKLQTGVNKLADLVGVTLPPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKEVEDSELADVAAVSAGNNYEIGNLIAE

SEQ ID NO: 94800 - DNA, 815 bp, Zea mays
  misc_feature: Ceres CLONE 1584746
  misc_feature: Encodes the peptide sequence at SEQ ID NO. 94801
ggagctccccgcggtggcggccgctctagaactagtggatcccccgggctgcaggaattcgtctcacccctagaaaaagctgtctaccctcaccaactcctacctcccgagacaaattccgaggtcgacacaagaaaagggaaagaaccacaggtaattgccttcctgtgtcgggattgtagctccaatccactccgcgccggccgggtgcgctgccatccggatcagacgccctcgcatctctcgcccttccggcatcgtatcccctgggcggcagcggagtaaagatccgacccgcttgggattgtttgcttctcctttttgcggtgcgccgctggactccagtgctgcacatgctcgacgacggtgctgagctcctgcaatggcccgaagatatgccggcgcaatgcagcgggagggttccgcggggtcggttaaggactggtcggaaatcgacccttcgccgtctcccaagctggcgtactcgcagtcctacgtcgccatgagaaggctgttgacgtcggtggcttctctgggacctggtcctgacgtccagcaacctcaaagtctctgttgggcagccttggccttcgcacaaggcacccctccggtcccttggaaaaggcccaaaagttcaaggggggatgaaacctggaaaaaaaggcccctgggttcccacccctgcctttgggggggcctttcctaaaaaagaggaaggtttttcccctttggggatttaaaaacaaccctttctttttttcccccctcggggttttttttcccccccgaaaaaaacaaaaaaaatatttccgaac

SEQ ID NO: 94801 - protein, 107 aa, Zea mays
  misc_feature: Ceres CLONE 1584746
MARRYAGAMQREGSAGSVKDWSEIDPSPSPKLAYSQSYVAMRRLLTSVASLGPGPDVQQPQSLCWAALAFAQGTPPVPWKRPKSSRGDETWKKRPLGSHPCLWGGLS

SEQ ID NO: 94802 - DNA, 1274 bp, Zea mays
  misc_feature: Ceres CLONE 1584747
  misc_feature (18)..(18): n is a, c, t, g, unknown, or other
  misc_feature (72)..(72): n is a, c, t, g, unknown, or other
gggtgtgtgggtttttcnttacggaaggacggcggagtgtaagggtaaatgaagggaggggggtggggggtnccaaagtggagctccccgcggtggcggccgctctagaactagtggatcccccgggctgcaggaattcgtctcacccctagaaaagcgccgccgcctactccagcctccagcgtgatctgagtcctgaccaagccctaaacgccaccgccctcgcaaatctcctttcccttcgatccatggtcgccgccgtcgccgcccccgcgccatcccgcaagacggagacctacacggacaccaagcgccgcgacgacgtgcgcggggccaaaatcgggagatgcgcgcgccttcgacgacaacgtgagcaactcgggtgggcccccgggggcagggggaaagagaatggggtcggggcgaaccagggcgtccggaagtcatccgtttttgagggagggtggtcaagaagcgtagggaccgccccccacgcccccccacaacccacactcgaagcaaggctgagcgggggctgaggcccgtctcccaggaaattcccctccggccggggggaaggggaggcaggatagggggcggatgaccccaaccgcggggagatgcgttatgaaccagagcaacgaaccacgaagggggctagcgcgggctcggcccgggggtgatggcaaaggcccccgcggggcttaccagtgcgtggagcgcaataattgcagctttcgcgaattcagaagtgctatgaaggcgcttacgtggctcgctcacgtgactgtaccaggtacagagttgagcttcctctaacggagagaggaccgctgcacgacgcggtacgacaatctcttgttaggtgtggctctcggttaccgagatcggaggtctagggatggttactgagaacaaaggcaccacctacggacagccgaaaaggttgaacgaccgctcctctcagtactgaagagctcgaggtcctcaatcagaagatccagagaggtagggagacgatggatcgccacaagaagagacacggttgacaaggaatgtgagagcgggacaggggagcggccgggccgcagggaatggccggtggtcgaggtaggaccgaccctatgtcgcccaggccgggtggtatatgaagttcgtcggttcatgattcgctggacgataactttgatacagtaacttaccgaggggcgactgctgtgggcaggcttgcgcgcgtgtagtgagttggagatgcggagagctggagtccgtgc

SEQ ID NO: 94803 - DNA, 947 bp, Zea mays
  misc_feature: Ceres CLONE 1584750
  misc_feature: Encodes the peptide sequence at SEQ ID NO. 94804
  misc_feature (452)..(452): n is a, c, t, g, unknown, or other
  misc_feature (903)..(903): n is a, c, t, g, unknown, or other
tggagctccccgcggtggcggccgctctagaactagtggatcccccgggctgcaggaattcgtctcacccctagaaaaagctcattcccatcacgcccatcgttttccgtcctccagtccgtcaatccagtccccatccccacggcgccgacgactcgggggcttcccccccttggacttggcccgggtgggagtagcacgtcggggaagggaagcaagcgtccgcgagtaaggacagaaaaccgaagggaggagtggagaggaggagcttgcttggagcgggtggacgggtggtgtgtatatagttaagcgggcgggcgggcagccaatgccgtcgggcgcgcagggctaggagcatgcgcggagggggcgcgatcgtgcacggcttccgccgctggttgcaccggcggagcgaagggctcatcttcaactccaatcgagccgtccttcgnccggcaagggggaaaacggacgacgggtcatccgatcttcaggtcatgaaggaccgggattttcctcggcctcgaggcaattcggggttccccaagccaaaaaggccttttccccgtccgaagccccaggaaaaatccctttgaaaatggggtttcttttccggaggacggggaaggggaccccccttccacaatcccaaaaaatttttgggaaagggggtctccggagattttttcttgagtttgggaacaccccaccccgggggaggggggggtttataaaaaaaaaaaaatagggtttggggggcccccttcgggagcccccccccatgtgggggagaaaaaaaaccccccggggtgttttccccccccgcaatattgggaaattatacacaaggggggcccccctctttttagggggggtcccacaaaaatgttgttgtgtgttttnccggcgggaggggcgtccgctcttttggggggggcgaaatatag

SEQ ID NO: 94804 - protein, 79 aa, Zea mays
  misc_feature: Ceres CLONE 1584750
MRGGGAIVHGFRRWLHRRSEGLIFNSNRAVLRPARGKTDDGSSDLQVMKDRDFPRPRGNSGFPKPKRPFPRPKPQEKSL

SEQ ID NO: 94805 - DNA, 899 bp, Zea mays
  misc_feature: Ceres CLONE 1584752
  misc_feature: Encodes the peptide sequence at SEQ ID NO. 94806
  misc_feature (881)..(881): n is a, c, t, g, unknown, or other
ctccccgcggtggcggccgctctagaactagtggatcccccgggctgcaggaattcgtctcacccctagaaaaaactcctcatcagccatccccaaaaggccaaaacccgcgcacaccggcgacggcaggagaacctcccgccggccgccgccatgccgccgcctctacaggcccaccgcctactcatctcccaccgccgcctacccactccagctcgccgccggttcaccgccgcctcttccgtccaatccgctcccgccacaaccttggccccgggccccgccacatcctccatcctctccatacgcgagtcgctcctctcaggcgagaggaccgcggcggacatcacctacgagtacctctccggccatcgacgatacgagccgactatgcgcagcttcatccacgtcgcggacgccgccgccgagcgggaggcgaagaaactcggacggagattgctccggggagaacgagccgttggtcccctccctggagtgcctgggggaatgaaagaaaatttttgcaaagcaaaatgccttcaagggggggtcagggaacaggaagggaaacgggcggcttaaaacccctttccctttggcgcttcggggagaccccccttttggtttggggaaaaaaacctcaaaaaattcgaaagggggcccccccgggggggccgcttttggggaaaaaaaacccgggggagaaacccgggggccgggggaaccccctggggtttccccccccaatatctcgaggagggagggagttcccccagggggacccccggggggggggggaaacacacccctttttgtgggggggggggagaaaaaaaaaattgggggggggttttctctttgtgtgggggggggccccctcngggggggggggggggggg

SEQ ID NO: 94806 - protein, 142 aa, Zea mays
  misc_feature: Ceres CLONE 1584752
MPPPLQAHRLLISHRRLPTPARRRFTAASSVQSAPATTLAPGPATSSILSIRESLLSGERTAADITYEYLSGHRRYEPTMRSFIHVADAAAEREAKKLGRRLLRGERAVGPLPGVPGGMKENFCKAKCLQGGVREQEGKRAA

SEQ ID NO: 94807 - DNA, 892 bp, Zea mays
  misc_feature: Ceres CLONE 1584755
  misc_feature: Encodes the peptide sequence at SEQ ID NO. 94808
aaagctggagctccccgcggtggcggccgctctagaactagtggatcccccgggctgcaggaattcgtctcacccctagaaaaagagcagcagaccacgaccagcacgcccacttgcctgcgattactttgcgccagagggcagaggccttggccctgccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaatacaagtagcagtagaaggaaaagagtcagtccgcccgtgactacgagtgaatttgttgggtgtggtgtttgttgaggccaccaccatgggaggcgggctgttggtggatcagagcgtggtgttccctggcgtccacaacttcgtggatctcctgcagcagaagggcgacaagaacctgggcttcgggtctctgatgccgcagacgtcctctggcgaccagtgcgtgatgggggagggcgatctcgtagacccgcctccggatagcttcccggacgcctgggaggacgacagcgacgatgacgtctaggacatcgaggagctggagcgccccatgtggcgcgaccgcatgaagctgaagcggctcagggaactgcagcagacaggcggcaaggactcgttggctagcgggtgggggactggctggatggcttcctcaaaccctaagcagtcgcacggaacaagcccaggcgacaagaagaatgtcccgcgccccagggacgggcttcttcaagtacatggccccagaatgatggaaagtgtttcccgcccgcccaggggctttgtggt

SEQ ID NO: 94808 - protein, 73 aa, Zea mays
  misc_feature: Ceres CLONE 1584755
MGGGLLVDQSVVFPGVHNFVDLLQQKGDKNLGFGSLMPQTSSGDQCVMGEGDLVDPPPDSFPDAWEDDSDDDV

SEQ ID NO: 94809 - DNA, 836 bp, Zea mays
  misc_feature: Ceres CLONE 1584756
  misc_feature: Encodes the peptide sequence at SEQ ID NO. 94810
tccccgcggtggcggccgctctagaactagtggatcccccgggctgcaggaattcgtctcacccctagaaaaaatctcacgcggccatccgacgaccagcttctttcactttggaaccctcgtgtgaggccaccatcgccttctctctcccttctttcatctcccctccccatctggatcctccgccaccggttccccattgctgcctccaccgcccccgctcctcgccggttccccattgctgcctccaccgcccccgctccgaggagggccacgacggccggatcctggactcgttgtcgcgtacctggatccaggggaaatggcggaacacggcgaacgcgagcgtgacggcggggttcatgtgcgcgcccgagatgtggccgacggcgtagatcatgacggtgacgatgagcccgccggcgaccgactgccccagctgcgagatgcggtccttgtcgctgccgtagatccccgccgccccgcacgtgacgaacaccagcaggaacgtggacaccacctccgagaccacctgtcgatcgataaccatgggaggagcaccaccaccacaaagcactctcatgcatcagtcgatctccggccgccggtacttgattctgaataacaaataatttccactactgggactgaaacttagtatccatctactgctggattgggacatggcttagaaaatgtcatctttcacttgagtagtctttggtcattcaagcaccacttggcattcagttacgtcatggcagttttggtgtggcccaaatacctttaccccttggcttctgggagttcaaaggatacctctgatacttgtaatg

SEQ ID NO: 94810 - protein, 100 aa, Zea mays
  misc_feature: Ceres CLONE 1584756
MAEHGERERDGGVHVRARDVADGVDHDGDDEPAGDRLPQLRDAVLVAAVDPRRPARDEHQQERGHHLRDHLSIDNHGRSTTTTKHSHASVDLRPPVLDSE

SEQ ID NO: 94811 - DNA, 867 bp, Zea mays
  misc_feature: Ceres CLONE 1584758
  misc_feature: Encodes the peptide sequence at SEQ ID NO. 94812
ggagctccccgcggtggcggccgctctagaactagtggatcccccgggctgcaggaattcgtctcacccctagaaaaaaaaaaacctagaggcgaccggccagcgccatatcccgcgccgccgccgccgccgccaacgcttaatgctagtgttcctccggcgaggcctcttgctcgtccggcagcccaccacccgcgtccttgccaaaccgtctctccgccctgcttgtctcttcgtccaccacttcgccgtcgacacgatgggtgagggttctgctgctggtaaggacgcgaaggggaaggggaaggggaaggggaagaccaaggccgccgccgcggattcggccctggtcgttcgcgacgactcctacctagaggcggtcactcagaagaggattcgcttcttcgaggagatccaggcaaggcaagccgtcgagcggctgaatatcggcggcgaagttatcaaggtaactttgcctgatggcgctatctaggagggtaagaaatagataacacccccaatggatattgctaaggagatatcaagtggatttgcagctagttgtttgatagctcaagtggacgaaacactctgggacatggggaggccactcgaaggtgattgtaaattgcaaatgttcaagtttgatacccatgaagggcgtggacccttttgggcactcagtggctcatattcttggagaaatctattgagaaaacaatatggaaggccaagctgttgtattggggccttggcaccacaaagaaggggaggggttttccaacaaggaaggccttcactaaacaggaaatcaaaaacttggaatggaggggagcccttttggggtatcctattgaaaaaaccaac

SEQ ID NO: 94812 - protein, 116 aa, Zea mays
  misc_feature: Ceres CLONE 1584758
  misc_feature: SWISSPROT Homolog: EC 6.1.1.3 Threonine--tRNA ligase
MLVFLRRGLLLVRQPTTRVLAKPSLRPACLFVHHFAVDTMGEGSAAGKDAKGKGKGKGKTKAAAADSALVVRDDSYLEAVTQKRIRFFEEIQARQAVERLNIGGEVIKVTLPDGAI

SEQ ID NO: 94813 - DNA, 834 bp, Zea mays
  misc_feature: Ceres CLONE 1584762
  misc_feature: Translation starting site: 245
  misc_feature: SWISSPROT Homolog: EC 2.7.7.27 Glucose-1-phosphate adenylyltransferase
aaagctggagctccccgcggtggcggccgctctagaactagtggatcccccgggctgcaggaattcgtctcacccctagaaaaaactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttggggtggtgggtacgggactcagcttttccctctcacagcacaaaggccacccctgctgttcctattggaagatgttacagggctattgatatccccatgagcaactggttcaacagtggcataaaccagatattttgttatgactcagttcaactcagcttctctttaccgtcacattcatcgtaactatcttggggggggggggaatcacttccccggaaggaacttgttgaaggtgcctggctgcaaaaacaattgccctggggaaggcttgctggttgggttccaggggcaaagcaaaacccccgttagaaaat

SEQ ID NO: 94814 - DNA, 961 bp, Zea mays
  misc_feature: Ceres CLONE 1584763
  misc_feature: SWISSPROT Homolog: EC 2.7.7.27 Glucose-1-phosphate adenylyltransferase
aaagctggagctccccgcggtggcggccgctctagaactagtggatcccccgggctgcaggaattcgtctcacccctagaaaaaactccattgcaacgcaacggcctcgccccgctttataggccgccgcccgcggcacatcaccaccgtctcgcaccgtcacggccacccattctctctcgtccatcggatcgatccggctcccagcgcaatcgatccatccgtccctaggtgtgcttcaactatgcaggtcagcaccgtgcttcccctacagagaaaagcgcgtatgaccccagagaggagaggcagtggaagttatgggagtgaaaggatgaggatcaactgctgcaccatcaggagcaacaaggcattgaagaggatgtgctttcaatgcaagggagaaccccaagccacacaacagagcgtgatcacatcagatagctgggccataacactctgtggtggcccgaacatccctttcccgaaggaatctggccggatccctaatgaaatccactgcccccccatttttaggagggggggaacccggggaaccccaaattattccccgcgtgcaaaaaaaaaaaagggggccccccccctgggttggtgcccaaatgggaaagagaacggtgaaccggggccgttatatggaaaatatccccctgggaggcacaccgtggtttcaaaaacgagggggcaaataaacgaagaaaaattttctggtaaaggaaccaagggtgtgagaggtaaaagttgttttcggttaaaacccaataaaggaagaatccctctaccccgggtatttggggggggggggcggattaacccttcagggcggaaaggaataaatgtgtataagaatccttggggtgaaaaaaaaaaaaaattgtcctggggagaaagggccctcccgtgttgaggtatataggggggtcgctcgtggtaaaatcccccgttg

SEQ ID NO: 94815 - DNA, 838 bp, Zea mays
  misc_feature: Ceres CLONE 1584764
  misc_feature: Encodes the peptide sequence at SEQ ID NO. 94816
  misc_feature (257)..(257): n is a, c, t, g, unknown, or other
  misc_feature (279)..(279): n is a, c, t, g, unknown, or other
  misc_feature (632)..(632): n is a, c, t, g, unknown, or other
  misc_feature (634)..(634): n is a, c, t, g, unknown, or other
  misc_feature (736)..(736): n is a, c, t, g, unknown, or other
  misc_feature (737)..(737): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (784)..(784): n is a, c, t, g, unknown, or other
ctggagctccccgcggtggcggccgctctagaactagtggatcccccgggctgcaggaattcgtctcacccctagaaaaaccccctagaaaaaacatatattttttgtgttagagaagtgtggctcagactgccagcattggttagtacgtttagctcttgggatattgcctcttctattcatcggctactgtaacttctattttcttttgttctgaagactacctgtaccagacttgtgatccaggttccagggcnctaattaatatatgtgacactngaatttaagctcaaaaaaaaaaaaaaaaaatggtcgcaccctcctccggccctcccagccgctaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcgggggcgctcgcctcactccaccgctactccgacgctctcgccgacgcgcagaagaccgtcgagctcaagcctgactgggccaagggctactcccgcctcggcgcggcgcacccntnggctccgcgacgccgccagcgccgtcgccgcatacgagaagggccttgcgctcgacccagcaacgaggtctcaaggcggggctcgaggacgccaagaaggcnngcgcgccccnnncgcgtcgcgggccgtcgggccccgacgccatcggncagatgttcaagggcccgaactggtggagcagatcgcgtccgaccccacacacc

SEQ ID NO: 94816 - protein, 149 aa, Zea mays
  misc_feature: Ceres CLONE 1584764
  misc_feature (2)..(35): Pfam Name: TPR_2 Pfam Description: Tetratricopeptide repeat
  misc_feature: SWISSPROT Homolog: EC 3.1.3.16 Phosphoprotein phosphatase
  misc_feature (82)..(82): Xaa is any aa, unknown, or other
  misc_feature (116)..(116): Xaa is any aa, unknown, or other
  misc_feature (120)..(120): Xaa is any aa, unknown, or other
  misc_feature (132)..(132): Xaa is any aa, unknown, or other
MADEAKAKGNAAFSAGRFEEAARHFTDAIALAPGNHVLYSNRSGALASLHRYSDALADAQKTVELKPDWAKGYSRLGAAHPXAPRRRQRRRRIREGPCARPSNEVSRRGSRTPRRXARPXRVAGRRAPTPSXRCSRARTGGADRVRPHT

SEQ ID NO: 94817 - DNA, 943 bp, Zea mays
  misc_feature: Ceres CLONE 1584767
aaagctggagctccccgcggtggcggccgctctagaactagtggatcccccgggctgcaggaattcgtctcacccctagaaaaagaggaagaaaaaaaaaaaaagcagcaggcaccagtgcatcgccaccgtaccggagggggcagcgcccaaaaaaggcaaacgggagggtgggcgagcctgctcttcctgtctgggagagagaccgaagaagaggagagagaggcgcagcgcagcgcaggcgcgcatctcccccctccccttgccggctggcccctgctgcagctctgctccggtcggctctgcccccccgctctgctgactgctctgccgctgctgctgtcgcaggcgcgccaccaacccgccgatgcgcgcgtagcggggtaggtaccatcatcatccatccccgcgacgacccaccacccacccctgcagtctgcagcatccccttccccactcccggctggtctgctgcggccacccctgcgccgatccacctccgctgcttcctgcctcaatatattcgcccgcctcgtcgccttccgaccccgccacggaaggccttccagaacccgtccgaccccgtcaccttcggctccgcccccggctccaatcttcctcctccccggggccggcccgactcccgatgggccgtccgtcgagggcccgccggcaacctgaaccacgccggcggccgccggttccaggaaggaaggcacccggggcccccggtcccttggccctcttgcgccctcacccccggggaaaccgccaaaaatcggggaattctggaaaggaactttgttctttcaaggcttaaaccccaatgggcccgagggagtttggttcccgggcccttcccttgggacttcctcccggcggccctttaaggcccgagggcccggtttattcccgggcgggcgtaaggggttttataccctgg

SEQ ID NO: 94818 - DNA, 1055 bp, Zea mays
  misc_feature: Ceres CLONE 1584770
  misc_feature (64)..(64): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (686)..(686): n is a, c, t, g, unknown, or other
  misc_feature (801)..(801): n is a, c, t, g, unknown, or other
gggtttggtgccgtggtggggacgcagttcttttaaatgtccggacatcccctctgggtgttcntccccnnnnnngnnnnnnnnnaaaaactggagctccccgcggtggcggccgctctagaatagtggatcccccgggctgcaggaattcgtctcacccctagaaaaacgaccgacactgaatcccgcctccaacctccgctcgaacaccataccttcggtctcctccgtctgtccgtcgcccatccggccggctctttctcccacagccggccgctgccgcacgttagctcctcctgcatcgtcgccggacctccgctacccccccggggcaatccttgcctgggcaaggcaggatctggccaccttttcgcccgcaacagtttgggccccccccaaaggaaaccgccctacccccagaggaaaggaagacccccctccccccacgcttaaaaaccccgaaaggggggggcccaaaaaaaccccctttttttaaaaccaaaaggggaaaccccgcgcgggggagaagggcgccccccccgggggaaaccacccccttccctctgaaaaaaaaaaaagagcccccccgggggcctataaaagggggggggccccaaaaaactcttttttctcccccgcgggggaaaaccccccccctttttttttttcccccccccccgcccccngaaaaaaaaggagggggggagtgtttttctctttctgggggggaacaagaggaggggggaggtgccaaaaataaaattggcggggcgggggaaaaaaaaaaacactcctcccccnccccaaaaaaaaggcggcccgtccttgggggtgggtggagaaaaaaagaattttcttttcccccccccctctcttttataaaaaaaaattttgttttttttttgggcgggcgcgcccccactaacaaaataaatattttctccccccacaaagagaagggcctcggagaaaaaattttttatttctctccccccccccctcttgttgtgggcggcccccaccggcggatgatttttcccccccccggggagaag

SEQ ID NO: 94819 - DNA, 818 bp, Zea mays
  misc_feature: Ceres CLONE 1584771
tggagctccccgcggtggcggccgctctagaactagtggatcccccgggctgcaggaattcgtctcacccctagaaaaaaaaaaagcagccccagcccccagcaacatttctcctttctctctcctcttgccgtttctcgctctcttcttccttgcagtgcactgcaaaccaaccataaacttgccctcttctctgcttgaaccgcggagcaagaccgctcttgttctcttctctgcttgaactgcggagaaagaccgaatccgaagggacgttgggactttctggctgggaagactacataccatttctctaattcgggcgtggtttgtgctgggagggaaggaatccatggggctgcagctcgatccgcgctgagggttgaaggaaccggccttgttgtgtgctccacccaatcgaggaataggggcaaggattgctgctttgttgtctttggatcccgttacgccattggggattcaaccatcagcagggcgaagtgacggttctgcaccacttttccccttatcctaattcgattttatttgaacactggatgtgatttatatctcggttggctgttctgtgcggctctatctgagggtttctcccgtccctgattcgggaaggaaaggcgcccttggattttcgtctccttggcgcccgccttgtaacccccggaggctaacttttaaatttaggggaaaaattaatggtagcacctgtttaaggaaacccgggtcctctttattaccccccgggggaattttccgccacccgggggtggaccgtcctgggggccaatccccaaaagacccta

SEQ ID NO: 94820 - DNA, 829 bp, Zea mays
  misc_feature: Ceres CLONE 1584773
  misc_feature: Translation starting site: 238
  misc_feature: SWISSPROT Homolog: EC 4.1.1.1 Pyruvate decarboxylase
  misc_feature (356)..(356): n is a, c, t, g, unknown, or other
  misc_feature (383)..(383): n is a, c, t, g, unknown, or other
  misc_feature (456)..(456): n is a, c, t, g, unknown, or other
  misc_feature (547)..(547): n is a, c, t, g, unknown, or other
  misc_feature (707)..(707): n is a, c, t, g, unknown, or other
aagctggagctccccgcggtggcggccgctctagaactagtggatcccccgggctgcaggaattcgtctcacccctagaaaaaaccgaaccaaaccaacacacgtcaaagcagaaaacctcagaaaaccccaatatatcctcgtccaccactgcccccgctctgctgcaactccactcggcccggccgccctttccacccaccttgatcctccgatccgttggtgcttgaccgatccatggacacccacatcggatccgtgaacggggcggcgtcgaaccagacggttggctgcccggcgtcggcgccggggtgcccgatggcgtccacgccggcgcagcccgcggcgacctgtcnggcgggggaggcgtcgctggggcgccncctcgcgcgtcgcctcgtgcaggtcggcgtcaacgacgtcttcgcggttcccggagacttcaacctcacgctngctcgaccacctgatcgccgagcccggccctgcgccctcgtcggctgctgcaacgagctcaaacgccgggtacgcccgccgaacgggtacncgcgcgcgccgcgggcgtcgggggccctgcgccgtcacgttcacaagtcgggggggctcagcgtggctcaacgccatcgcgggcgcctacagcgaagaacctgcccgtcatctgcatcgccggcgggccccactccaacgactaacgggacaaacgcatnctcccacacaacatcgggctccccgacttctcgcaggaactccgctgcttccgaacgtcactggcattcagggggggtgaacaatctggatgaccgcacgaacagatcgaaccgccattgcc

SEQ ID NO: 94821 - DNA, 844 bp, Zea mays
  misc_feature: Ceres CLONE 1584776
  misc_feature: Encodes the peptide sequence at SEQ ID NO. 94822
ctccccgcggtggcggccgctctagaactagtggatcccccgggctgcaggaattcgtctcacccctagaaaaactcagccaccaccggcagccgcgggagcttcgcgtgcgccgcttgctcactgcccgcacacgtacgccagaacccctctctcccccctccttctgcagccatgctcctccacctgcttccgctctcctgccccgcgccgccgttccacctgcgcaggaccggcggctcgccgcgggtccgcgccggggatagggccaggacacgggggctccgggggacagacgtggagccggagacagcgccgcgaaagcgccgcagccgcgatggcgacgatcctcaagcggctgggagcggtggagacaccggggcgctgctggcgtcagtcatgaggcttctgctctccaaggcgcctgcggaggcggagggagacagtgaggaggagcagggacagttccccaagcgttgggccatcgtcttcctctgcttctccgcatttctactctgcaacatggaccgcgtaaatatgagcactgctatactgcctatgtccgcagagtttggttggaacccacagactgttggtctcatgcagtcatctttcttctggggctacctcctaactcaaatagctggagggatatgggcagatactgtttggaggaaagaacgtcccttggctttggcgggggtttgggtgggccattgcctacaactcttactccctgtgcagaacaatcttggcttggcaatttcttgcttggtgggggggcctttcctggggaattgggggggagagggttcgcaagccctggcaatgaaaccatattggt

SEQ ID NO: 94822 - protein, 223 aa, Zea mays
  misc_feature: Ceres CLONE 1584776
MLLHLLPLSCPAPPFHLRRTGGSPRVRAGDRARTRGLRGTDVEPETAPRKRRSRDGDDPQAAGSGGDTGALLASVMRLLLSKAPAEAEGDSEEEQGQFPKRWAIVFLCFSAFLLCNMDRVNMSTAILPMSAEFGWNPQTVGLMQSSFFWGYLLTQIAGGIWADTVWRKERPLALAGVWVGHCLQLLLPVQNNLGLAISCLVGGPFLGNWGGEGSQALAMKPYW

SEQ ID NO: 94823 - DNA, 968 bp, Zea mays
  misc_feature: Ceres CLONE 1584781
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
tggtttgggtgtnnnnnncncccgggcggggcccttgacgagcgcggcgacagatggagggagaagtgagattnnnnattatatttgtttaaaactggagctccccgcggtggcggccgctctagaactagtggatcccccgggctgctggaattcgtctcacccctagaaaaaaaccacgagtttttcctgttcgctttgctttctcggctcagctactgctgctctgctaggaacaccaacagtagtgtgttcttgcgccggcttttcttgccgtgtttcgggtcgatattattgggagggtgggtctcccgtcccgtttcgatgaggccggaggagagagatgctgccgtggggagagtcagggaccagttccccgtcggcatgagggtcctcgccgtggacgacgaccccgtgtgcctcaaggtgcttgagaacctcctgcgccgctgccagtatcatgtgacaacgacgaatcaagctgttgtccccttgagtatgctgaggcaaaacagggacctggtttgatcttgttattagtgatgttcacatgccagacatggatggcttttagcttctagagcttgtgggggcttgaaatggaccctcccctgttcattaatgttatccggtggaattggagaggacaaaaaactggtaatgaaagggggattaactcatggggggccctggtgaactatcctcctttaaaaaccgggttccgggctgggaaagaagctttagggaaattttcttgggccagccatggtttggttaagggaaggaaaattccaggtaaaactggtggattcggtggcctaaccaatgggatgggcctatggaagggaaattggcaaattaggggccacttccaaaagggccaaaaattttttggaatccctgggcctccacacgggcccaaaaatttaccaccgctggggggcccacccctgggaaccaaaaggggt

SEQ ID NO: 94824 - DNA, 945 bp, Zea mays
  misc_feature: Ceres CLONE 1584785
aaagctggagctccccgcggtggcggccgctctagaactagtggatcccccgggctgttggaattcgtctcacccctagaaaaaatcgacctcgatccattgaataattttactaatcaaattcttgttgggatatattcctccaattcccctcctcctcccaacaaggcaacaacaatctgttccggccgccaaacaaaacccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcaccactcgccctgctgcgtccgcgtccctctccttctctgcgaggaaaccggcgggcggcagcctgcagctgcaacggcaagcgtgcttcgagccatcagtggcgccgtcgcgggggggtgttcccctgccgggcccccggcgtcgggggagcgcggcccgacctggacatccgggggccaggaggtcctctcggcgtggccagggggttcgtccatggaagcccgcttggaacaccgcccaaggaatggcgggaaccccccccttgaaccggccttcaaaggcgggtgcaagggacaacctttttcccgaggattaaaaaaacgcggggcctcctaagggggctctttggagggaacctgaggggggggggaatcttctcaaaaggtaaaagggccccgtggccgggaaacaactttacggggctctctccggagagttttttgaaaattggcccaccaagacccggggttaaagggtacaagacccccatgttccttctcaccaaagggggggggaaaatttcggaaaaaccttagagaatatcccctcccccgggtggcccccacaaaaa

SEQ ID NO: 94825 - DNA, 1173 bp, Zea mays
  misc_feature: Ceres CLONE 1584789
  misc_feature: Encodes the peptide sequence at SEQ ID NO. 94826
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (1032)..(1032): n is a, c, t, g, unknown, or other
gtgtgggtgtggtgtgtgggggggtgtgggagcgcttatttttttttgttttaaaaaggnnngtttgttttttcaagctggagctccccgcggtggcggccgctctagaatagtggatcccccgggctgcaggaattcgtctcacccctagaaaatgtgaagacattgactggcaagaccatcaccttggaggtggagagctctgacaccattgacaatgtgaaggccaagatccaggacaaggagggcattcccccagaccagcagcgtctgatctttgctggcaagcagctggaggatggtcgcaccctcgcggactacaacatccagaaggagagtacccttcaccttgttctccgcctcaggggtggtatgcagatctttgtgaagaccctgactggaaaaaccataaccctggaggttgagagctcggacaccatcgacaatgtgaaggcgaagatccaggacaagtagggcatccccccggaccagcagcgtctgatcttcgccggcaaacagcttggaggatgggccgcacctttaccagacttaccacatcccaaagggagagcaaccctccacctctgttgctcccttcctccgggggggggttcagtaaaaatccaaggggttccgttttaagcctgcccgatgttgcccctgccgttccttcctgggggggccccctccctccataattggggaaggggttgggccaaaaaaatgtattcctggccatggttttccggaagtatcaatagaaaaagtcctgttaggtgccacaatagaggttcgtaggggttattaaaatacaaaaatggggggaacacaccggggttcggatggagtttagtgtagtagggggaccccattaacacttatcgcccacggataatgttatgtgtggggccctcctaaaaacacatccaccttctcggggggataagtcgccctgaggaaggagagatgaaatgccccgtgtgtggactctttaatatttaatctcactacctgttttagtatagtgccgcnaaaggaagagtagggcccctagcttagtacgcaaaagactacacctcccgcgggtgtccacaaaaccaataatgtctcctcatcgatgtctcttgggcgctcccctatattatgtcttccaagacacgcgtgtgtatgaaa

SEQ ID NO: 94826 - protein, 33 aa, Zea mays
  misc_feature: Ceres CLONE 1584789
MQIFVKTLTGKTITLEVESSDTIDNVKAKIQDK

SEQ ID NO: 94827 - DNA, 921 bp, Zea mays
  misc_feature: Ceres CLONE 1584794
  misc_feature: Encodes the peptide sequence at SEQ ID NO. 94828
  misc_feature (407)..(407): n is a, c, t, g, unknown, or other
  misc_feature (785)..(785): n is a, c, t, g, unknown, or other
  misc_feature (793)..(793): n is a, c, t, g, unknown, or other
  misc_feature (801)..(801): n is a, c, t, g, unknown, or other
  misc_feature (802)..(802): n is a, c, t, g, unknown, or other
ctggagctccccgcggtggcggccgctctagaactagtggatcccccgggctgcaggaattcgtctcacccctagaaaaaatccacacccatccttccatccaccatcaggtcagggcatcacacttcacacaacaacaacaactcctcctcctcctccaccatcagggatcgtctccaccgcttggctcaaccaactcctctgctcctgttcaatcgaccccacctctctcgctcctattccaccgggatcccatttccatccggacgatggcggtgatgaccgacatgcccgcggccacggcgctgcgcgcgccggcgccggccccggcgggctgcgacggtcaaaaggacgccgagaagctgaggttcatcgaggagatgacctccgacgtcgacgccgcgcangagcgcgtcctggccgagatcctggccaggaacgccgggaccgagtacctcgcccgctgcggcctcgccggcgccacggaccgcgccgccttccgcgccaaagtgcccgtcgtcacctacgaggacctgggagcccgacatccagcgcatcgccaacggggaaccgcttcgcccatccttctccgcgcatccccattctccaagttccctcaccaggctccggggacttccggaccgggcgagcccaaacctggatgcccaaccaatcaagggagggagctctgaccgggcgccaatgatgaatgtaaaaggcctccctttaatgccccggtcatggaaacactggtacccggcacaggggcctgggcacaagggganaggggggnctccttcnnttccttgttccggctaagagccggaaaaaggaacaaacgccccgggcgcgggcattgaaagggacacgcggccccgagggctggaaagaaaacattcctagaggagaagccgaaagaat

SEQ ID NO: 94828 - protein, 140 aa, Zea mays
  misc_feature: Ceres CLONE 1584794
  misc_feature (46)..(46): Xaa is any aa, unknown, or other
MAVMTDMPAATALRAPAPAPAGCDGQKDAEKLRFIEEMTSDVDAAXERVLAEILARNAGTEYLARCGLAGATDRAAFRAKVPVVTYEDLGARHPAHRQRGTASPILLRASPFSKFPHQAPGTSGPGEPKPGCPTNQGREL

SEQ ID NO: 94829 - DNA, 834 bp, Zea mays
  misc_feature: Ceres CLONE 1584795
  misc_feature (770)..(770): n is a, c, t, g, unknown, or other
  misc_feature (774)..(774): n is a, c, t, g, unknown, or other
  misc_feature (800)..(800): n is a, c, t, g, unknown, or other
  misc_feature (806)..(806): n is a, c, t, g, unknown, or other
aaagctggagctccccgcggtggcggccgctctagaactagtggatcccccgggctgcaggaattcgtctcacccctagaaaaaccctagaaaaaatgattgcattgcgggctgccgcggagctcagctctcctgtcctgccaccaccacgccgctgacgatgccttcctctcgcctgcctctgcctgcgcacaaccgaaacggctagcccgcccttcctcccctcccctttgcttccgcaccaagatttgggcgggcgttccttcttccgataaagttgacacccgtcgtctcgtcgtgggcctggcagatactgataggtggtctggttcgtgacttgttcagtcctcctctccaggtgccgagccagggtgactgttccgaggagcgtggcgtggacccatggggaagaagggcaagtggttcggcgccgtcaagaaggtcttcagccccgaatcctaggagaagaaagaggagaggctaaggaggaaatcagcagctagcaacccagcaccggtagatctgaccccatctacctccctggaagtcaatgtgtcggtgccaccccctccggctcctcctccagttcctcgccagaccgacgaggtcagggtccccgaagccgagcatgagcagagcaagcatgtcaccctggaggaggcccctgctgctgctgctgccccagcacatgcgtcggtgctgccacctggtggcgcataccgagagctcgccgctatcaagatgcagaccgccttgcgaggttacctggnaggnatggcactaagagcactaccaggccntgtacnattgaagtcatcggatgaaggctattcc

SEQ ID NO: 94830 - DNA, 1182 bp, Zea mays
  misc_feature: Ceres CLONE 1584796
  misc_feature: Translation starting site: 274
  misc_feature: SWISSPROT Homolog: EC 2.7.11.1 Non-specific serine/threonine protein kinase
tggtgtggtgggttgtgtgcgtcgtagtgtgaataacgtgagaatgaaaaaaatacaaaataaaaaaaaagattaatctgggactccccgcggtggcggccgctctagaactagtggatcccccgggctgcaggaattcgtctcacccctagaaaaatagctgtagctttcaccccactccctccacggcaccgcgcctccctcccccccttccccaaatcctcctcccctccccaattgggccaatagcccgctccgtctccgtcgccggcgatgagctgcttcgtctgcttcgggtcgggccggatcgcgcagtggctcgcgtcggatcagataaatcaagatcacagggtggaccagactctaagaaggatctaattatccataaggatgggaatagtcaaaatattgcagcacagactttcacttttcgtgagctcgctgcagccactaagaacttcaggcaagattgccttttaggagacggaggttttggtcgtgtatataaaggacacttggagaatgggcaggctgttggctgtgaaacaaccttgatcgtaataggtctccaaaggaaacagggaaatttgctgggttgaagggtcctcatgactcagtcctctttaccatcacaacctaaatcctgggtgcaaatcaaaaatctgggcttgaccgtgggcgcctaaaagggtggaaccaaagcggcgccttaacttagaagtaatacgaaagcttataattagctcccatctggagggggggtcccgacgtggtggaaaggaaatccaatttctgttatcctattgagactacattgtggcctcaccgcgagttgcaatatataacgacgagggcactccacctgaggatattgggcggaaaaaccaacagatggtgcgagtaggaaaaaattcaaacaccctagaaacattgtgttggcataagcctctaaaaggcggccgttttagtgtaataacaaccaattgactgctggtaacaaatggtggcgcaagagtataacttacccatggtgtaaaatgttttacaccccggggagaacatatatgtaaggatgctgactcaaagaaaacgatattctgtttctgtgggggagaaaagaggtattcctccactagcgagaagaatcacgagactgtaagaaggatgctagagatcattgtg

SEQ ID NO: 94831 - DNA, 1253 bp, Zea mays
  misc_feature: Ceres CLONE 1584797
  misc_feature: Encodes the peptide sequence at SEQ ID NO. 94832
  misc_feature (72)..(72): n is a, c, t, g, unknown, or other
  misc_feature (73)..(73): n is a, c, t, g, unknown, or other
cgggtgtgtggtgccgggcgggagggcgcgatcgcctctttgtcgtttttgttgggagaaaccgccggcccnnaaaaactggaactccccgcggtggcggccgctctagaactagtggatcccccgggctgcaggaattagtctcacccctagaaaaaaccaccaccaccggtcaccgaaacgcagcaactgacaggcacctgacggagagctagtcgctctgcagccgagtcgagtcgaactagcgcgcgagcgagcgaggaagaagaagagctagctatactgctgcttcctcgcgcgcagcagcagcagcaaacgaagaaaccagccccatgggcggcagcgcggatgcgaacggcgcggggtcggtgcgggtagcggtgcccccggcgcggccctttcctggacacgttccgcgggaacctcaaggagaccttttttccggaacaacccttccgccggggggggcagggatttctcccccccttttgggaacgggggccacgttgagcagctttcttcccggtccctctaagggggaaccggccctttccactgggccacccttcaagggtccgaacagtattgaccggggaataaccaatttacagagctcccccaatcccgcggggggggtatagtgtctatcccgaaataatttctcaaacacgggacggcccacagttcctgggagaacttatcgtctgaggattttcgagtcaccgacgcgactgggggtcacatcccagccaagcctaggtgcggaaactcctctacggaacacactaacagccccgatggcgggaagcacctaggactagctaggcgacatgctgcgacccaacctcagcccgccgcacctactgataagccgggcgcgaccgcgtgttgcggtataatcagagtccactggtctgcatgccaggcatgcaggcacacccgtacgtagatcttcctgaggccgcacggtgtatagcggactggttaatacaggtcaaaattgtcggacgcgagcgctccccggtggctctcacacctccctgactagcgctaaactcctgtccaccggctcgcgcaacagtagccgagacgcgtgcctgagtaccgtcgctgcgtccaccctcgcatcacagagagagaccccctcactccaagcgtgagctggtgactatcaccaacccctcaatagtgtgtctctattcgtactgcctcacccccaacagagaggctcactgcatccacagccagctcaa

SEQ ID NO: 94832 - protein, 102 aa, Zea mays
  misc_feature: Ceres CLONE 1584797
MGGSADANGAGSVRVAVPPARPFPGHVPREPQGDLFSGTTLPPGGAGISPPLLGTGATLSSFLPGPSKGEPALSTGPPFKGPNSIDRGITNLQSSPNPAGGV

SEQ ID NO: 94833 - DNA, 871 bp, Zea mays
  misc_feature: Ceres CLONE 1584798
  misc_feature: Encodes the peptide sequence at SEQ ID NO. 94834
ctccccgcggtggcggccgctctagaactagtggatcccccgggctgcaggaattcgtctcacccctagaaaaagattcgcccagggcaatattccccccggaccaaactagatcagcgaaacccactccgctctcccgagatcggacacatggcggcggcggcagtgacgtccaacggcggcgcagtggccgcgaacgggccggcgcccggcaggctggcctccgtgtacagcgaggtgcagacgagccggctcctgcacacgctgcccctcccctccgtcctccgctccaacttctcggtcgtcgacggccccgccagctccgccgcgggtaaccccgatgagatcgccaagctcttccccaacctgttcggccagccctcggcgtcgctggtgccttcggccgagcccgcggcgaccaggccgctaaaggtcggtgtcgtgctctctggtggacaggcgcccggcgggcacaatgtcatctgcggcatctttgattaccttcaggagcgtgcaaaaggtagcaccttgcttggattcaagggaggccctgctgggatcatgaagtgcaaatatgtggaactcacttcagactttgtgtatcccctcagaaaccaggggcggattcgaatatgatctgccgtgggaaggggacaagatttgaaacaccggtagcagttccaggcaagcctgaagacacagcccaacaaggctttgattttggaatggaccttgtttgtcaattggggggtggaatgaatttaaaaccacccaatggcccgtcccctttctttgggtggaaataacctttaagggtccaagggaaaaccccggaaaaaacaccccgggtctatactcggcgtttgtccca

SEQ ID NO: 94834 - protein, 161 aa, Zea mays
  misc_feature: Ceres CLONE 1584798
  misc_feature: SWISSPROT Homolog: EC 2.7.1.90 Diphosphate--fructose-6-phosphate 1-phosphotransferase
MAAAAVTSNGGAVAANGPAPGRLASVYSEVQTSRLLHTLPLPSVLRSNFSVVDGPASSAAGNPDEIAKLFPNLFGQPSASLVPSAEPAATRPLKVGVVLSGGQAPGGHNVICGIFDYLQERAKGSTLLGFKGGPAGIMKCKYVELTSDFVYPLRNQGRIRI

SEQ ID NO: 94835 - DNA, 863 bp, Zea mays
  misc_feature: Ceres CLONE 1584801
  misc_feature: Encodes the peptide sequence at SEQ ID NO. 94836
  misc_feature (1)..(1): n is a, c, t, g, unknown, or other
naaagctggagctcaccgcggtggcggccgctctagaactagtggatcccccgggctgcaggaattcgtctcacccctagaaaaaagagctggcaagtggcaaggctgcgcagagggactttttgtgtaaaatgcggtgggaaggtgcgctgcacctgcaagcagaggtgtgctctactgacagagtttgaactcaagaggaggcgaggcagaaccgcaatcgcgaccgcgacccgcaggtgacatacatacggtgcgagcgccggcagccggaagcaccggtgacgaagccttccgtgtcatcaggatcgcagggttttgtttcgtttcgcgggcgttgggtatccatccatggcgaagaagatgctcatcgacggggaggtggcggccgtcgcggatggtgggcactatgactacgatctcttcgtcatcggggcgggcagcggcggtgttcgcggctctcgcaccgccgcctccttcggaactaaagttgccatttgtgagctcccatttcaccccatcagctcagagtggctaggaggacatggtgggacttgcgtggatcctgggttggcgtacctaaaaagatactcgtggtatgggggcatcaatcccggggagaaattgagggatcccaaagaattttggggtgggaggaataacggagaaatttaactttcaattggaaaaaccctattgggaaaattaaaactaaaagaaattgttaaaataaaatgggtggggtttcaaaaaggatccctttaccaggtgccgggggtgaacaattattttaaaaggggccagggaaagcctaaatttgaaggccccaaaaccggtggaaagatttgccccgcccccaaatg

SEQ ID NO: 94836 - protein, 107 aa, Zea mays
  misc_feature: Ceres CLONE 1584801
  misc_feature: SWISSPROT Homolog: EC 1.8.1.7 Glutathione-disulfide reductase
MAKKMLIDGEVAAVADGGHYDYDLFVIGAGSGGVRGSRTAASFGTKVAICELPFHPISSEWLGGHGGTCVDPGLAYLKRYSWYGGINPGEKLRDPKEFWGGRNNGEI

SEQ ID NO: 94837 - DNA, 872 bp, Zea mays
  misc_feature: Ceres CLONE 1584805
  misc_feature: Encodes the peptide sequence at SEQ ID NO. 94838
  misc_feature (61)..(61): n is a, c, t, g, unknown, or other
ctgaagctcacccgcggtggcggccgctctagaactagtggatcccccgggctgcaggaantcgtctcacccctagaaaaaggggcgcggcgacgacacccacaggccacagccacaggccacacgacaccaccgctcggtctcggcgtccgcctccacgcacgcttcctcccgcaggccatccacccgatccgatccgatccgagcgtccaccatgtgggtgacgtcgatgccgcaggtttgggacgaggagggcgcggccaagggcggcgcggtgaccccggcgccggccgcggccatgctgggctcgctggcggggtggctgtcccggaccgtgcagccgcagccgccggcgccccgggtgtgcggcaccgcggggggcccgcccgtgacggcgcccaggctcaggctccgcgacggccgccacctcgcctactgcgagagcggcgtgccccgggaccaggccaggttcaccgtcgtcttctcccacggattcaccggctcccgcgaggacagcgtccgcgcctcccagaaaccgcgaatcaaggtcggtttcgatgagcccggatcataggtgcaaggcatcgaacccgtgactattctctccttgggcgtcgtcgtcgtccttgttggcgatggcaattgcagggccgcctggacagcgaccttcggtatactggtttgtcccacaggcaatggaaaaggctgggggttttggggaaacgtaaaggcctagtgcggcctacaccgggggtcggcctgcccatgggggccagggcgtccttatcgggttggggctgccgacctttcccacttcccagagggcagggcgggaggggaggagatgtggggggttcgcggatacaccgggg

SEQ ID NO: 94838 - protein, 119 aa, Zea mays
  misc_feature: Ceres CLONE 1584805
MWVTSMPQVWDEEGAAKGGAVTPAPAAAMLGSLAGWLSRTVQPQPPAPRVCGTAGGPPVTAPRLRLRDGRHLAYCESGVPRDQARFTVVFSHGFTGSREDSVRASQKPRIKVGFDEPGS

SEQ ID NO: 94839 - DNA, 849 bp, Zea mays
  misc_feature: Ceres CLONE 1584809
  misc_feature: Encodes the peptide sequence at SEQ ID NO. 94840
  misc_feature (452)..(452): n is a, c, t, g, unknown, or other
ctccccgcggtggcggccgctctagaactagtggatcccccgggctgcaggaattcgtctcacccctagaaaaaaggggcgcggcgacgacacccacaggccacagccacaggccacacgacaccaccgctcggtctcggcgtccgcctccacgcacgcttcctcccgcaggccatccacccgatccgatccgatccgagcgtccaccatgtgggtgacgtcgatgccgcaggtttgggacgaggagggcgcggccaagggcggcgcggtgaccccggcgccggccgcggccatgctgggctcgctggcggggtggctgtcccggaccgtgcagccgcagccgccggcgccccgggtgtgcggcaccgcggggggcccgcccgtgacggcgcccaggctcaggctccgcgacggccgccacctcgcctactgcgagagcggcgtgccccggngacaggccaggttcgccgtcgtcttctcccacggattcaccggctcccgcgaggacagcgtccgcgcctcccagaaaccgcgaatcaaggtcggtttcgatgagcccggatcataggtgcaaggcatcgaacccgtgactattctctccttggcgtcgtcgtcgtccttgttggcgatggcaatgttagggccgctggacagcgacctccgtatactgtttgtccacatgcaatgcaaaagctggagtttgggcgagctaacagctaggcagctacaccggggtcggctggccattgggccagggcggtctattcggattgggttggccacttccacctccccagggcaaccgggaaagggagcaattggggttccccgagacccgggtccattcgc

SEQ ID NO: 94840 - protein, 119 aa, Zea mays
  misc_feature: Ceres CLONE 1584809
  misc_feature (82)..(82): Xaa is any aa, unknown, or other
MWVTSMPQVWDEEGAAKGGAVTPAPAAAMLGSLAGWLSRTVQPQPPAPRVCGTAGGPPVTAPRLRLRDGRHLAYCESGVPRXQARFAVVFSHGFTGSREDSVRASQKPRIKVGFDEPGS

SEQ ID NO: 94841 - DNA, 833 bp, Zea mays
  misc_feature: Ceres CLONE 1584813
  misc_feature: Encodes the peptide sequence at SEQ ID NO. 94842
aaagctggagctccccgcggtggcggccgctctagaactagtggatcccccgggctgcaggaattcgtctcacccctagaaaaactctgctttccaccaccctataccaaaccagccaaagtcctctactcctccccgcctccggctccgacgtctaacattcttctccaatggcgacggcccccgcatccctctcgctctccgcctctaccctgcccacccagctccgtgccgcagcggtgctggcgggcatgcgctggacgcagccgcagcgcgggcggatggtggtgcgcgccaagatccgggagatcttcatgccggcgctgagctccaccatgacggagggcaagatcgtctcctggtccgctggagagggtgatcgcgtctccaagggtgacgccgtcgtggtcgtcgagtctgacaaggacgacatggacgttgagaccttccacgacggcatcgtggcggtggtcctcgtgcaggctggctagtcggcgccagtgggcgcgcccatcgcgctgctcgcggagtcagaggaggaggtgccgctcgctctcgccaaggctcaggagctctccaacgggcagccgcagcaagggcctcctgctccgacggaagatgccgcagcgacgccgcccccttcttcaggtcagggcactgctcccacgcccggggcccgggggtacgaagggaatttgccagcccgggacgcttagaaactgggctaagcagcaccggggtggaccctggcaaaggggactgggaaccgcggcccttatgagccaaaattccctccggcaaattgtccaaggccggctttcccggaaatccac

SEQ ID NO: 94842 - protein, 106 aa, Zea mays
  misc_feature: Ceres CLONE 1584813
  misc_feature (45)..(106): Pfam Name: Biotin_lipoyl Pfam Description: Biotin-requiring enzyme
  misc_feature: SWISSPROT Homolog: EC 1.2.4.1 Pyruvate dehydrogenase (acetyl-transferring)
MATAPASLSLSASTLPTQLRAAAVLAGMRWTQPQRGRMVVRAKIREIFMPALSSTMTEGKIVSWSAGEGDRVSKGDAVVVVESDKDDMDVETFHDGIVAVVLVQAG

SEQ ID NO: 94843 - DNA, 898 bp, Zea mays
  misc_feature: Ceres CLONE 1584815
  misc_feature: Encodes the peptide sequence at SEQ ID NO. 94844
cagagctggagctccccgcggtggcggccgctctagaactagtggatcccccgggctgcaggaattcgtctcacccctagaaaaagccacccaaaagacaccgcgatcccgtgcttccttctcgcacctgcggatctactctccgcacctgcggatctaccccccggcgaaacaagcgccccgacgcctcagggaatgcggagcgatgaggcggcgctcaggcactgacgtcgccggtcagcgcgagctgcgcggcgaccgaacctgccatcgcaagcacgtcgaggacgggtagactcgtccatccttccttcctcttgttagtggtcgtagggtagtttgcactttgcagatagctagctagctagtagttaggggatcaggcatgggtgagggcgaggcggaggtgaagggcggggtgctgcagggccgctacgagctcggccgcgtgctgggtcacggcaacttcgggcgcgtccacgcggcgcgggacctgcgcaccgggcgggccgtggcggtgaaggtgctcgacaaggacaagatgctgcgcacgggcatgatggagcagatcaagcgcgagatcgccgtcatgaagcgcgtgtcccaccccaacatcgtggagctccacgaggttatggccacgcgctccaagatctacctcgcgctggagctcgtccgcggaggggagctcttcgcgcggatcgtgcgcgccgggcgcgtcaaggagacgtggcgcggcgctacttccgggcgctcatccacgcgtggacttctgccccgcgcgggcgtgtacaccccgaactgaagctcgagaacttcctctggacgacgcggggaaacttcaagctgtcgactttggcttaacgcgcttgccgacaacccccgcactgacgggtta

SEQ ID NO: 94844 - protein, 139 aa, Zea mays
  misc_feature: Ceres CLONE 1584815
  misc_feature (17)..(139): Pfam Name: Pkinase_Tyr Pfam Description: Protein tyrosine kinase
  misc_feature: SWISSPROT Homolog: EC 2.7.11.1 Non-specific serine/threonine protein kinase
MGEGEAEVKGGVLQGRYELGRVLGHGNFGRVHAARDLRTGRAVAVKVLDKDKMLRTGMMEQIKREIAVMKRVSHPNIVELHEVMATRSKIYLALELVRGGELFARIVRAGRVKETWRGATSGRSSTRGLLPRAGVYTPN

SEQ ID NO: 94845 - DNA, 823 bp, Zea mays
  misc_feature: Ceres CLONE 1584816
  misc_feature: Translation starting site: 533
  misc_feature (570)..(570): n is a, c, t, g, unknown, or other
  misc_feature (663)..(663): n is a, c, t, g, unknown, or other
ctggagctcaccgcggtggcggccgctctagaactagtggatcccccgggctgcaggaattcgtctcacccctagaaaaacatctctggaccctggtggcctgctctgttctctgccgtcgccgataccttcgcgtgctccgcaaccgctgagtgacaagaacacatcggcctgcctgggcgatgggccggctctcccattctgtctcgggacgacatactcttgcgtccgtcttcgtcaccagcacaccgtcaagaccgtgaccgacgacccggtctcctcgccactccctcgtacgtcgtcttcgccgacgccgagcacctcatcggagatgcggcctagaaccgcttcgccgtgaactccatcatcaccgccctttgatgaccttcgtctcatcctccccacccacattgttgcgctcgctccgtacgacatctgcttgtgcccctgcgttgacagttctgggcgtgacgagaaccaagtcattgttgtcccgcacacgggttacgacaacgtcttggcagctgaagacatgtccctctacgccctgatcggcatgcttcacactcnctcagcttaccctggtcttccgatcgagagcgatgtgagccccctgcagaacctggtgtactgcactctccaaggcctggcaatacaggaagnctggggggattttccggcatttatgggccggccctttccccatgtacacggacatccggcagctcttggacctctggggaccggcaacaaaggccccccccgcgggcggccaagaaagaaggtcccggatcctttgaatccttggaaagtgcgaagccct

SEQ ID NO: 94846 - DNA, 747 bp, Zea mays
  misc_feature: Ceres CLONE 1584817
  misc_feature: Encodes the peptide sequence at SEQ ID NO. 94847
aaagctggagctccccgcggtggcggccgctctagaactagtggatcccccgggctgcaggaattcgtctcacccctagaaaaaaaatgctgccgcgcaccgtcatcactagctagtggaggggcggacgagaaggcgaggagctgaggggagagaggcttcacagagcttgcttgagcctggagggggctgccgctgtttgtctctccactccacccaccagcagttacctcgggagggcatggcaaaatctggtgcctcctttccggagtccagttggatggagagggatttcctggccgcgatcggcaaggagcagcagcacccgcacaaggaggaggcaggcgcggaggaatctgcttacttcagcggagcaggagcagcagcagcagccccggcaatggactggtccttcgctagcaagcccggcgccgccccggcgttgatgtcgttccggtcagcttcgttcccccaggtctcctccctcgacggcgcaagaacccgcccctcgatcctcacgcaccgaggtcgttcgggccccgacagacggattaggccgccgcgcaacggaaggcagaatgggcttaaacgggggctaaaattcccctccgggtcccgtcccccctttcaaccgaaaaaaaatccccaaattttcaagggggccccaaaaccctcccccctataccctttcccaaaaaaagggggaacttggcgttttttaaaaaggagaggcgcccccctcttttt

SEQ ID NO: 94847 - protein, 168 aa, Zea mays
  misc_feature: Ceres CLONE 1584817
MAKSGASFPESSWMERDFLAAIGKEQQHPHKEEAGAEESAYFSGAGAAAAAPAMDWSFASKPGAAPALMSFRSASFPQVSSLDGARTRPSILTHRGRSGPDRRIRPPRNGRQNGLKRGLKFPSGSRPPFQPKKNPQIFKGAPKPSPLYPFPKKGGTWRFLKRRGAPLF

SEQ ID NO: 94848 - DNA, 818 bp, Zea mays
  misc_feature: Ceres CLONE 1584821
  misc_feature: Encodes the peptide sequence at SEQ ID NO. 94849
ctccccgcggtggcggccgctctagaactagtggatcccccgggctgcaggaattcgtctcacccctagaaaaacatttatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatctttatggaggtcaagtaacatcatggaagaatgacaatggggaagacttgcttttcctcagcagcaaggctattttcaaacctccaaaagctattcgtggtggtataccaatctgctttccccaatttggatcacatggaaatcttgaacaacatggattcgctaggaaccggttttggactattgacaacaatccacctcctttaccattaaaccctgctattaaagcttttgttgatctgattctgaagccttctgaagaggatttaaagatctggccccacagttttgaatttcgtttgagagttgctcttggaccttctggagatttgagtctcacatcacgaatcaggaacaacaacccagatggaaagacctttctcttatacatttgcatatcacacatgacttctctgtttctgacataaagtcctgcttgatgttttctcccttttcgtc

SEQ ID NO: 94849 - protein, 175 aa, Zea mays
  misc_feature: Ceres CLONE 1584821
  misc_feature (18)..(176): Pfam Name: Aldose_epim Pfam Description: Aldose 1-epimerase
MQLPSPFAELVKGPSGLEKVVLRGARNCCAEIYLYGGQVTSWKNDNGEDLLFLSSKAIFKPPKAIRGGIPICFPQFGSHGNLEQHGFARNRFWTIDNNPPPLPLNPAIKAFVDLILKPSEEDLKIWPHSFEFRLRVALGPSGDLSLTSRIRNNNPDGKTFLLYICISHMTSLFLT

SEQ ID NO: 94850 - DNA, 960 bp, Zea mays
  misc_feature: Ceres CLONE 1584824
  misc_feature: Encodes the peptide sequence at SEQ ID NO. 94851
  misc_feature (860)..(860): n is a, c, t, g, unknown, or other
  misc_feature (907)..(907): n is a, c, t, g, unknown, or other
  misc_feature (908)..(908): n is a, c, t, g, unknown, or other
  misc_feature (911)..(911): n is a, c, t, g, unknown, or other
  misc_feature (912)..(912): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
aaagctggagctccccgcggtggcggccgctctagaactagtggatcccccgggctgcaggaattcgtctcacccctagaaaaaatcagccatccccttttgctgcaaatctttccctgaattgtgggtctccgacaatggcggcgctcgctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacagggagatctacctgccggatgggctgcttgacccatcggaggtgcccgaataccccacccgaaaaggtccttggagactatggctacaaccccttttggcctgggcaaaaacccaaaggaatttccccaaatacccgggccttccaactcgaatccttgcccaaagggggccaggctccggggccccctgggccttttctctccacagaggccttgaaaaaaatttcgggggcttaaatggggggcccctaaaggggtttctgggtgttaaaaaaaaggggggccctttttccttgtgggggggaaacccctctcccaatatttttttggggaaaaaaaatcccccctacaaaacgtggggggggggcgccgttttcccccggggtgtccttttctcctttggggggggccgcaggaaacctcccggtgctacccccaaggggtgggtgtttcttggaaaaaaaattcccccccggggggggcgcccccacaccccccgggggggtgggtggcanaacaccccacaaagaggggcgcccttcttttgggggggagtgtaaannaannannnggggcgcgggggggagaatatttctaaaggggcccccgcctaag

SEQ ID NO: 94851 - protein, 255 aa, Zea mays
  misc_feature: Ceres CLONE 1584824
  misc_feature (241)..(241): Xaa is any aa, unknown, or other
MAALAPSKILGTQLNFAGSSRYATAAPTAGAQKIVSLFSKKPAQKPKPAAVSSSSPDISDELAKWYGPDREIYLPDGLLDPSEVPEYPTRKGPWRLWLQPLLAWAKTQRNFPKYPGLPTRILAQRGPGSGAPWAFSLHRGLEKNFGGLNGGPLKGFLGVKKKGGPFSLWGGNPSPNIFLGKKNPPYKTWGGGAVFPRGVLFSFGGGRRKPPGATPKGWVFLGKKIPPRGGRPHTPRGGGWXNTPQRGAPFFWGGV

SEQ ID NO: 94852 - DNA, 1028 bp, Zea mays
  misc_feature: Ceres CLONE 1584825
  misc_feature (48)..(48): n is a, c, t, g, unknown, or other
  misc_feature (70)..(70): n is a, c, t, g, unknown, or other
  misc_feature (72)..(72): n is a, c, t, g, unknown, or other
  misc_feature (73)..(73): n is a, c, t, g, unknown, or other
  misc_feature (81)..(81): n is a, c, t, g, unknown, or other
  misc_feature (82)..(82): n is a, c, t, g, unknown, or other
  misc_feature (89)..(89): n is a, c, t, g, unknown, or other
  misc_feature (90)..(90): n is a, c, t, g, unknown, or other
  misc_feature (101)..(101): n is a, c, t, g, unknown, or other
  misc_feature (102)..(102): n is a, c, t, g, unknown, or other
  misc_feature (110)..(110): n is a, c, t, g, unknown, or other
  misc_feature (111)..(111): n is a, c, t, g, unknown, or other
  misc_feature (239)..(239): n is a, c, t, g, unknown, or other
  misc_feature (240)..(240): n is a, c, t, g, unknown, or other
  misc_feature (315)..(315): n is a, c, t, g, unknown, or other
  misc_feature (361)..(361): n is a, c, t, g, unknown, or other
  misc_feature (362)..(362): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (395)..(395): n is a, c, t, g, unknown, or other
  misc_feature (408)..(408): n is a, c, t, g, unknown, or other
  misc_feature (409)..(409): n is a, c, t, g, unknown, or other
  misc_feature (426)..(426): n is a, c, t, g, unknown, or other
  misc_feature (429)..(429): n is a, c, t, g, unknown, or other
  misc_feature (431)..(431): n is a, c, t, g, unknown, or other
  misc_feature (433)..(433): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (498)..(498): n is a, c, t, g, unknown, or other
  misc_feature (534)..(534): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (614)..(614): n is a, c, t, g, unknown, or other
  misc_feature (634)..(634): n is a, c, t, g, unknown, or other
  misc_feature (637)..(637): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (661)..(661): n is a, c, t, g, unknown, or other
  misc_feature (663)..(663): n is a, c, t, g, unknown, or other
  misc_feature (664)..(664): n is a, c, t, g, unknown, or other
  misc_feature (697)..(697): n is a, c, t, g, unknown, or other
  misc_feature (716)..(716): n is a, c, t, g, unknown, or other
  misc_feature (717)..(717): n is a, c, t, g, unknown, or other
  misc_feature (720)..(720): n is a, c, t, g, unknown, or other
  misc_feature (721)..(721): n is a, c, t, g, unknown, or other
  misc_feature (734)..(734): n is a, c, t, g, unknown, or other
  misc_feature (748)..(748): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (783)..(783): n is a, c, t, g, unknown, or other
  misc_feature (784)..(784): n is a, c, t, g, unknown, or other
  misc_feature (787)..(787): n is a, c, t, g, unknown, or other
  misc_feature (822)..(822): n is a, c, t, g, unknown, or other
  misc_feature (823)..(823): n is a, c, t, g, unknown, or other
  misc_feature (828)..(828): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (852)..(852): n is a, c, t, g, unknown, or other
  misc_feature (853)..(853): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (878)..(878): n is a, c, t, g, unknown, or other
  misc_feature (900)..(900): n is a, c, t, g, unknown, or other
  misc_feature (904)..(904): n is a, c, t, g, unknown, or other
  misc_feature (919)..(919): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (957)..(957): n is a, c, t, g, unknown, or other
  misc_feature (966)..(966): n is a, c, t, g, unknown, or other
  misc_feature (975)..(975): n is a, c, t, g, unknown, or other
  misc_feature (977)..(977): n is a, c, t, g, unknown, or other
  misc_feature (981)..(981): n is a, c, t, g, unknown, or other
  misc_feature (983)..(983): n is a, c, t, g, unknown, or other
  misc_feature (1004)..(1004): n is a, c, t, g, unknown, or other
  misc_feature (1005)..(1005): n is a, c, t, g, unknown, or other
  misc_feature (1022)..(1022): n is a, c, t, g, unknown, or other
ctggagctccccgcggtggcggccgctctagaactagtggatcccccngggctgcaggaaaaattcgtcntnncacccctnnagaaaannaatcccagcanncgtctcgnntctccctcccaaaaaaaaaaaaaaaaactgctcggttgctgctcctgctccgccgcgccggcatcatgtgtggcatcttagccgtgctcggttgctccgactggtctcaggcaaagagggctcgcatnncctcgcctgctcccagaagggttgaagcaacaggggggcccccgaacctgggtcgggggccctcttaccccaggnccaccggaaaggggggggaaaaaaaaaatttttttctctctttttnnagaaggaaaaaaaaaaaaannnnnnnaaggggnaagcgagggaggnngaccccccccccccccnccncncngnnnnnccccccccccccccccccccccttttatttcttttcaaacaaccaccccccccctcccncccctggggggggggggggggggggggtggtttttnttctctttttatattnnnaaaattnnnnntaaannnccaaaagaaaaaaaaaaaagataagcgctctttcccccttctcnccctcccccccctccccctntcnccccnnnnnnnnnnnnacgaaaancnnaagaaggggaggggtggggggggggtgggggcngcacccctctttccctatnnccnnccccccccctccnccttctaaacaacnaaaaaaaaaaaaaaacacaaaannncnnnnnnngnntgnggggtggtgtgtgggtgggtggggttgtttgtttnnttgtntgnnnnttcgtcnnnncctgacanntannntaaaatacaaaacgagcganaccgcgcgcgcctctcctcccnccgngatctccttggtttnttgtattttnnnatgttgttggatgaatgtttgtgtgntgtctgtgnataagcagnanaagncnggagcgaccgagtgaaaaggnnagacggatatctgttanatacaa

SEQ ID NO: 94853 - DNA, 850 bp, Zea mays
  misc_feature: Ceres CLONE 1584826
  misc_feature: Encodes the peptide sequence at SEQ ID NO. 94854
aaagctggagctccccgcggtggcggccgctctagaactagtggatcccccgggctgcaggaattcgtctcacccctagaaaaaaggcagagcactgcacgccaccttatctctaaccggagatcaaagaagtagccgttaacgatggcttccgacgagctcgcaaaggccgtcgagcccaggaagaagggcaacgtcaagtatgcctccatatgtgccatcctggcctccatggcctctgtcatccttggctatggtacccacgcaccctttcgtttactgtcaaaatattttcctttttttttgcttttaagagttcgtaggtgaagtttttttttgtgctgctgttcaccaacgctgtagacattggggtgatgagtggagcggccatgtacatcaagaaggacctgaatatcacggacgtgcagctggagatcctgatcgggatcctcagtctctactcgctgttcggatccttcgctggcgcgcggacgtccgacaggatcgggcgccgcttgaccgtcgtgttcgccgctgtcatcttcttcgtgggctcgttgctcatgggtttcgccgtcaactacggcatgctcatggcgggccgcttcgtggccggagtcggtgtgggctacgggggcatgatcgcgcccgtgtacacggccgagatctcgcctgcggcgtcccgtggcttcctgaccaccttcccggaggtgttcatcaacatcggcatcctgcttggctacctgtccaacttcgcgttcgcgcgcctcccgctccacctcggctggcgcgtcatgctcgccattggcgcagttcccgtcggcctgctcgcgctcctgggtgtctgcag

SEQ ID NO: 94854 - protein, 153 aa, Zea mays
  misc_feature: Ceres CLONE 1584826
MYIKKDLNITDVQLEILIGILSLYSLFGSFAGARTSDRIGRRLTVVFAAVIFFVGSLLMGFAVNYGMLMAGRFVAGVGVGYGGMIAPVYTAEISPAASRGFLTTFPEVFINIGILLGYLSNFAFARLPLHLGWRVMLAIGAVPVGLLALLGVC

SEQ ID NO: 94855 - DNA, 803 bp, Zea mays
  misc_feature: Ceres CLONE 1584827
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (252)..(252): n is a, c, t, g, unknown, or other
  misc_feature (259)..(259): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (292)..(292): n is a, c, t, g, unknown, or other
  misc_feature (293)..(293): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (305)..(305): n is a, c, t, g, unknown, or other
  misc_feature (306)..(306): n is a, c, t, g, unknown, or other
  misc_feature (310)..(310): n is a, c, t, g, unknown, or other
  misc_feature (311)..(311): n is a, c, t, g, unknown, or other
  misc_feature (328)..(328): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (342)..(342): n is a, c, t, g, unknown, or other
  misc_feature (343)..(343): n is a, c, t, g, unknown, or other
  misc_feature (345)..(345): n is a, c, t, g, unknown, or other
  misc_feature (384)..(384): n is a, c, t, g, unknown, or other
  misc_feature (385)..(385): n is a, c, t, g, unknown, or other
  misc_feature (394)..(394): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (506)..(506): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (560)..(560): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (597)..(597): n is a, c, t, g, unknown, or other
  misc_feature (598)..(598): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (608)..(608): n is a, c, t, g, unknown, or other
  misc_feature (609)..(609): n is a, c, t, g, unknown, or other
  misc_feature (631)..(631): n is a, c, t, g, unknown, or other
  misc_feature (632)..(632): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (663)..(663): n is a, c, t, g, unknown, or other
  misc_feature (664)..(664): n is a, c, t, g, unknown, or other
  misc_feature (675)..(675): n is a, c, t, g, unknown, or other
  misc_feature (677)..(677): n is a, c, t, g, unknown, or other
  misc_feature (678)..(678): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (698)..(698): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (724)..(724): n is a, c, t, g, unknown, or other
  misc_feature (726)..(726): n is a, c, t, g, unknown, or other
  misc_feature (730)..(730): n is a, c, t, g, unknown, or other
  misc_feature (733)..(733): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (748)..(748): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (762)..(762): n is a, c, t, g, unknown, or other
  misc_feature (763)..(763): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (774)..(774): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (803)..(803): n is a, c, t, g, unknown, or other
tggactccaccgcgggtggcggcccgcttctagaactagtggatcccccgggctgcaggaattcgtctcacccctagaaaaagccaccccatcctcgtcttctccattccaagtaagaaagccacacgcgaggccgaccgaggaagtccaatctcatggcgctctcctgcatgaagtgccccgcggggcgccggcgccgcccttccgcccgaaggcggcccgcaagcgccagcccgtgggcccnnnnngggngggaggnagagaaaggagagggggtccgcgcnnnnccggnncgnnnnaaaggnnaagnnagaggggaggccgcggncggggnnngnnncnncncccccccctttttttttttttttgtccccccccgggccnngaggagaanagagagtttggggggccgccgcccggnnnncccccccccgcgcggggcggggannntttttttcctttttcgnnnnnnnnnnaagggggggagggaaggattttgtgttttnttnnnnnncagggggggggcgcggacaccctcgggggggggtggggggtgtttnttnnnnaaattttattttttttttccccccccccccnnccnnnnnnannggagggggaggaggggggtttnnttttttgggagggtnnnnnnnnttgtggggnnaaggccgcccncnncnnnnnnnnnnnttgttgtntgtnnnttnnnntctctgtgcggggngntgtntcncctnnnnncccgtcncnnnncgttgccgnntccccnnnngngcccgggtggcgtcgtgcatnnnnccgtn

SEQ ID NO: 94856 - DNA, 903 bp, Zea mays
  misc_feature: Ceres CLONE 1584828
  misc_feature: Translation starting site: 290
aaagctggagctccccgcggtggcggccgctctagaactagtggatcccccgggctgcaggaattcgtctcacccctagaaaaacacttcacgttcacaagaccggaggagcccactcctgcatgtaactcagatactccacccgagagtccgcaccaactcacatcacagcttaccttccagtccagaagaagaagccagaccggaatcccgagagccctgctccctcggttcctcctccgttgggcgtttggccgccgggggtggtcaggggtgggccgagaccgagatgatatcgtggaacgatgtatacacggcgctgaccgcgatggtgcctctgtacgtgggcatgttcctggcgtactggtcggtgcggtggtggagcatcttcacggcggaccaccgctccggcatcaaccgcttcgtggccatcttcgccgtgccgctgctgtccttgcacttcagctccaccaacgacgcgtacgccatgaacctccggttcctggccgcggacacgctgcagaagctggtcgtcctcgcggggctggccgcgtgctcgcgcctgcccgtccaggctggcggcgccgcggctggactggtccatcacgctcttcaccgtgtcgacgctgcccaacacgctggtgatgggcatcccgctgctgatcgccatgtacggtccctacgccgggtccctgatggtgcaggtggtggtgcttcagtgcatgatctggtacacgctgctgctgttcctcttagaggtcgcgacgcgcggacgctcatcgcggaccgattccggacaccgcggcgggcatctggtcactgcactgggaaccggacgtgtggtccctggagggccggccgccccaagacggagtccaagttggcggaggacgcgcagctgca

SEQ ID NO: 94857 - DNA, 878 bp, Zea mays
  misc_feature: Ceres CLONE 1584831
  misc_feature: Encodes the peptide sequence at SEQ ID NO. 94858
ctggagctccccgcggtggcggccgctctagaactagtggatcccccgggctgcaggaattcgtctcacccctagaaaaactcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaagggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaggacagcctggcgttccagtcgcgtctgctgggcaagtccggcatcggcgacgagtcgtacagccggcgctgcgtgttcgagcccacggcagctgcgccacccatgaaggagggcgccgccaaggcgtccaacggcatgttcgcggggcctggaccactgttccaaaaagggcccggtcgggcccaaggacctggggccttccgggggccaactggcacctt

SEQ ID NO: 94858 - protein, 113 aa, Zea mays
  misc_feature: Ceres CLONE 1584831
  misc_feature (1)..(113): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MSRPRPVYLIDFACYKPADELKVSKAEFIDLARKSGKFDEDSLAFQSRLLGKSGIGDESYSRRCVFEPTAAAPPMKEGAAKASNGMFAGPGPLFQKGPGRAQGPGAFRGPTGT

SEQ ID NO: 94859 - DNA, 1063 bp, Zea mays
  misc_feature: Ceres CLONE 1584833
  misc_feature: Encodes the peptide sequence at SEQ ID NO. 94860
  misc_feature (957)..(957): n is a, c, t, g, unknown, or other
tggagctcaccgcggtggcggccgctctagaactagtggatcccccgggctgcaggaattcgtctcacccctagaaaaaatcatttaagcaggaggttgctgtctggcatgagctcaaccagcccactccagcgctgaaggcctgcagcgccagcgcagcgcctctctgctactgtgctggctgacgccggtggggtgtgagccaactgcgagctgctgccacccctgctgccgcggtcgaccgccggccccggaccgagatggacgctcggtgggcggtgctgctcgcgctgctggtcgccagcggcggcgtccgtgtctgcgccgccgctggggccaagggcgccaactggctgggcgggctgagccgcgcgtcgttccccaaggggttcgtgttcgggacagccacgtcggcgtaccaggtcgagggcgccgcgtcccaccaacggccgggggcccctcccatctggagattcattccgcgcacgttcccagggaaaatatttgggaggggaatcaaaaaatgggagaacttttgcaagtgggaatcaattaacatttcggctttcctagggtaaagacctctccgaatctccactggaaaaaaggttttgaaaacctttggaaatgggccttaacccgggtgttcctccagatttcttcggttggggcgcaccaagtggaatcatttttccccccgggaaagtgtggcaaaaaaggggataaaaagtccacaacatccccgagaaaaagggagggcatagagccgttattttaaccaaaaaataaatttttgaaaataaaaaacgtaatcttgggcgggttgcgagccaaaagggcgatgttggtccaccccctttaacactcgcaaacccgttgtaacaccccatgtacaggaatccctttcaccctctatgtaggtggcctctttagcgattttatatatcttaagcaggngggtggggtttaataaaccctctcgacaaatagtggggtgcggaaatctgtgttcttcaaccaatcacaattcggcgcggagaccataacgtagataaaataaaaa

SEQ ID NO: 94860 - protein, 105 aa, Zea mays
  misc_feature: Ceres CLONE 1584833
  misc_feature: SWISSPROT Homolog: EC 3.2.1.21 Beta-glucosidase
MDARWAVLLALLVASGGVRVCAAAGAKGANWLGGLSRASFPKGFVFGTATSAYQVEGAASHQRPGAPPIWRFIPRTFPGKIFGRGIKKWENFCKWESINISAFLG

SEQ ID NO: 94861 - DNA, 694 bp, Zea mays
  misc_feature: Ceres CLONE 1584836
  misc_feature: Encodes the peptide sequence at SEQ ID NO. 94862
  misc_feature (192)..(192): n is a, c, t, g, unknown, or other
  misc_feature (625)..(625): n is a, c, t, g, unknown, or other
  misc_feature (626)..(626): n is a, c, t, g, unknown, or other
  misc_feature (628)..(628): n is a, c, t, g, unknown, or other
  misc_feature (629)..(629): n is a, c, t, g, unknown, or other
  misc_feature (651)..(651): n is a, c, t, g, unknown, or other
  misc_feature (652)..(652): n is a, c, t, g, unknown, or other
tggagctccccgcggtggcggccgctctagactagtggatcccccgggctgcatgaattcgtctcacccctagaaaaactccgatcgcccgaccgatcgccgagcttccccgttccctccctgccccccgcgacgccgcgacgccatggagctgccgcacgccagagcaggacggtctgctcgctgtatcancagcgagggagaaggggcttgcattccccaaaaagcccggggggacaactgttcccttttaaaaggggccccgggtgtttaaacccgggggggctctaaacccgggggggggaaaaaggaaaaatcgggttatttttttgtttggggaaaaaaaacccggaacccccaaccccctgatattttttccctccgtggggcccaaaatggggggggggaaaaaaggggggccccggtgggacctctgttgagtttcccgggggggggggtttttttttcctttttttaaaaacccgccccccccaaaaaaaaggggggggggggaaacacctttttttttgggggggggggggggcccaaaaagggagggtttttttcttccccccccccccttttttttttttattttaaaagaagagggggccccccccccccnncnncccccttttttttttttttttnntaaaaagttgtggggggagggagaggggcccccccccttttc

SEQ ID NO: 94862 - protein, 42 aa, Zea mays
  misc_feature: Ceres CLONE 1584836
  misc_feature (16)..(16): Xaa is any aa, unknown, or other
MELPHARAGRSARCIXSEGEGACIPQKARGDNCSLLKGAPGV

SEQ ID NO: 94863 - DNA, 854 bp, Zea mays
  misc_feature: Ceres CLONE 1584837
  misc_feature: Encodes the peptide sequence at SEQ ID NO. 94864
aaagctggagctccccgcggtggcggccgctctagaactagtggatcccccgggctgcaggaattcgtctcacccctagaaaaaactcccatcgagcagccgatggagcatctttcctggcttctctcctctcactctcgactcgtgctgcgcttgctacttcgcttcgcataccattccatgacagctgtgagaggggaagaaagagcgagatgttcatcgagagcttccgcgtcgagagccgccacgtgctgaaccgcccgacggacatcgagtcggaataccagtacgacacgatggagctggtacacgagggcaaggaccgcgcctcacactgggtcgtccaccccaagtccgtctagtacaacttccggaccagaaccgccgtccccagagctccgcctcatgcttgttgggtggggaggcaacaacaggtccactctgacagctggggtcattgccaacacggaggggatctcatgggccaccgacgacaatgtgtcccaagctaactactacggttccctcagtcaggcctctaccatcagagtctgcagctataacggggaggagatctatgcgccgttcgagagcctccttcccatggtgaacccacacgacattgtggtcagaggctggcacattagctacatgaatctggacgactccatggacagtgccaaggtgctggatattgacctgtctgagcgtctcaggccctacatgaagtccatggtgccactccccggtatctatggtccggacttcatcgcggttaaccaaggctcttgcggcaaagatgtcatcaggggcccgaaaaaaaaacagggggagccgatcatccagggatatcg

SEQ ID NO: 94864 - protein, 149 aa, Zea mays
  misc_feature: Ceres CLONE 1584837
  misc_feature (1)..(149): Pfam Name: NAD_binding_5 Pfam Description: Myo-inositol-1-phosphate synthase
  misc_feature: SWISSPROT Homolog: EC 5.5.1.4 Inositol-3-phosphate synthase
MLVGWGGNNRSTLTAGVIANTEGISWATDDNVSQANYYGSLSQASTIRVCSYNGEEIYAPFESLLPMVNPHDIVVRGWHISYMNLDDSMDSAKVLDIDLSERLRPYMKSMVPLPGIYGPDFIAVNQGSCGKDVIRGPKKKQGEPIIQGY

SEQ ID NO: 94865 - DNA, 825 bp, Zea mays
  misc_feature: Ceres CLONE 1584838
  misc_feature: Encodes the peptide sequence at SEQ ID NO. 94866
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
atagctggagctcaccgcggtggcggccgctctagaactagtggatcccccgggctgcaggaattcgtctcacccctagaaaaactcgcttccctcccccacgtcgcgtccgatcggcgacggtgcgccatgtcgatgctggacaccttcttcagcaagggcggcggcggcggcggcggcggcttccgcggcgccaagtgcaagacgctgctgaagctgtcgatcccgcggataaagctgctgcggaaccggcgggagctgcagctgcgccagatgcgccgggacatcgccaagctcctagaggccggccaggaggccactgcccggatcagggtggagcacatcatccgggaggagaacatgatggccgcgcaggagatcctcgagctcttctgcgagctcatcgcggttcgcctgcccatcatcgaggcccaaaaggagtgtcctattgatctcaaagaagcaatatcaagtgtctgttttgccgctccaagatgtgcagatctacctgaactgatgcaagttcaaatgatgtttgcaactaaatatgggaaggaatttgtcgctgcagcttcagagttgatgcctgattgtggggtcaatcgtcagataattgaattgctttctattcgtcctcctcctgttgatgcaaagttgaaactgctgaaggagatagttgagggacatgaagttgattgggatccatcagagacagagacagaatttctcaaaccctcatggagaatctattggaatggaccggacctacttcaatggggtcacctcagattaagannnnnnnnnnnnnnnnnnnnnnnnnnnnna

SEQ ID NO: 94866 - protein, 222 aa, Zea mays
  misc_feature: Ceres CLONE 1584838
  misc_feature (30)..(151): Pfam Name: DUF292 Pfam Description: Eukaryotic protein of unknown function, DUF292
MSMLDTFFSKGGGGGGGGFRGAKCKTLLKLSIPRIKLLRNRRELQLRQMRRDIAKLLEAGQEATARIRVEHIIREENMMAAQEILELFCELIAVRLPIIEAQKECPIDLKEAISSVCFAAPRCADLPELMQVQMMFATKYGKEFVAAASELMPDCGVNRQIIELLSIRPPPVDAKLKLLKEIVEGHEVDWDPSETETEFLKPSWRIYWNGPDLLQWGHLRLR

SEQ ID NO: 94867 - DNA, 759 bp, Zea mays
  misc_feature: Ceres CLONE 1584839
  misc_feature: Encodes the peptide sequence at SEQ ID NO. 94868
  misc_feature (700)..(700): n is a, c, t, g, unknown, or other
gagctccccgcggtggcggccgctctagaactagtggatcccccgggctgcaggaattcgtctcacccctagaaaaaataaacccctgcaggttcttgtaccatcaaaatctgaagcgcagaaacaggcttccctaactggcagcgcaagcactcaggtcgtttcggtatcaaggcccttgagtgccccgcaagtccctgcagcaaaacaaagtgtgccagccacaacagctcagaacgcacctcttctttctcgctcagtgagtgctgttgggcggttaggaaatgagccctccgccaatgctcctagcttcattccccggtcacgaacctatcgcaatgccatgatggagaaaagttctggtggcgtaagcagtctcacacatcagcaaggttcatctgagcaggccgtcgcaccatcccaatcgatgtttacatcgcagccttccattctgtcatcggagaccttgtctatgaaagaggaaacgtcgttgagacctgggtttacatttggaaccgtaaagcccgagtcactgaacccttaccagggcagagaagagaactcactgcaagcgagcagcagcagcagcagtgactgtacgccatcgagttcgaacatcagaagtgagatcgcgaagctcagtttgaacggaagatcacggagcaagcaactcctgtctgaaatctctaccagatttacntcctaccagccacaaggcttggtagctgacgaagtcccacacctggacatcatcaacga

SEQ ID NO: 94868 - protein, 138 aa, Zea mays
  misc_feature: Ceres CLONE 1584839
MMEKSSGGVSSLTHQQGSSEQAVAPSQSMFTSQPSILSSETLSMKEETSLRPGFTFGTVKPESLNPYQGREENSLQASSSSSSDCTPSSSNIRSEIAKLSLNGRSRSKQLLSEISTRFTSYQPQGLVADEVPHLDIIN

SEQ ID NO: 94869 - DNA, 1203 bp, Zea mays
  misc_feature: Ceres CLONE 1584841
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (1181)..(1181): n is a, c, t, g, unknown, or other
ccctttttttccctccttcccccccttttattannannccccaaagtgtgagagggtccattttnnntnnnnnnnnaaaaactggagctcccctcggtggcggccgctctagaatagtggatcccccgggctgcaggaattcgtctcacccctagaaaaaagcttccagcttccaacctcaatcctcctgcaccagggtgtcagagcgtgctccgaatcccccgccaagaaacgcgagagcctccatcacagctctgctgaggcctctcaattctgcgctcgttaagcgcccgcagctttaattactgtgtatatatatataatactacgggatctatccctccctcatatcgtcctcctgctcctggcgcagcacgcaggcaggtggagttctcaacgtgccaaagactggagcacccgcttccggcgtctctataaacaagaccgcccggccatttggtcttgctcatctctgttctcccccccctgccctgcttgcggctggactctctcttcggccgagatccgaggaggaaggagggacgctaaaggcgagggcattcccctgaaccttacggaacgggcgggccaatggggggaacatccaggccgtcccgggagaaaaataaccccccgcccgaagaaaggggtacttaggtaacgtccaagggaaacccccgccctcgcggagaaaaagtggccactttccgaaccacgaacttgaggggctttccaccacggatattccacccctttccgtgttcctggcgtgggaaaataagcaccccctatagagggtgggcgttgtggggttaatactctctcacgatacccattattcacacgcataacagaggtgtcgatcgcgcaaacccccttatggtgtattacgtgcgccgtaacacctattgctactaggcactcacaaaagacctctttgggggccggtgtacaaacgcgccattgggtctaaccgcaaaccttttggggagactatgggggagagcacatttgtgggcgcactcacacaactcgcataccacctctgtgtccgcgtatgctatctcatgtgggaggtctatattcaccacaccattttgtacaacatacgcattgttcgggagtgtcagatataggcggtggtggcacatgtgtccaccgaaggaataaattcgctgcgntccgggggggaatatccggcgt

SEQ ID NO: 94870 - DNA, 882 bp, Zea mays
  misc_feature: Ceres CLONE 1584842
  misc_feature: Encodes the peptide sequence at SEQ ID NO. 94871
  misc_feature (587)..(587): n is a, c, t, g, unknown, or other
  misc_feature (588)..(588): n is a, c, t, g, unknown, or other
  misc_feature (740)..(740): n is a, c, t, g, unknown, or other
  misc_feature (744)..(744): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (780)..(780): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (812)..(812): n is a, c, t, g, unknown, or other
ctccccgcggtggcggccgctctagaactagtggatcccccgggctgcaggaattcgtctcacccctagaaaaaatatgacagaaaaaaaaaatagtagagaaaaaaaaaacccgagagaagcaaaagtcactttcgaaggtttagttacggaagccctacccaacggaatgttccgcgttcgcctagagaatgacacgatcatcctgggctatatttcaggaaagatccggtctagttctatacgaatactgatgggggatagggtcaaaattgaaataagtcgttatgattccagcaaaggtcgtataatttatagacttccccataaggattcgaagcgtaccgaagactcgaaggatactgaagatttgaaggataccaaagattcaaaggattaggttttttctgggggtaataaacttcccaagtttttccaaaatttttaagggggaaaaagagccttttttttttttttcccaaaaaaaaaaaaaaatccccccccgtttttataaaaagagagaaaaacccccccccctttttttaaaaaaaaaaaaaaaaaaacaaaacccccctccccctctcccnnaaaaaaattttttttttaaaaaaaaaaaagggggggggcgtttttttttttttctccttccgggggggggggggggggggggaaaaaaaaaaaaaaaaaaaaaaaaaattttttttttttttttttttttttccccccccccccccccggcngggnggnnncaaaaaaaaaaaaaaaannnnnnnnnnnggnggggggggggggggggggggtgttgnnnnccnggtttttttctttcttctctttcgaataaacaaaaaaagaagagaaacaaaccttctctttctttcttct

SEQ ID NO: 94871 - protein, 107 aa, Zea mays
  misc_feature: Ceres CLONE 1584842
  misc_feature (16)..(81): Pfam Name: eIF-1a Pfam Description: Translation initiation factor 1A / IF-1
MTEKKNSREKKNPREAKVTFEGLVTEALPNGMFRVRLENDTIILGYISGKIRSSSIRILMGDRVKIEISRYDSSKGRIIYRLPHKDSKRTEDSKDTEDLKDTKDSKD

SEQ ID NO: 94872 - DNA, 1057 bp, Zea mays
  misc_feature: Ceres CLONE 1584844
  misc_feature (297)..(297): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (711)..(711): n is a, c, t, g, unknown, or other
  misc_feature (715)..(715): n is a, c, t, g, unknown, or other
  misc_feature (718)..(718): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (726)..(726): n is a, c, t, g, unknown, or other
  misc_feature (730)..(730): n is a, c, t, g, unknown, or other
  misc_feature (732)..(732): n is a, c, t, g, unknown, or other
  misc_feature (735)..(735): n is a, c, t, g, unknown, or other
  misc_feature (737)..(737): n is a, c, t, g, unknown, or other
  misc_feature (738)..(738): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (793)..(793): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (868)..(868): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (876)..(876): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (885)..(885): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (924)..(924): n is a, c, t, g, unknown, or other
  misc_feature (925)..(925): n is a, c, t, g, unknown, or other
  misc_feature (928)..(928): n is a, c, t, g, unknown, or other
  misc_feature (929)..(929): n is a, c, t, g, unknown, or other
  misc_feature (931)..(931): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (962)..(962): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
  misc_feature (971)..(971): n is a, c, t, g, unknown, or other
  misc_feature (972)..(972): n is a, c, t, g, unknown, or other
  misc_feature (973)..(973): n is a, c, t, g, unknown, or other
  misc_feature (974)..(974): n is a, c, t, g, unknown, or other
  misc_feature (975)..(975): n is a, c, t, g, unknown, or other
  misc_feature (976)..(976): n is a, c, t, g, unknown, or other
  misc_feature (977)..(977): n is a, c, t, g, unknown, or other
  misc_feature (978)..(978): n is a, c, t, g, unknown, or other
  misc_feature (979)..(979): n is a, c, t, g, unknown, or other
  misc_feature (980)..(980): n is a, c, t, g, unknown, or other
  misc_feature (981)..(981): n is a, c, t, g, unknown, or other
  misc_feature (982)..(982): n is a, c, t, g, unknown, or other
  misc_feature (983)..(983): n is a, c, t, g, unknown, or other
  misc_feature (984)..(984): n is a, c, t, g, unknown, or other
  misc_feature (985)..(985): n is a, c, t, g, unknown, or other
  misc_feature (986)..(986): n is a, c, t, g, unknown, or other
  misc_feature (987)..(987): n is a, c, t, g, unknown, or other
  misc_feature (988)..(988): n is a, c, t, g, unknown, or other
  misc_feature (989)..(989): n is a, c, t, g, unknown, or other
  misc_feature (991)..(991): n is a, c, t, g, unknown, or other
  misc_feature (993)..(993): n is a, c, t, g, unknown, or other
  misc_feature (996)..(996): n is a, c, t, g, unknown, or other
  misc_feature (997)..(997): n is a, c, t, g, unknown, or other
  misc_feature (998)..(998): n is a, c, t, g, unknown, or other
  misc_feature (999)..(999): n is a, c, t, g, unknown, or other
  misc_feature (1000)..(1000): n is a, c, t, g, unknown, or other
  misc_feature (1001)..(1001): n is a, c, t, g, unknown, or other
  misc_feature (1002)..(1002): n is a, c, t, g, unknown, or other
  misc_feature (1003)..(1003): n is a, c, t, g, unknown, or other
  misc_feature (1011)..(1011): n is a, c, t, g, unknown, or other
  misc_feature (1013)..(1013): n is a, c, t, g, unknown, or other
  misc_feature (1014)..(1014): n is a, c, t, g, unknown, or other
  misc_feature (1015)..(1015): n is a, c, t, g, unknown, or other
  misc_feature (1035)..(1035): n is a, c, t, g, unknown, or other
  misc_feature (1036)..(1036): n is a, c, t, g, unknown, or other
  misc_feature (1037)..(1037): n is a, c, t, g, unknown, or other
  misc_feature (1038)..(1038): n is a, c, t, g, unknown, or other
  misc_feature (1039)..(1039): n is a, c, t, g, unknown, or other
  misc_feature (1040)..(1040): n is a, c, t, g, unknown, or other
  misc_feature (1041)..(1041): n is a, c, t, g, unknown, or other
  misc_feature (1042)..(1042): n is a, c, t, g, unknown, or other
  misc_feature (1043)..(1043): n is a, c, t, g, unknown, or other
  misc_feature (1044)..(1044): n is a, c, t, g, unknown, or other
  misc_feature (1045)..(1045): n is a, c, t, g, unknown, or other
  misc_feature (1046)..(1046): n is a, c, t, g, unknown, or other
  misc_feature (1047)..(1047): n is a, c, t, g, unknown, or other
  misc_feature (1048)..(1048): n is a, c, t, g, unknown, or other
  misc_feature (1049)..(1049): n is a, c, t, g, unknown, or other
  misc_feature (1050)..(1050): n is a, c, t, g, unknown, or other
  misc_feature (1051)..(1051): n is a, c, t, g, unknown, or other
aaagctggagctccccgcggtggcggccgctctagaactagtggatcccccgggctgcaggaattcgtctcacccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctccntcgtctcgtcttcttcctctcgattcccatacgtaccagtagttttaatttaggtagtagtaattgtagtagcaatctccttgtaactgcgctcgccttttgcggggtccccgccccttttgggcttttcccgtcccccttttccccaaaatctcccctttattctttctccttccccgggaaaaacccgggcggggggtttggaacccccaaggcagtggnnnnnnnnnnnnnnnnnnnnnnnnnccccaaacccctatgggaggggtgggggggggggccccccccccccctattttttaatacccgggggggggtttttttgggggggtgtgaaaaaagtccccgggcgccccccccccatattttttttttaaagtgnnnnnnnnnnnnnnnnnnnnnnnnattattttntttnttntnnnnntntttntnttntnntttttnnnnnnnnnnnnnnnnnnnnnnnnnnaaaaatattataataagaaaactntttctaggnnnnnnnnngggggggctgagagagaaaaacaccccccgcccgccccccaaaaaaaaacctcctccngnnnnncnccccnnncnccccacaggacgaaagccggggnnnntgtctgagagagnnggnngngggggggggggggagtccnnnnnnnnggggnggnnnnnnnnnnnnnnnnnnnnnnnnnangngannnnnnnnagagaggngnnngggggggggggtgagtgggnnnnnnnnnnnnnnnnnaacagg

SEQ ID NO: 94873 - DNA, 830 bp, Zea mays
  misc_feature: Ceres CLONE 1584847
  misc_feature: Encodes the peptide sequence at SEQ ID NO. 94874
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
ctggagctccccgcggtggcggccgctctagaactagtggatcccccgggctgcaggaattcgtctcacccctagaaaaaaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctggtgggccttgtggtgcgtcgtcgccgctttcgtcctcatcggcctccccatcatcatcgccaagtccatcccgcacaagaagccaggcccgccgccgccagatcagtacacagaggcgctgcacaaggcgctcctcttcttcaacgcccagaaatccggccaccttcccaagaacaatggcatcaagtggcgcgggaactctggcctgtcagacggctccgacgccaaggacgtcaagggtggcctcgtcggcggctactacgacgctggcgacaacatcaagttccacttcccgatggccttctccatgacgctgctgagctggtcggtgatcgagtacagcgccaagtacaaggccatgggggagtatgaccatgtcagggagctcatcaagtggggcaccgactatctgctactcaccttcaactcctctgctcttactnnnnnnnnnnnnnnnnnnnnnnnnnnnnnnnnnnnnnnnnnnnnnnnnnnnnnnnnt

SEQ ID NO: 94874 - protein, 222 aa, Zea mays
  misc_feature: Ceres CLONE 1584847
  misc_feature: SWISSPROT Homolog: EC 3.2.1.4 Cellulase
MYSANHWGGSFEIADGAAEDDHSRNMDLDRGALSARQHHELDETQQSWLLGPPEAKKKDKYVDLGCVVVKRKLLWWALWCVVAAFVLIGLPIIIAKSIPHKKPGPPPPDQYTEALHKALLFFNAQKSGHLPKNNGIKWRGNSGLSDGSDAKDVKGGLVGGYYDAGDNIKFHFPMAFSMTLLSWSVIEYSAKYKAMGEYDHVRELIKWGTDYLLLTFNSSALT

SEQ ID NO: 94875 - DNA, 819 bp, Zea mays
  misc_feature: Ceres CLONE 1584848
  misc_feature (819)..(819): n is a, c, t, g, unknown, or other
ctggagctccccgcggtggcggccgctctagaactagtggatcccccgggctgcaggaattcgtctcacccctagaaaaattcttccgctgttctctctcgcgcaaatttttatgctgggcaaagacggtgttcttcagcttcgaccccccaaaagggcgaagctttcgcgtccttccccacacacacacaattacacaaatacctgggagccgtagcttttgtttggtgcggccacgaggtggaagaaatggtatgcgggatgctcgccaattggcatgctgcgctttccgtccctgcagccgcaagaggccttctcttttagatctgtgccgcgccttcctcttcctggtaccctgtgattggagccagtattgttagcgtttaatgaagctgcttttttctagccggcttttggatggtgcttactactacatcgtatcagttgccaccactctcgcgtgcttttgccttctttaggtttgctcgcagggcacacaaagccatttttactgctggaagactgccgcttttagtatctctgggctctggctcttgagtgatctccaaggtaagctgcccccccgcactcgcttggaagaaatggaaataaataaataaataatgctttggctctccgttggagaggggcgaggaattagcttccccgcatccttcggtggtttctgatgtcttggttagaaaattttatgaggttgcttgataagaatcgcattttccttctatctgatctctcaaaatggtcgcttatctcttgtttttgcttgcctcagtctacttgcaagatctgtgttcagtn

SEQ ID NO: 94876 - DNA, 745 bp, Zea mays
  misc_feature: Ceres CLONE 1584856
  misc_feature: Encodes the peptide sequence at SEQ ID NO. 94877
  misc_feature (557)..(557): n is a, c, t, g, unknown, or other
  misc_feature (666)..(666): n is a, c, t, g, unknown, or other
  misc_feature (671)..(671): n is a, c, t, g, unknown, or other
  misc_feature (673)..(673): n is a, c, t, g, unknown, or other
  misc_feature (674)..(674): n is a, c, t, g, unknown, or other
  misc_feature (676)..(676): n is a, c, t, g, unknown, or other
  misc_feature (677)..(677): n is a, c, t, g, unknown, or other
  misc_feature (694)..(694): n is a, c, t, g, unknown, or other
  misc_feature (716)..(716): n is a, c, t, g, unknown, or other
  misc_feature (719)..(719): n is a, c, t, g, unknown, or other
  misc_feature (721)..(721): n is a, c, t, g, unknown, or other
ctggagctccccgcggtggcggccgctctagaactagtggatcccccgggctgcaggaattcgtctcacccctagaaaaaagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacgggggagggcagcgcgctccccgcgtcgtgctgcagcggcgtcaagagcctcaacagcgcggcgccgtaccagcgccggaccgccaggggggcgtgccgctgcctaagaaacctcgcccaacaggttcaaagagcgtcaaacttggggcaccggtgggccccccattcccccgggaaaaggggggggggttccccccgggggggaaatttcccccccattaaaaaggggtgtgtcccccccccccaaggtgttggggggggnaaaaaaaaaaaaaaaaaacaccccccccccccccaaatatttttttttttttttttggggggccccccccccccccccacaccttttggagatttttattaaaaaaagnggggngnnannccccccccccccccccnaccaaaaaaaaaaaaagaaaanaantnaaaaaaaacacccaaaaaacacct

SEQ ID NO: 94877 - protein, 169 aa, Zea mays
  misc_feature: Ceres CLONE 1584856
MAAVLNSRKTAQAVVAVLVAAALLASSTSAAITCGQVGSSLAPCIPYATGEGSALPASCCSGVKSLNSAAPYQRRTARGACRCLRNLAQQVQRASNLGHRWAPHSPGKRGGGSPRGGNFPPIKKGCVPPPQGVGGGKKKKKKHPPPPQIFFFFFLGGPPPPPTPFGDFY

SEQ ID NO: 94878 - DNA, 826 bp, Zea mays
  misc_feature: Ceres CLONE 1584857
  misc_feature: Encodes the peptide sequence at SEQ ID NO. 94879
  misc_feature (437)..(437): n is a, c, t, g, unknown, or other
ctccccgcggtggcggccgctctagaactagtggatcccccgggctgcaggaattcgtctcacccctagaaaaaacctagaaaaaacccttcatccaccagccgctcctcgagcacccccgtcccgcgccgcctccggctccggcgagatgtcacgcttcggtcgatccggcccgccgccgccgatccgcgacacgtactcactcctcgtcctcaacatcaccttccgcacaactgctgatgacctcttccctctcttcgacaagtacggcgagattgtcgacatctacatcccaagggaccgccggactggtgactcgcgcggattcgcgttcgtgaggtacaagtacgaggacgagggcacagaagcagttgaaaggctcgatgggagattggtagacggggagggagatcatggtgcagtttgccaagtacggnccaaatgctgaacgggattaataaaggaagaatagtgggagccagttcaagaaccagggggggcgtcccaggagtcacagtccaagacggaggtacccgggatgaatttccgaattgacctgatagagatttttagaaggccaaattccttacccggattggaaataaaacccccccgggaccggtacagggaaaggggtttccccgccttcttaacccgagtgcaacttcacggcccgaagtatccaaaaaacgggggaaaaaaaattttgcccccgaaggaaaaaaccccctttttaaaccccgttcctgtatatttacaaaagggggggggaaaaaaagggcctcccccccaagagagaaaggccctttgtctcccccccctccgg

SEQ ID NO: 94879 - protein, 99 aa, Zea mays
  misc_feature: Ceres CLONE 1584857
  misc_feature (19)..(90): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (97)..(97): Xaa is any aa, unknown, or other
MSRFGRSGPPPPIRDTYSLLVLNITFRTTADDLFPLFDKYGEIVDIYIPRDRRTGDSRGFAFVRYKYEDEGTEAVERLDGRLVDGEGDHGAVCQVRXKC

SEQ ID NO: 94880 - DNA, 801 bp, Zea mays
  misc_feature: Ceres CLONE 1584860
  misc_feature: Encodes the peptide sequence at SEQ ID NO. 94881
aaagctggagctccccgcggtggcggccgctctagaactagtggatcccccgggctgcaggaattcgtctcatccctagaaaaatgtgtctgcctgcctgcctgccactgatgctagctgttccttgaaagaactcagacgacgacgacgacgatctacgtcgtgtacatgggcgagaagaagcacgacgacccttccctcgtcgtggcgtcgcaccacgccacgctggcctccgttcttgggagcaaggatgaagcactcagctccatagtctacagctacaagcacggattctccggtttcgcggcgaagctcacccagccccaagcggaggagcttaaaaaataccctggagttgtgagcgtgaagccaaacacgtaccaccacgtccacacgactcggagctgggattttcttggcatgagctacggccaacagcagtcgtcgtcgtggtcgtcgtcgtcgcggctccttaggaaggccaagtacggcgaagatgtcatcgtcggcgtcatagactcaggcatctggccggaatcccggagcttcgacgacagcgggtacggctacggccccgtgccgaaacggtggaaaagcgtgtgccagacaggccaggcgttcaacgcgagcaactggcaacgggaaggtcatcgggcgcgcggtgggttacgccgccgaacttcggcgaagagggacctcagaaacgaatacagggtcgccacgggacgccaacgggccagggaacgccaacggccctccccgatccgccggtttcccccggggcgggaacccgaggccacc

SEQ ID NO: 94881 - protein, 211 aa, Zea mays
  misc_feature: Ceres CLONE 1584860
  misc_feature (1)..(75): Pfam Name: Subtilisin_N Pfam Description: Subtilisin N-terminal Region
  misc_feature: SWISSPROT Homolog: EC 3.4.21.25 Cucumisin
MGEKKHDDPSLVVASHHATLASVLGSKDEALSSIVYSYKHGFSGFAAKLTQPQAEELKKYPGVVSVKPNTYHHVHTTRSWDFLGMSYGQQQSSSWSSSSRLLRKAKYGEDVIVGVIDSGIWPESRSFDDSGYGYGPVPKRWKSVCQTGQAFNASNWQREGHRARGGLRRRTSAKRDLRNEYRVATGRQRARERQRPSPIRRFPPGREPEAT

SEQ ID NO: 94882 - DNA, 873 bp, Zea mays
  misc_feature: Ceres CLONE 1584861
  misc_feature: Encodes the peptide sequence at SEQ ID NO. 94883
ctggagctccccgcggtggcggccgctctagaactagtggatcccccgggctgcaggaattcgtctcacccctagaaaaaagcggcccgtggagcggacagctgagcgagcaagcctgcgcccttccgaagtagaagctgttctgatccacagctctcgattccggaaggagttggtcaagaactggggatcctgagttgaatatgatatcaaatccggtggactggtatagtttcggacccggatagaattggtagggatgccagattggagggtgcgtgagtttgaaggtaaattcactgatgagtttgcccacagtaacaacaacaaacatgaaagtggagttgaggctcctggtgtcactagtagtaagaagttgaagcatacagttgccggtgagaaaattcaaggtgtcatccctggaataaatagctcagatccacagaaatgtaattcagagaacatccaacatgagaacaggatagtatcccagaatataaacagtgctggtgactgcattggagactgcaaagacagctccaacgccttctctttcagggaagaaaatacaatcgctgaaaacagatgtccaacggatgactgggaactcctgtcagtttgcactggagcaatggttcatcccttcctcaatacccacggggctcccaaggaaagccctcccttttgggaaataatggttctaaacttcctttggttggccctgggccttgacaatttttgagggatggtaaacccttttttccgggaatctcgtttccccatattaatcccccaccccccggggaaaaaaacaaagggggggtacctggggcttccccttccccaaaaagggggtgttaacccccccggaag

SEQ ID NO: 94883 - protein, 160 aa, Zea mays
  misc_feature: Ceres CLONE 1584861
MPDWRVREFEGKFTDEFAHSNNNKHESGVEAPGVTSSKKLKHTVAGEKIQGVIPGINSSDPQKCNSENIQHENRIVSQNINSAGDCIGDCKDSSNAFSFREENTIAENRCPTDDWELLSVCTGAMVHPFLNTHGAPKESPPFWEIMVLNFLWLALGLDNF

SEQ ID NO: 94884 - DNA, 1135 bp, Zea mays
  misc_feature: Ceres CLONE 1584862
  misc_feature: Encodes the peptide sequence at SEQ ID NO. 94885
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (74)..(74): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (93)..(93): n is a, c, t, g, unknown, or other
gggggggggtnnnggnngggngnngctgggggcggcggcggggtttcaaaagtaaaaaggacgatatattcaantttttttttttnnnnnttntaaagctgggactccccgcggtggcggccgctctagaatagtggatcccccgggctgcaggaattcgtctcatccctagaaaaaagtgtctgcctgcctgcctgccactgatgctagctgttccttgaaagaactctcacgaccacgacgacgatctacttcgtgtacatgggcgagaagaaggacgacgactcttccctcgtcgaggcgtcgcaccacgccacgctggcctccgttcttggcagcaaggatgaatcactcagctccatagtctacagctacaagcactgattctccggttttcgggccaagctcacccatcccccagcggaggagcttaaaaaataccctgcatttgtgagcgtgaagccccaactcgtaccaacaccgttccacccgaccccaaagccggggattttttcttggggatggagctaagcggccaaacagaagatccttccgtccgtggttacgttccttcgttcccccggctttcccttttgatagtaagccatagttttgcgcccaaaaaaatgttttatttcctccgggggttctttttaaacccctcggggaaatcttttgggccccggaaatatccccccgaaaactttctccaaacaaaaacaccccgttggagaaagcgcgcgtattcggcgcgcccccccaattggtccctaaaaaaaccccgggtggagaaaaaataacccttttttattgccccataaaaaacggcgccccaaggggcgtgtttttaaagccgcggggggggtaaaatataatcctaacccccgcagaaaaggggttctctctcgcgcgcccccgccggggggggtgtataaacccacctcccacaaaacaatttgtttggggagtagagaaaaaccccctcttcatagaaccacataatttatcaggggtgtccgcccaagcgggggagaaccctacaatgagggtgtgcggtggggaaccctccaccaaaacgtgtcatgttcttagaagagaataattccggcggattctctctccccttggttggggg

SEQ ID NO: 94885 - protein, 40 aa, Zea mays
  misc_feature: Ceres CLONE 1584862
MGEKKDDDSSLVEASHHATLASVLGSKDESLSSIVYSYKH

SEQ ID NO: 94886 - DNA, 827 bp, Zea mays
  misc_feature: Ceres CLONE 1584864
  misc_feature: Translation starting site: 206
  misc_feature: SWISSPROT Homolog: EC 4.3.1.5 Phenylalanine ammonia-lyase
ctcaccgcggtggcggccgctctagaactagtggatcccccgggctgcaggaattcgtctcacccctagaaaaaaagaagagcacgcccactcctctccggctcctcttcttctccaccacaccacaggcaccggcaccagcaccgcctcctccctccctccctcttgccaccgcgcggccccccagccacagcacagcacagcaatggcgggcaacggcgccatcgtggagagcgacccgctgaactggggcgcggcggcggcggagctggcggggagccacctggacgaggtgaagcgcatggtggcgcaggcccggcagccggtcgtgaagatcgagggatccacgctccgcgtcggccaggtggccgccgtcgcgtccgccagggacgcgtccggcgtcgccgtcgagctcgacgaggaaggcccgcccccgcgtcaagccagaagcgagtggatcctcgactgcatcgcccacggcggcgacatatacggcgtcaccaccggcttcggcggcaccctccaccggcgcaacaagggacggccccgcgctccaggtcgagctgctcaagcatctcaacgcccggaatcttccgcactggcagcgatggccacaccctgccgtcggaagtcacccggggcggcgatgcctgtggcgcatcacacgctccttgaaggctactccagcaatccgcttcgaaatcctcgaaggcatcaccaaagctgctcaacacgggggtcagcccgggcctgtcgcttcggggaaccattaccgggtccggcggactgggtccgctctcttaaatggcgggctcatcaagggccgt

SEQ ID NO: 94887 - DNA, 1054 bp, Zea mays
  misc_feature: Ceres CLONE 1584866
  misc_feature: Encodes the peptide sequence at SEQ ID NO. 94888
  misc_feature (69)..(69): n is a, c, t, g, unknown, or other
  misc_feature (70)..(70): n is a, c, t, g, unknown, or other
  misc_feature (75)..(75): n is a, c, t, g, unknown, or other
  misc_feature (76)..(76): n is a, c, t, g, unknown, or other
tggtttgtgttttcttctttgggttaccgtgatagtagctgaagtaggaggtagttattttattccgtnnggcgnntaaaactggagctccccgcggtggcggccgctctagaactagtggatcccccgggctgcaggaattcgtctcacccctagaaaaaaaaaagaccagagttacatgcttcaataaactcgtcagccttagatgtcaacacaagtgccacttcagaaacattttctgctactggcaatgttgcccaggctgatgctaagaacactttccagcctccatctcaagtgaaacatggttggggcggtgttccaggtcgcccttccatggctgaaatagtgaagatgggccggcctcaagctaaagttgggagcagatctgttgcaagtagcattgtcatgccagctattggtgattcagccattctcaatacaccaaatcttgcgcgcaatgaatacaaccaaactgtacttccatcagaagtaggccatgggtgcaacaaataaattgccaaatgttgcccgatgaggtgcactctggtatctaaagatgcttccctcacttgaatatgtttaccttccagcagaagggaacatgatgtttgaaagcccccttccattggagtggctaaacaatggcaaggggttccatccaacgccccagaatgcccaattggaaagaatgaaccgcttggaaaaaaaagaccccaaaatttcttgggaaagaagagggcgatataaccaagaataggccttggtaccgaacttccctgggaaacaaaggtttttccttggctttccttgggtaaaaaagaatcctggaaatggggaaagaatggttggtgcttaccaagcgacgcaaacccccaaattttgggaattaattttttaagacctctgggcgttggaagtgggaaccccaaaaattttggggcccggaaaggagaaaatatcccggggcgtgtgttaattcaatccccccggaggcccaatgctcttcaagggggtttgacaaaaacgcccttatatttggtgtgcccgcaac

SEQ ID NO: 94888 - protein, 59 aa, Zea mays
  misc_feature: Ceres CLONE 1584866
MAEIVKMGRPQAKVGSRSVASSIVMPAIGDSAILNTPNLARNEYNQTVLPSEVGHGCNK

SEQ ID NO: 94889 - DNA, 966 bp, Zea mays
  misc_feature: Ceres CLONE 1584867
  misc_feature: Encodes the peptide sequence at SEQ ID NO. 94890
  misc_feature (1)..(1): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (70)..(70): n is a, c, t, g, unknown, or other
  misc_feature (71)..(71): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (504)..(504): n is a, c, t, g, unknown, or other
  misc_feature (505)..(505): n is a, c, t, g, unknown, or other
  misc_feature (507)..(507): n is a, c, t, g, unknown, or other
  misc_feature (535)..(535): n is a, c, t, g, unknown, or other
  misc_feature (772)..(772): n is a, c, t, g, unknown, or other
  misc_feature (773)..(773): n is a, c, t, g, unknown, or other
  misc_feature (866)..(866): n is a, c, t, g, unknown, or other
  misc_feature (897)..(897): n is a, c, t, g, unknown, or other
  misc_feature (920)..(920): n is a, c, t, g, unknown, or other
  misc_feature (951)..(951): n is a, c, t, g, unknown, or other
ngtgtgtgtttctagtttaaactattaatttatatntccttccnnttgttcttatatgatattttttganngggttttataaatttnnnnttttnnnnnttttttttttaaagctggactccccgcggtggcggccgctctagaactagtggatcccccgggctgcaggaattcgtctcacccctagaaaacccctgcctgagagaatcggctcggacagtcggactcgatcatcaattaagcgaacctcgccgcgatcgtatcagccatggcgaccgccgcgcacgagggcgtgacccagcgcgtcgctgccagtggcagcagggaagacagcgcccgcgggggcatcgcggggggtctccggtcccccactagaaaaccgggcgggcggagggaggcggggcgggcctccgtttggttcccccccccgggggccctcccccccggggcctctggggtttgtttccatttttagaagagggggccccccccccacccctttcnncnaaattttccccccacggggttgcccccngcgggggggggggcccgcgccccccacggggccacccaaaaaaaaggggggccctggagacctttcgagcccgccccccgaaaaaggcgctttgggggcaaaaaaaggaggggggaggtttttaaaaaaaccacgcaatttgggggggcgcacccaccacacgaggggagggggggccaccattaaaaccccccccggcgggttgattcaaatgaaacaccccacactacttcccanngggagagggggccccccctccttatttttttgggggggcgccccccccaaacctccagggggatgaaccccacccggggggggcccctccttncccgggggggggcgcccccacaaaaaggacnccccgggaaggccccacaggagnagaacataaaccccacaccattttttctcangcggcggacaataac

SEQ ID NO: 94890 - protein, 68 aa, Zea mays
  misc_feature: Ceres CLONE 1584867
MATAAHEGVTQRVAASGSREDSARGGIAGGLRSPTRKPGGRREAGRASVWFPPPGALPPGASGVCFHF

SEQ ID NO: 94891 - DNA, 886 bp, Zea mays
  misc_feature: Ceres CLONE 1584871
  misc_feature: Encodes the peptide sequence at SEQ ID NO. 94892
gagctcaccgcggtggcggccgctctagaactagtggatcccccgggctgcaggaattcgtctcacccctagaaaaatcaacacaataacctgtctggaatcatacaaagttcactttcttccagtctaacattcttagacctgtcctataactcgttcaatggagaaataccatcgaaggtgcaagacatcactgaactgacagcattgcttctccagaacaactctctttctggacccatccctgaccttcgcctccccaagttgagacatttggatttgagcaacaataacctgagtggacctatgccaccctccctgcagaagttcccagctacttcttttctgggaaatgcctttctgtgtggatttccattggaaccatgtccagggacaccacctgcttctccatcgtcgccatcgtcccaaaatgccaaaagaagcttctggaaaaagctcagccttggtatcataattgcaatagttgctggaggaggggttgtattcatattgatcctgatcctcttggtatgtatcttcaaaagaaagataaatgcatagtctggcataggatcatcttcatccaaaggataggcaattgcaggtaaaaggggagaaaaatccaagggggcaatacagcagccgtggtattcaagaagcaaaagagaaataaactggtttttctttggagggctctttcacattaattttgactttggaaaggatcttgttgaagggcttttggacttaaagtctcttgggaaaaagggaagttaattgggacttacggttccacaagctttcttcttgggaaggaaggggaccaacccgttgggggggctccaaagaaaattttaaaaggacaagttggtaggccccccgaaaa

SEQ ID NO: 94892 - protein, 84 aa, Zea mays
  misc_feature: Ceres CLONE 1584871
MPPSLQKFPATSFLGNAFLCGFPLEPCPGTPPASPSSPSSQNAKRSFWKKLSLGIIIAIVAGGGVVFILILILLVCIFKRKINA

SEQ ID NO: 94893 - DNA, 933 bp, Zea mays
  misc_feature: Ceres CLONE 1584875
  misc_feature: Encodes the peptide sequence at SEQ ID NO. 94894
  misc_feature (516)..(516): n is a, c, t, g, unknown, or other
  misc_feature (522)..(522): n is a, c, t, g, unknown, or other
  misc_feature (563)..(563): n is a, c, t, g, unknown, or other
aaagctggagctccccgcggtggcggccgctctagaactagtggatcccccgggctgcaggaattcgtctcaccccctagaaaaaaaagcaacaagccgcagccgctttcggtgttctactgccgcgtagcagcggcagcggcaccgacggcatcccaaaaggcagcgacgtctgggtcggacttggaggccccggggatcggtggccaggctgagctcctcccagagtcccagtacgcctccggagtccggatccgcggagccgaccgacggcccgagctcctctggtctactctccagtacgcggctcggcagggaccgggagcgaggacgagcgtcctgcgtcgacgggatcggcgtgcctgaggagcgctgaaatctgcgcttccgtctccggacggccgatgccaggccttgctcgggagaggtagcaaacgaaacatggagctgaagccgcggcggcggctgctgctgctgcttgcgctcatttgcctgcgtgctcccccgttggcttcngctcancagccggatgaggcgacggtcatagttaaaggctccactangaatgcggaaaacgatgacaactacgtctgggctacaattgattggtgccccccggaaaatgccactacattcagtgtccctggggcccaggcgtcaattctaaacttggatttgggatccccgtttttggggtcagggcctttaaacgtttggaccttttgaggaatggggttggggggctccttgcaaaagccagtttttttttagattgggggaaaaaaaaaccccgcccccccatttaaaaagggtcacaggccctgtgtggggtttcccacagggtccccctcgaagagaaagaggggggaaacacataaatcccctttttgaaaaaaaggaggacgtttttgtcctttgtggggggagacaccc

SEQ ID NO: 94894 - protein, 94 aa, Zea mays
  misc_feature: Ceres CLONE 1584875
  misc_feature (27)..(27): Xaa is any aa, unknown, or other
  misc_feature (41)..(41): Xaa is any aa, unknown, or other
MELKPRRRLLLLLALICLRAPPLASAXQPDEATVIVKGSTXNAENDDNYVWATIDWCPPENATTFSVPGAQASILNLDLGSPFLGSGPLNVWTF

SEQ ID NO: 94895 - DNA, 876 bp, Zea mays
  misc_feature: Ceres CLONE 1584878
  misc_feature: Encodes the peptide sequence at SEQ ID NO. 94896
caaagctggagctcaccgcggtggcggccgctctagaactagtggatcccccgggctgcaggaattcgtctcacccctagaaaaactcgcagctcttctccagctctcggaggcccgaggtttcatcgacccgcgctccttcatcctcgacacctcactccggcggcgcgggtccgcagtgctgcacatcgcgagccgcgcggcacagccgcacttgttgtccttcgtgcgtggggtgcggttcgacgcgggcggcgggatggcggcgagcgcgcgggacagcaccgatgcagcggagcgagttgtggatgaccacgacggctgggcgtcggacgccgagatggacgtggagatggatgtggtggaaggcgagttccacgaccgcgatgccgaccccaccgacggcggcgcggatggtgatgatgagtacttgctgctcactaggataagggacacatcagcagctgaagcaagggcaggaaaggatatacaaggtataccatgggagaggatacacatagccaggcaagattaccgaaaagctaggttggaacagtataagaactatgaaaatttccctcaatcaggagagctcatggataagctgtgcaagcaagtggagaagagcagcaagtattatgaatttcagcacaaccctagatcagtgaagccattcatttcttcattttcagcttaaggaatttggttatgggcaacatccgaagcatgatgttctatttttatgtccaaattcccccgtaaagcccactgggtcatccattgtccccccaaattaatcacgagggtcctttgacttcctcctggggcatgtttgctctccggccggagaaagtatctctgggccagtttaactaa

SEQ ID NO: 94896 - protein, 145 aa, Zea mays
  misc_feature: Ceres CLONE 1584878
MAASARDSTDAAERVVDDHDGWASDAEMDVEMDVVEGEFHDRDADPTDGGADGDDEYLLLTRIRDTSAAEARAGKDIQGIPWERIHIARQDYRKARLEQYKNYENFPQSGELMDKLCKQVEKSSKYYEFQHNPRSVKPFISSFSA

SEQ ID NO: 94897 - DNA, 862 bp, Zea mays
  misc_feature: Ceres CLONE 1584881
  misc_feature: Encodes the peptide sequence at SEQ ID NO. 94898
tggagctccccgcggtggcggccgctctagaactagtggatcccccgggctgcaggaattcgtctcacccctagaaaaagcggaggcctcgctctggttggaaggtttggagaaactccccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccaagaaggatgaataccaaggtgtgtggaggcatgccaagagtgatggtcatgaggactatggcctccttgttagtgagaaggcaaggaaatacgccataatcaaggagcttgatgagccacttaccttgaaggatgggacagtggtcctgcagtttgaagtgagacttcagaatggccttgaatgcggaggtgcctacattaagtacatccgccctcaggatgctggatgggatgccaaggagtttgataatgagactccatacactattatgtttggtccagataagtgtggatcaaccaacaaggttcatttcatcctttagcacaagaatcctaagactggaaagtatgttgagcatcatctcaaattcccaccatctgtcccatatgacaagctctctcatgtctacacgggctatcttgaagccagacaatgaggtcaaaattttggtagatgggggaaaaaaaaaagaaaggcgaccttcctttctgctggatgattttgagcccgccactaatcccattccagacccattcctgaccctgaatgacaaaaaaccggaaggaactgggattaaaagaacta

SEQ ID NO: 94898 - protein, 148 aa, Zea mays
  misc_feature: Ceres CLONE 1584881
  misc_feature (24)..(149): Pfam Name: Calreticulin Pfam Description: Calreticulin family
MGGRALLLLLLVSALVFQIHASDPLLYEPFDEDFEGRWVVSKKDEYQGVWRHAKSDGHEDYGLLVSEKARKYAIIKELDEPLTLKDGTVVLQFEVRLQNGLECGGAYIKYIRPQDAGWDAKEFDNETPYTIMFGPDKCGSTNKVHFIL

SEQ ID NO: 94899 - DNA, 900 bp, Zea mays
  misc_feature: Ceres CLONE 1584882
  misc_feature: Translation starting site: 220
  misc_feature: Pfam Name: APS_kinase Pfam Description: Adenylylsulphate kinase
  misc_feature: SWISSPROT Homolog: EC 2.7.1.25 Adenylyl-sulfate kinase
  misc_feature (360)..(360): n is a, c, t, g, unknown, or other
  misc_feature (687)..(687): n is a, c, t, g, unknown, or other
  misc_feature (836)..(836): n is a, c, t, g, unknown, or other
  misc_feature (900)..(900): n is a, c, t, g, unknown, or other
ctggagctccccgcggtggcggccgctctagaactagtggatcccccgggctgcaggaattcgtctcacccctagaaaaaaccatttggacaccgatccatccatccatccatccagccccgtacgtgtctcgctggccgtccgtatatatagagagaggcatcggagattggccgccacgttgccatcgcgcgcggcgcccgccggccaaggccaaccatgctggcgagggctcctcctccgcggccgtgctccagcgccgtcggcggcgcttgcatcgcccgcgcacatccaagagccgccgccggcggcggcggcgtagtcaagctcgtcgcggccaggccggggacgaggacgacngtcgcggcggcggcggcagaagccgcttctaacgggtcggcggcggcggccgtcgcagggatcagcagcagcagcagcgcgctggtgacctcgaccgtcgggaaatcgacgaacatcctgtggcatgagtgcgccatcgggcagaaggagcgacaaggtctgctgaaccagaagggctgcgtcgtgtggatcactggcctaaagcgttcagggaaaaccacgctcgcgtgcgcgctgagccgcgagctgcacggcagaagcccacctcacgtacgtcctcgacggcgacaacctcaggcacgggctgaaacggggacctcagcttcngagcagaggaacgccccgagaacatccgcagaagtaggggaagtacccaaactgttcgccgaccctgggctctgtctgcatcgccagcctcaaatcggcctacagagcgaaccgaagcgcgggtcccgaactgctgccccagccctccntttttaaggtggttcctggacgggcccccttccaggggggccaagacaggggacccccaaggcn

SEQ ID NO: 94900 - DNA, 1232 bp, Zea mays
  misc_feature: Ceres CLONE 1584886
  misc_feature: Translation starting site: 238
  misc_feature: SWISSPROT Homolog: EC 1.4.1.2 Glutamate dehydrogenase
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (63)..(63): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (71)..(71): n is a, c, t, g, unknown, or other
  misc_feature (774)..(774): n is a, c, t, g, unknown, or other
  misc_feature (1063)..(1063): n is a, c, t, g, unknown, or other
  misc_feature (1232)..(1232): n is a, c, t, g, unknown, or other
atattatttaaaccacaaacacaaagtaaaaaaataaatatattaccgccannnnnnnncnancnnnnnanaaaactggaactccccacggtggcggccgctctagactagtggatcccccgggctgcaggaattcgtctcacccctagaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcatcggcgtgtggcagcacgaccgcgtccagatcattgccaacgaccagggtaaccgcaccacgcccccgtacgtccccttcgccgactccgaagcgccttcttgggagatgcgtgcaataaccaaggttgccatgaaacccattaaccccggcctttgaaggcaaggccccccaccgcgcgcccaagggttcagggaaggggttgtgtccacaagggaaaaaccaagtggtgggcccttcaagggtcatttttctggggcccttgggggagaaagcccaactgatttgtttgttcaagcccccaagggggttaaggaaaaaaaccagtttttgcccgcctgtaaaaaaaaactcgcccccctaatgggggttcctaaatccacagacgtgccggagaagatattggctctaaaaagctcttcaccccttttgtctatgccccccggatactgagaaaaaatggtctttttgttgcgnccacacagtaggccctcgggccgccttgacaccttattaaaatgtggactctccccacacaaatgctgctgaggggtgcgccacaaaaatgagaaatgtaccctcgggggcggggtaatattattccttggaggcacctctatgagaatagtgagccccgcgtcgatattctacggctgcggaggagaaagctctaatatgtgggtggcggggcgggcactatctcacccgctaatggtgggtctgttgtgagcaaaacagacaagagccgctctaccactacagtttngcccaatgatatagaaaataaaaaataatacccgcagccgcatccatattgggcgatactctccgccgagggcggggtgagcacgcctgtttaaatagtagtcgagcgccactttgactggtatacgaaatgtagagcgagaggatatacctacttgtgttagaggggn

SEQ ID NO: 94901 - DNA, 929 bp, Zea mays
  misc_feature: Ceres CLONE 1584887
  misc_feature: Encodes the peptide sequence at SEQ ID NO. 94902
  misc_feature (305)..(305): n is a, c, t, g, unknown, or other
  misc_feature (370)..(370): n is a, c, t, g, unknown, or other
  misc_feature (398)..(398): n is a, c, t, g, unknown, or other
tggagctccccgcggtggcggccgctctagaactagtggatcccccgggctgcaggaattcgtctcacccctagaaaaaattcctccgcgccgccactagctgtcctaaaccctaccaccacttgagcctccaccttctccgcgtctcaccttcttctccgttctccttccgctcccctcttcacaacgaagccctagtgtcccgcgacatggcatctggtctggaggagaaactcgcggggctctcaacgggcggcgacgggcaaaatcctccgccggcgggtgagggcggagaggagccgcanctctcgaagaaatgcgagaagagagaggagaagaggaagaagctggaagaggagcggaggctcanggaggaagagaagaagaacacgcctccngctgccagtggaaaacctcagaaagcatctgctgctgacgatgatgacatgggatcccactcatactatgagaataggctcagggctcttgattcactgaagggcaacagtgtaaacccctatccccataaagtccccggttgggcatttctgttacccgaataccttgagaagtacaggaccttgaccgagggggagaaactttacgatggtggcaaaaggttttaccggggaggatcatgaacaaaaaaacttcctccctcaaagcaattttttttaggaacccttaggggggggggcctaaaaggttcaagggaagggttggagcccggacctccaaagtgggaagaaggtgaaatttttcaagccccccccgggggggtgaaagggggggtaaattttgggggcattgtggggaattcccggaaaaacacccccgggggggggtttttttttttttccaaaaagaattgtggccccccccccccggggttttttaaaagaggggcccccccccaagagggggggaga

SEQ ID NO: 94902 - protein, 143 aa, Zea mays
  misc_feature: Ceres CLONE 1584887
  misc_feature: SWISSPROT Homolog: EC 6.1.1.6 Lysine--tRNA ligase
  misc_feature (32)..(32): Xaa is any aa, unknown, or other
  misc_feature (54)..(54): Xaa is any aa, unknown, or other
MASGLEEKLAGLSTGGDGQNPPPAGEGGEEPXLSKKCEKREEKRKKLEEERRLXEEEKKNTPPAASGKPQKASAADDDDMGSHSYYENRLRALDSLKGNSVNPYPHKVPGWAFLLPEYLEKYRTLTEGEKLYDGGKRFYRGGS

SEQ ID NO: 94903 - DNA, 936 bp, Zea mays
  misc_feature: Ceres CLONE 1584888
  misc_feature: Encodes the peptide sequence at SEQ ID NO. 94904
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (34)..(34): n is a, c, t, g, unknown, or other
  misc_feature (45)..(45): n is a, c, t, g, unknown, or other
  misc_feature (56)..(56): n is a, c, t, g, unknown, or other
  misc_feature (59)..(59): n is a, c, t, g, unknown, or other
  misc_feature (60)..(60): n is a, c, t, g, unknown, or other
  misc_feature (70)..(70): n is a, c, t, g, unknown, or other
nnnnnnnnaaaannccccnttttaaaaaagtttngaggcattaanaacgataggtnttnnccttattttngaaagctggaactccccgcggtggcggccgctctagaatagtggatcccccgggctgcaggaattcgtctcacccctagaaaaagtcttatcccctcgcccctcctcccctccgccgctccccccagtccccacctcacctcgtcaaccccctccttggatagggttagagttcccccggcacgagcgcgagccatggcctccttcacctgctcccaggtcggcgctgcggcagcgggcggagcctcgcccttcctcggctaccggcggcggagcggccctgggggcgccattccgtcgagctccctcttcgtgggccggcggttggcggcggtgcagatgcgcgcgccctctcgcggggtccgcgggggctccgcgctgcgggtcacgtgcgagaaggtggtggggatcgacctgggcaccaccaactccgcggtcgccgccatggagggcggcaagccgaccgtcgtcaccaacgccgagggtgcgcgcacgactccctccgtagtggcgtacaccaagacaggggagcgcctggtggggcagatcgctaagcgccaggcggtcgtgaaccccgagaacaccttcttctctgtcaagcgcttcatcggccgcaagatgtctgaggtcgacgacgaagccaagcaggtctcgtacggcgttgtcaaagacgagaaccggaaacgtcaaactcgactgcccccgctattgggcaaaacagttttgctgcccaaggaagatctcctgccccagggttttgaaggaaaatttggtggggatggatgcattcctaaggttttctttaatggaagaaaaatttcccaaaagccgggggggttttccagggtaccccagggcattttctta

SEQ ID NO: 94904 - protein, 224 aa, Zea mays
  misc_feature: Ceres CLONE 1584888
MASFTCSQVGAAAAGGASPFLGYRRRSGPGGAIPSSSLFVGRRLAAVQMRAPSRGVRGGSALRVTCEKVVGIDLGTTNSAVAAMEGGKPTVVTNAEGARTTPSVVAYTKTGERLVGQIAKRQAVVNPENTFFSVKRFIGRKMSEVDDEAKQVSYGVVKDENRKRQTRLPPLLGKTVLLPKEDLLPQGFEGKFGGDGCIPKVFFNGRKISQKPGGFSRVPQGIFL

SEQ ID NO: 94905 - DNA, 858 bp, Zea mays
  misc_feature: Ceres CLONE 1584890
  misc_feature: Encodes the peptide sequence at SEQ ID NO. 94906
  misc_feature (640)..(640): n is a, c, t, g, unknown, or other
aaagctggagctccccgcggtggcggccgctctagaactagtggatcccccgggctgcaggaattcgtctcacccctagaaaaatagaaaaaacacacaagtctgaacgcttgaacctgaacctccaaagcagcaaccccagcagctcctcctcatcgcagccgcagcgccgtcccctactcttcctgcgaccaactgctgtctctccggcgacggcagaaccgtctctgcaggtgcagggagggacccgggagatgagtctggggctgctcaacacagagcgcaaccaccttctctccccgaagccgcagagccctcgggatgccgccgtgtcgtcgctgctgaggtcacccagggcgtcctgcggctcctgcagccagagccccaagccgaagcccaccaagatggcgcacggcggcctggagcgctcgctcagcttcaagaactgggaggcggacgacagccggggcggcatcaacggagcgcgcccgggcgccctggcgctgcagcagcaggagagccccggcgcgtggtctccgtgtccccgcaggcgcaggccatgatcgagtacatctcccctcgcccacgcgtggagctggaccagcgggcaccaccctgaaaaagatgtacagggcctggncaagcgccgaaaccttgccaaaggggccctattccccaaagaaactggggggaaaacgggcaactcgggttccccaaaacaaagccctttcccctcttcaaaaaggaaaaacaggaaaaccccccccgccccctgtggccaggggccggaaaaaaaaaatccccaaggggggaaaaggggcttccccaaaggaacaaagggggcaaaaaacccgcccc

SEQ ID NO: 94906 - protein, 102 aa, Zea mays
  misc_feature: Ceres CLONE 1584890
MSLGLLNTERNHLLSPKPQSPRDAAVSSLLRSPRASCGSCSQSPKPKPTKMAHGGLERSLSFKNWEADDSRGGINGARPGALALQQQESPGAWSPCPRRRRP

SEQ ID NO: 94907 - DNA, 1329 bp, Zea mays
  misc_feature: Ceres CLONE 1584892
  misc_feature (16)..(16): n is a, c, t, g, unknown, or other
  misc_feature (22)..(22): n is a, c, t, g, unknown, or other
  misc_feature (23)..(23): n is a, c, t, g, unknown, or other
  misc_feature (45)..(45): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (59)..(59): n is a, c, t, g, unknown, or other
  misc_feature (60)..(60): n is a, c, t, g, unknown, or other
  misc_feature (66)..(66): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (632)..(632): n is a, c, t, g, unknown, or other
  misc_feature (633)..(633): n is a, c, t, g, unknown, or other
  misc_feature (893)..(893): n is a, c, t, g, unknown, or other
  misc_feature (941)..(941): n is a, c, t, g, unknown, or other
  misc_feature (1013)..(1013): n is a, c, t, g, unknown, or other
  misc_feature (1049)..(1049): n is a, c, t, g, unknown, or other
  misc_feature (1190)..(1190): n is a, c, t, g, unknown, or other
  misc_feature (1191)..(1191): n is a, c, t, g, unknown, or other
  misc_feature (1192)..(1192): n is a, c, t, g, unknown, or other
  misc_feature (1194)..(1194): n is a, c, t, g, unknown, or other
  misc_feature (1195)..(1195): n is a, c, t, g, unknown, or other
  misc_feature (1196)..(1196): n is a, c, t, g, unknown, or other
  misc_feature (1201)..(1201): n is a, c, t, g, unknown, or other
  misc_feature (1203)..(1203): n is a, c, t, g, unknown, or other
  misc_feature (1204)..(1204): n is a, c, t, g, unknown, or other
  misc_feature (1212)..(1212): n is a, c, t, g, unknown, or other
  misc_feature (1213)..(1213): n is a, c, t, g, unknown, or other
  misc_feature (1214)..(1214): n is a, c, t, g, unknown, or other
  misc_feature (1215)..(1215): n is a, c, t, g, unknown, or other
  misc_feature (1216)..(1216): n is a, c, t, g, unknown, or other
  misc_feature (1217)..(1217): n is a, c, t, g, unknown, or other
  misc_feature (1218)..(1218): n is a, c, t, g, unknown, or other
  misc_feature (1219)..(1219): n is a, c, t, g, unknown, or other
  misc_feature (1220)..(1220): n is a, c, t, g, unknown, or other
  misc_feature (1221)..(1221): n is a, c, t, g, unknown, or other
  misc_feature (1222)..(1222): n is a, c, t, g, unknown, or other
  misc_feature (1223)..(1223): n is a, c, t, g, unknown, or other
  misc_feature (1224)..(1224): n is a, c, t, g, unknown, or other
  misc_feature (1225)..(1225): n is a, c, t, g, unknown, or other
  misc_feature (1226)..(1226): n is a, c, t, g, unknown, or other
  misc_feature (1227)..(1227): n is a, c, t, g, unknown, or other
  misc_feature (1228)..(1228): n is a, c, t, g, unknown, or other
  misc_feature (1229)..(1229): n is a, c, t, g, unknown, or other
  misc_feature (1230)..(1230): n is a, c, t, g, unknown, or other
  misc_feature (1231)..(1231): n is a, c, t, g, unknown, or other
  misc_feature (1232)..(1232): n is a, c, t, g, unknown, or other
  misc_feature (1233)..(1233): n is a, c, t, g, unknown, or other
  misc_feature (1234)..(1234): n is a, c, t, g, unknown, or other
  misc_feature (1235)..(1235): n is a, c, t, g, unknown, or other
  misc_feature (1240)..(1240): n is a, c, t, g, unknown, or other
  misc_feature (1241)..(1241): n is a, c, t, g, unknown, or other
  misc_feature (1242)..(1242): n is a, c, t, g, unknown, or other
  misc_feature (1243)..(1243): n is a, c, t, g, unknown, or other
  misc_feature (1244)..(1244): n is a, c, t, g, unknown, or other
  misc_feature (1245)..(1245): n is a, c, t, g, unknown, or other
  misc_feature (1247)..(1247): n is a, c, t, g, unknown, or other
  misc_feature (1252)..(1252): n is a, c, t, g, unknown, or other
  misc_feature (1253)..(1253): n is a, c, t, g, unknown, or other
  misc_feature (1260)..(1260): n is a, c, t, g, unknown, or other
  misc_feature (1261)..(1261): n is a, c, t, g, unknown, or other
  misc_feature (1263)..(1263): n is a, c, t, g, unknown, or other
  misc_feature (1264)..(1264): n is a, c, t, g, unknown, or other
  misc_feature (1266)..(1266): n is a, c, t, g, unknown, or other
  misc_feature (1267)..(1267): n is a, c, t, g, unknown, or other
  misc_feature (1268)..(1268): n is a, c, t, g, unknown, or other
  misc_feature (1269)..(1269): n is a, c, t, g, unknown, or other
  misc_feature (1270)..(1270): n is a, c, t, g, unknown, or other
  misc_feature (1271)..(1271): n is a, c, t, g, unknown, or other
  misc_feature (1272)..(1272): n is a, c, t, g, unknown, or other
  misc_feature (1276)..(1276): n is a, c, t, g, unknown, or other
  misc_feature (1277)..(1277): n is a, c, t, g, unknown, or other
  misc_feature (1284)..(1284): n is a, c, t, g, unknown, or other
aataaagtcacccccncccccnncccccaacaacacaaaaaaaanaccnnncnnnnaannaaaaanaaaacccaaaaannncacannnaactaccccccgtggcagccgctctacaatagtggatcccccgggctgcaggaattcgtctcacccctagaaaaaaaaacccctgcaggttcttgtaccatcaaaatctgaagcgcagaaacaggcttccctaactggcagcgcaagcactcaggtcgtttcggtatcaaggcccttgagtgccccgcaagtccctgcagcaaaaccaagtgtgccagccacaacagctcagaacgcacctcttctttctcgctcagtgagtgctgtctggcgggtaggaaatgagccctccgccaatggctcctaactttaattcccccgggtcacgaacctgttcgcaatgccatgaagggaaaaaaagtcctgggtggccctaaagcaatcccacaagatcaggagaggggttggagtctgaacccccccccctccacaacaaatccccaaatccagaaggtttttacattatcccaagaccctttcccacattcgtgggacaatccgggagaaaaaccctcttgtgttcttgtggtaaaagaggaggggnnaacccgccctcttcttttccaaaagaaaccccctcggaggaatgttgtatcaacatatttctttggggtagcaacacacccccgtcgtagaagataatagccccccctgagaagagaggtacaccaataccgtgtgaaggaaatacaacctctccctctttgtttgtcgtacagactgagagaggcgggcgcctgctcgcgatataatatgtcataatcttgcggttagtagaaaataacgagccgagtgctccaatgtntgtgcgtgctaacatacaaaagcgcccgcggtatgagctgatacatcntgggtcgtctcgtctcagactgagacgacatcgcgcgaaaccaggagagtaagtgaagagagagggagttgntatgcgcacgctcgcaaaatacattcaatgtagctnggcgaggtatttctttagcagaagacagaaaacagtgttgcatggatgataataacaacagtgccggaaatatacatatctccgtcccgcataaaataagagatgagaccgcacattgatgtgtattgtgtggaaaattcnnntnnncccanannaaccccannnnnnnnnnnnnnnnnnnnnnnngtgannnnnnanaaaannaaaaaannannannnnnnnaaannaaaaatnaaaagaatatatggatagatgcttcgatagacacaacaatagaag

SEQ ID NO: 94908 - DNA, 871 bp, Zea mays
  misc_feature: Ceres CLONE 1584893
  misc_feature: Encodes the peptide sequence at SEQ ID NO. 94909
ctccccgcggtggcggccgctctagaactagtggatcccccgggctgcaggaattcgtctcacccctagaaaaaccgctgagatggccgacgtggattccttctttgcgtgcccggcgcgctgctgattcgttaactaaacaatgaggcagcagactggtaagcgtccctcccaacacagggaatatgaaagagaagaaaggaaggaccaacacaagaggccgtttccccgtgctcaggaaagctctaataatgatgggctggttctttaccgtatactctgtccagacagtttgattggtagtgtcataagaaagcatggcaatgtgataaatgctatcaggcatcagacaagtgccaaagtcaaggttgttgacccgtaccccggtgcagacaaaccccctgtcttggtatattggctacgtcaagcatagagaccttgatgctgagggtgatgacaatgaacctgtttgtgcagctcaagatgcattacttagggggcataatgcaattgttgatgcactggcagacatttcattaacaatcctaaagacctctgattaaaaaaaccacaggaggaagcctaacattccttgtgcccaccctagtccgggaatcaaaatggttatagggaaaattcggggtgctggtaattcaagcatttcttcgggtcaaacatcaaagaaccattccttttaaagtggaggccccaaaaagattccaaggtgaacccctaccaacattccaggtgggcgaattgaggtttcggaaaaaatatttggttcacaaataaactgggtgggtgcgcctaaagcttggtttaaaaaaaagaacccggtttgtgaagaattcaaacccagcgttttttcaag

SEQ ID NO: 94909 - protein, 96 aa, Zea mays
  misc_feature: Ceres CLONE 1584893
MRQQTGKRPSQHREYEREERKDQHKRPFPRAQESSNNDGLVLYRILCPDSLIGSVIRKHGNVINAIRHQTSAKVKVVDPYPGADKPPVLVYWLRQA

SEQ ID NO: 94910 - DNA, 940 bp, Zea mays
  misc_feature: Ceres CLONE 1584894
  misc_feature: Encodes the peptide sequence at SEQ ID NO. 94911
ctggagctccccgcggtggcggccgctctagaactagtggatcccccgggctgcatgaattcgtctcacccctagaaaaaacggaggacgggaggagtgatctccacgcccgctcgctcgcgtcctgtcgccttgtcggcgtccgccactccgccccctccagccagatccctcctattcccccacttcactcccaatccgaatccagatccgcgaatgctggggcgggcggcggcactgtccgcgccacggtggcgcggcggggtgccagaccttcgcgccgcgctgcggtcggggggcaacctcctcttcgcgctcttcgtggcggccgtgctcgcattcacgctcctcgcggcgttccacagccccgacgatccgctcctccacccgtccctctcacccctgcggcgattttctcacctccgccactttccacctccacccttcctcactggacgactcccgtgctgcgcaccggggggaggacttccaactccctcgtcccaccgggcgccgccgggggaggtgcgccgccggggggggtgtccaaagtcggtcgcgggagggccgtccccgttcactaagacctctccgaaaatttgggcgcccaagggccccaaaaaaaacgggaggccccgaaaacgggaagcggggccccttccaccgttccaaaacttgattgccggcccacccgggcgaaagggtgcaaaccgctgggggcgcggaagaaaaaactcccccctttgccggaaaggcggggtttccttggcaaaaccgggaaggccgcccgcgttgaacggcccccagggggaaacgggggaaatttctttcaaacctgcgtcattgggcgccgcggggccatcggaaggggggttctccccaaacctccccctttttaatcgcgctttttgggccctccaacagtggccgggtggacccg

SEQ ID NO: 94911 - protein, 241 aa, Zea mays
  misc_feature: Ceres CLONE 1584894
MLGRAAALSAPRWRGGVPDLRAALRSGGNLLFALFVAAVLAFTLLAAFHSPDDPLLHPSLSPLRRFSHLRHFPPPPFLTGRLPCCAPGGGLPTPSSHRAPPGEVRRRGGCPKSVAGGPSPFTKTSPKIWAPKGPKKNGRPRKREAGPLPPFQNLIAGPPGRKGANRWGRGRKNSPLCRKGGVSLAKPGRPPALNGPQGETGEISFKPASLGAAGPSEGGFSPNLPLFNRAFWALQQWPGGP

SEQ ID NO: 94912 - DNA, 822 bp, Zea mays
  misc_feature: Ceres CLONE 1584895
  misc_feature: Encodes the peptide sequence at SEQ ID NO. 94913
  misc_feature (415)..(415): n is a, c, t, g, unknown, or other
  misc_feature (417)..(417): n is a, c, t, g, unknown, or other
  misc_feature (423)..(423): n is a, c, t, g, unknown, or other
cggccgctctagaactagtggatcccccgggctgcaggaattcgtctcacccctagaaaaactggaaaccaccgggggatcgccccgccctttccttcccgcaccccagatcctccgtcccaaaacggcagcttccggaggtctcccgtctccctgctccttccggcgcgacgggtggcccggctcgcggatccggcggtcttcggtcgacggcgaggcggcgctcgtcttggatcgggagtggttgctgaggcgcggagatggtggccgaggcggaagtcatgcatcaggcccccgtgccggtgctggaggtgcagtaccaccggcgcgcgacgaccaagggggttgacgacgtcgtcgggatgtccgcgcccgcccccgcggaggttggggttggggtttgggggtggaggtncnaggtcnaggtcgaggtcgccgtggaggtgcctcgcatggggttggagcagcctgatgtcgcaccaagggtatccatggacatgatacagcagtttgtgcccaacatccgttctggtagcttcgccgacattgggcctcggaggtatatggaggacgagcacatccgaatagatgatctttccgcccatctcggctcgatgttggtctgccctctgcctagcgccttctacggggtctttgacggccatggcggcccgggagccgcagcctacatgaagaggcatgcgatgaggttcttgtttgaggaaagcgagtttccacggcgtcgcaggtggatgaggtgtacctcgaatccgtggagaactgggttcgcaaagccttcttgcaggcgggaccttgccctgg

SEQ ID NO: 94913 - protein, 187 aa, Zea mays
  misc_feature: Ceres CLONE 1584895
  misc_feature: SWISSPROT Homolog: EC 3.1.3.16 Phosphoprotein phosphatase
  misc_feature (52)..(52): Xaa is any aa, unknown, or other
  misc_feature (53)..(53): Xaa is any aa, unknown, or other
  misc_feature (55)..(55): Xaa is any aa, unknown, or other
MVAEAEVMHQAPVPVLEVQYHRRATTKGVDDVVGMSAPAPAEVGVGVWGWRXXVXVEVAVEVPRMGLEQPDVAPRVSMDMIQQFVPNIRSGSFADIGPRRYMEDEHIRIDDLSAHLGSMLVCPLPSAFYGVFDGHGGPGAAAYMKRHAMRFLFEESEFPRRRRWMRCTSNPWRTGFAKPSCRRDLAL

SEQ ID NO: 94914 - DNA, 827 bp, Zea mays
  misc_feature: Ceres CLONE 1584896
  misc_feature (827)..(827): n is a, c, t, g, unknown, or other
tcccgcggtggcggccgctctaacagtggatcccccgggctgcaggaattcgtctcacccctagaaaaaaccatgcagcagctgtagaagcctggtggtaggtaggataggagtagcgccagccgccaagtgcgcgtccggagctggctgcttccgacgaagcaggaaggggagcccccacccgcccggggacttcccgcaaaaggttaggccttcccttccggacccccccggaccccgtttgtccctttgcgaaaaaacaaaaaacgtgttacccccccgcaaggagaaaaaggcagaggggggcccctaagggggagccataaagaccacccccaagtgggaggaaatcgcccccccggggggggggggggggcaataatttcacggccccgcggaaatgaggcggggggggggcacgacccacgccacacataatagacaggcgacacgtatagaaccgatacaacaaccaacgttccctccacacactacggcgagatgcacactcgcgttcaatctactaactacagtaacaatgcagcggcacgccaggtgggccaccaaccaagacgagtccagacgagataatccgggttaacaccaacacagcataaaaaaaaataaaatagagcccgggaccaccacggcgggcggcgcccgatcccccataggactagaggacaaagcaggcaacactacgcaccacacagcccagataagcccgccacaatagtgacccaggtgaccggcgggaacatagacaatgcaaattgatggcgactcgacgtacaagagcaatgacaccaaagcactctggacagatn

SEQ ID NO: 94915 - DNA, 814 bp, Zea mays
  misc_feature: Ceres CLONE 1584897
  misc_feature: Encodes the peptide sequence at SEQ ID NO. 94916
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
gaaaagctggagctcaccgcggtggcggccgctctcgaactagtggatcccccgggctgcaggaattcgtctcacccctagaaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagagaaagaaagggagggcatccaccagccgccggcgataagaggggaggagagagaggccagagaagaggaggagaagaagaagaaaatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggaaaatgagtgttcgcctgctcaccggctgacgccagcaacannnnnnncactnnnnnnnnnnnnnnnnnnnnnnnnnnacccnnnnnnnnngnnnnnnnnnnnnngnnnnnnnnnnnnnnntnnnnnnnnnnnnnnnnnnnnnnnnnnnntnnnnnnnnnnnnnnnna

SEQ ID NO: 94916 - protein, 94 aa, Zea mays
  misc_feature: Ceres CLONE 1584897
  misc_feature: SWISSPROT Homolog: EC 4.2.1.1 Carbonate dehydratase
MSSCLCLPKKKEGPAKEKPSTDTPTSSLLQNQKPSQPPPPPSKASSKGMDPTVERLKSGFQKFKTEVYDKKPELFEPLKSGQSPRKMSVRLLTG

SEQ ID NO: 94917 - DNA, 880 bp, Zea mays
  misc_feature: Ceres CLONE 1584903
  misc_feature: Translation starting site: 635
  misc_feature: SWISSPROT Homolog: EC 3.2.1.1 Alpha-amylase
  misc_feature (785)..(785): n is a, c, t, g, unknown, or other
ggagctccccgcggtggcggccgctctagaactagtggatcccccgggctgcaggaattcgtctcacccctagaaaaaaatggacgtctccgagaaaactcaaatcgaatccccaaatccttcgccggcgatcccactccaaatctcgatcggaaaagcgtagaaaagcaacggaatcccaaggggacaagcaaagctatcttctccttcttcccatccttcctcatcccgtcggatcaataccagcgggagcaaattcgaagccgctgccgaaattgtggccggttgaccggtgtttccagcccgtccccacgttgcacgcggcgaggcagaggagtccgccgtcaactccatccgatcggcgtagggtcgcggggtgccgacaactttggtccccgctcccatttgggcgccaccggtcgctgcgcatgccgcgggctcccgcgcccactggaccccggtaacgccgcacggcgcctcgctccgcgtgccctcccgctgccagctccatgccgaccgccgcgtctacataggtagctgcgcgctggctgaaggctcctgcagtgcgcgttgaaggctttcgctgcgtgttgtgcgttctgcttgaatttcggtctgagtttggatgggccagatgatttcgggtgataaatccgacgaacagacagcacgcgacgatggaatcatcaagaatggaagggaaatcctatttcaggcttttaactgggaatccaataagcacaactggtggagtattttgggaggaaaaagtaaccgatcttgcngaatctgggtttacatcagtgtgggcttcctcctccacacagtcattatctcaagaaggctatctaccacaggatctgtactgcccttgactcag

SEQ ID NO: 94918 - DNA, 831 bp, Zea mays
  misc_feature: Ceres CLONE 1584906
  misc_feature: Encodes the peptide sequence at SEQ ID NO. 94919
  misc_feature (635)..(635): n is a, c, t, g, unknown, or other
  misc_feature (657)..(657): n is a, c, t, g, unknown, or other
ctggagctccccgcggtggcggccgctctagaactagtggatcccccgggctgcaggaattcgtctcacccctagaaaaactttccatctgccgttcgcccagcgtgttctccctctagtgcggcaactgggcgaccgccgccgccgcttactccgggtgcccaggcattcgtccgtaccttctcaggccttcatcgcgtccttcgccggcgacgatcaccgacaaggatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccagaagtctgtaccaagtatatcagtgattggactgaatggagttctgctgtggaatcatgatggatatatcaactctgaaaatctgaaagaaagcattgagaaagcgtgggctgctcttcatctacaggagacagcagcgaccttgttgacagcatcacttgctancagaaaatctgaacctgtgaantctgctactactggtttgccagctcaggggggctcttcaactttagaaaaatctttccgatttattcagtcaatcccccaaatgtttctggggcccgtgaaagttgccccattcaacggatctgggattcacaaagttctaaaaagccctgcccctttatgaaaccttttgaaa

SEQ ID NO: 94919 - protein, 196 aa, Zea mays
  misc_feature: Ceres CLONE 1584906
  misc_feature (136)..(136): Xaa is any aa, unknown, or other
  misc_feature (143)..(143): Xaa is any aa, unknown, or other
MERTINSLMYKGSIPDAINQSRREKKLFVVYISGEDEASSSLEQSSLIDENVVEVIGRCCILLHLKQGNVDASQFSAIYPQKSVPSISVIGLNGVLLWNHDGYINSENLKESIEKAWAALHLQETAATLLTASLAXRKSEPVXSATTGLPAQGGSSTLEKSFRFIQSIPQMFLGPVKVAPFNGSGIHKVLKSPAPL

SEQ ID NO: 94920 - DNA, 838 bp, Zea mays
  misc_feature: Ceres CLONE 1584907
  misc_feature (123)..(123): n is a, c, t, g, unknown, or other
  misc_feature (134)..(134): n is a, c, t, g, unknown, or other
ctggagctccccgcggtggcggccgctctagaactagtggatcccccgggctgcaggaattcgtctcacccctagaaaaaaagtcgcgacgccaccagctccccatcccctcggacgccatgngaggaagctcngcgaccacaggctctcctccaccgccggccgccccttcctctctggcttctgcgccgcggcgcttcgacgtaagcccctcggcgcccgcgcctccgccgccgccgccgccaccggcgagggccttgtgcggcagctcggcgtcctcgacctcgtgctgctcgggatcggtgcgtcccatcgcgccggcatattcgtcgtcactgggaccgtcgcccgcgacgccggcccaggggtcaccgatcagttttgttcttgcgggaactcccggcggggcccaaaggccctggggcctagggaaaaaaggggggtcccgggtcccccgggtggggggtgggggggaaacactttttttacaccgttcccccgggggttttaaaaggaaaataacccccccctcttctggggggccccctcccccccgcgggggagggggggggaaaaaaacacaaataaccggggcccaaaaaaaaaaaatatttgctccccccctctttataaaaaggcacctttttttttcagggggtttttgggggaaaaaaaacacccccccttcttttgaggggggcgcaaacattccccccccctgggggaacgccccccgggggggaggaaaattttttttggggggggggggtgtgttaaaaaaaaaagaaaaagagggggcggccgccccccctttttttataaaaaaaaaagaaagaaa

SEQ ID NO: 94921 - DNA, 813 bp, Zea mays
  misc_feature: Ceres CLONE 1584912
  misc_feature: Encodes the peptide sequence at SEQ ID NO. 94922
  misc_feature (792)..(792): n is a, c, t, g, unknown, or other
ctccccgcggtggcggccgctctagaactagtggatcccccgggctgcaggaattcgtctcacccctagaaaaaagatcttctagcttctgtagctgtgactagaccacaatggactcgccttctatcttccgtggatcacagagtagaccgatctttagctatactaaggccacaagccattgttgatcatcgatcacttctttcttcccttggctggcctccttcacttgccggctcaaaattttcaagtattaattcggggaaacaagcagagattgtgaacccattgtttgtgatgcggggtgacctgaaaagcaagtattccgagagctttcttgcactatgcaatttgcagggattacagaaacgtagaaaagctagacaactgaaagggcattgtgtgggtaatcaactacgtcaaccattatgggtaattgaagagctagtaaatccaatatctacagctgcacaacgccatttctcaaaatgggctgaaaagcctgaatttgtttttgctcttgcttataagataattagagattttgttgattctatggatgagattctacagccccttgtggataaggctaaccttattgggtatagttgtagggaaggaatggatttcacgaatggtcattgcattgtctacatacttggcgaaagagatatttcctaagcagattgaagttcttcaggagagtagtagctcaagtgactcaggcagcacggcctatcaggctagagtctcgtggctcagcccttgatgatctgatgatatcttttgacnagcgggatcaagattttatct

SEQ ID NO: 94922 - protein, 127 aa, Zea mays
  misc_feature: Ceres CLONE 1584912
MRGDLKSKYSESFLALCNLQGLQKRRKARQLKGHCVGNQLRQPLWVIEELVNPISTAAQRHFSKWAEKPEFVFALAYKIIRDFVDSMDEILQPLVDKANLIGYSCREGMDFTNGHCIVYILGERDIS

SEQ ID NO: 94923 - DNA, 864 bp, Zea mays
  misc_feature: Ceres CLONE 1584915
  misc_feature: Encodes the peptide sequence at SEQ ID NO. 94924
  misc_feature (552)..(552): n is a, c, t, g, unknown, or other
  misc_feature (830)..(830): n is a, c, t, g, unknown, or other
ctggagctccccgcggtggcggccgctctagaactagtggatcccccgggctgcaggaattcgtctcacccctagaaaaaaagccgaaaaggagaaagtaccccgttccgtcggccgcagtgccgcacctgcacccaccgcacgccgagtcacgccccccctggaccagccaacgtgacactccaccgccgccggcgccgcggcagcccgtagcaaccgccaccgcctgcccatctcctctctatcccgcgccgcatggccgcgtacttcaaccactcctcgtcctacccgccgccgcctcccccgccgggcacttccccgtacggcgcgtaccgccacgcctacccgccggcgccggcacccccggccgcttacggcgcctactacgaccgcgcagagcaggccctcccggcgcgggacgaggtccgcaccctcttcatcgctggcctccccgccgacgccaagccgcgcgaagtctacaacctcttccgcgatttccccggatacgtctcctcccacctccgcacgggcaaatcctctcaggcgtatgcngtttgctgtgtttgcagatcaacagtctgcactagctgccttgagtgcacaaatggaatggtatttgatcttgagaaaaatgttctcttcatgtagatctcgcaaaatccaattcagatcaaagcgcttgagatcagatgatacttcaccttattctcctggaaaaagaaataggaaaccaagggggatttcctgattcaggtatgactcaagtagcttttttgggcagaatggcatgaaagaaaccatctgtattttcacaccaccgaagatctggntgcttacggcctaatgggaggtccactacaatcc

SEQ ID NO: 94924 - protein, 130 aa, Zea mays
  misc_feature: Ceres CLONE 1584915
MAAYFNHSSSYPPPPPPPGTSPYGAYRHAYPPAPAPPAAYGAYYDRAEQALPARDEVRTLFIAGLPADAKPREVYNLFRDFPGYVSSHLRTGKSSQAYAVCCVCRSTVCTSCLECTNGMVFDLEKNVLFM

SEQ ID NO: 94925 - DNA, 785 bp, Zea mays
  misc_feature: Ceres CLONE 1584917
  misc_feature: Encodes the peptide sequence at SEQ ID NO. 94926
  misc_feature (584)..(584): n is a, c, t, g, unknown, or other
  misc_feature (601)..(601): n is a, c, t, g, unknown, or other
ctccccgcggtggcggccgctctagaactagtggatcccccgggctgcaggaattcgtctcacccctagaaaaaacgacgatgatatttcgcatcacacttccgtctggccaccgcaaagcaccccctctccccccgtcgccatggcgagcgataaccgcgcgtcggtcttccccttcgccgccgccgtccttgtggtgctcctcgctggcggcgccgcggcggacgacgcctccagcgacgacgacgctgggacttcacggacacccggctgctccaacaagttccagctggtcaaggtgaagaattgggtgaatgggactgaaggtacaacttttgttggcctaagtgcaaaatttggagctcccttgccaagagatattcatgaagcaaaaaagtcatttgctgtcctctcaaatccaattgactgttgctccaacttgacatcaaagttaacaagttcagttgctatagcaacacgtggggaatgtgctttcacggaaaaagcaaatattgctcaggccagtggttcgaccggtttactagttatcaatgataatgaagagctttacaagatggtttgcnggtgagaatgacacctncattaatgtgacaatacctgttgtcatgataccacagtcagcaggaaagaagctgaagaactattgcatcatggagcaagtgtggaatgcagctatattcacaaatcgaccactgttggacctttgagcatgcttcctatggaaaatggctgtaggcccatagcctgtggcttcactcgggacg

SEQ ID NO: 94926 - protein, 147 aa, Zea mays
  misc_feature: Ceres CLONE 1584917
MASDNRASVFPFAAAVLVVLLAGGAAADDASSDDDAGTSRTPGCSNKFQLVKVKNWVNGTEGTTFVGLSAKFGAPLPRDIHEAKKSFAVLSNPIDCCSNLTSKLTSSVAIATRGECAFTEKANIAQASGSTGLLVINDNEELYKMVC

SEQ ID NO: 94927 - DNA, 1129 bp, Zea mays
  misc_feature: Ceres CLONE 1584925
  misc_feature: Encodes the peptide sequence at SEQ ID NO. 94928
  misc_feature (11)..(11): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (701)..(701): n is a, c, t, g, unknown, or other
aaaattttttntagggaatgttaannnaaggcagaaccccannnacaaggaccacctatgaacaaaaaataggaaagctcacagtaagaggtgatcaatctggaatagtggatccaccgagctgcatgaattcgtctcacccctagaaaaattccctcccgtaccgtatcagtctcccggattctctccggttcgtgggaggaccaaagcttcgagttaggaaaaccctaccgctatgggagtagcctccggcgatggctgcggcggcgatcctgccggagctggcgacgacagtgctcatcccggtcgcggaggccgtgggcatcacgttcgcggtggtgcagtgggtgctggtctccaaggtgcgggtcacccccgagcgccgcgcggacggcggggccgtgaagagcgggcccagcgactacctcgtcgacgacgaggagggactcaacaaccactacgtcgtcggggaggtgcgcctagaaccagaacggccatctcctgaaaagagcatacattattcacttttcacctcagtaacaagtatgcttggaattatttcacggggtcaacctatgtccaaatcccttattggttccctactttccatttgggatacagatcaaaaaggggaattccaccaccgaaaacaaaagtccaaaccctttggcccctacgatatattccatagagaatcccancaaaccttgtgcccaagaacccctgtccgcccctttgagggcgaaataaatgggccccaaattcctttcaaaaagagtacctcacacaaaaaagcaattattcggtggttcacttggggtaagtacaatataagagcccctgccattgtaaaaattcattcctcggggctgttttctctgttgagaaaattggaataaaattctgccccaactctatcacgcccaaaaatatagacccggaaacaagagcttttgtgaaaggggcgcccaaatataaggcgctgttccgccaaaaaaggctattctaaattagttgtgccccttgcagcaaactggggtgtctacttgaaaggcggtcctccccagggtcttcctgtcacaacagggcctcaaaaggcgtgcctgataacgtgaactcaccaatttgc

SEQ ID NO: 94928 - protein, 214 aa, Zea mays
  misc_feature: Ceres CLONE 1584925
  misc_feature: SWISSPROT Homolog: EC 3.6.1.1 Inorganic diphosphatase
  misc_feature (149)..(149): Xaa is any aa, unknown, or other
MAAAAILPELATTVLIPVAEAVGITFAVVQWVLVSKVRVTPERRADGGAVKSGPSDYLVDDEEGLNNHYVVGEVRLEPERPSPEKSIHYSLFTSVTSMLGIISRGQPMSKSLIGSLLSIWDTDQKGEFHHRKQKSKPFGPYDIFHRESXQTLCPRTPVRPFEGEINGPQIPFKKSTSHKKAIIRWFTWGKYNIRAPAIVKIHSSGLFSLLRKLE

SEQ ID NO: 94929 - DNA, 1018 bp, Zea mays
  misc_feature: Ceres CLONE 1584927
  misc_feature: Encodes the peptide sequence at SEQ ID NO. 94930
  misc_feature (220)..(220): n is a, c, t, g, unknown, or other
  misc_feature (601)..(601): n is a, c, t, g, unknown, or other
  misc_feature (778)..(778): n is a, c, t, g, unknown, or other
ctctccgcggtggcggccgctctagactagtggatccccgcggctgcaggaattcgtctcacccctagaaaaatatgaaaacggtgatcacgacaaagagcgtggagttcatgccattcttcctgtccttcttcctcttcctcaacggaggcgtctgggcaacgtacgcggtgcttgaccgcgacatcttcctcgggatccccaatgggataggcttcgngccaggcaccatccagctggatcgcctacgcgatcttcatgaacaagagggcgtcccacggcggcaaggaaacaacgtcccgccccgctgctgattgggcccggaggggggaagaagggcacagccccttcgcccgcccatccgaccggagaggggggggagggaaggagtaggataaagtgggcccccccccggggggatagtttgcgaaacagctgataaccctcgtacactccgacctcgaggagtgaggctaaaatccacacgatatgccccacaagcccccccggtctgcccccagcagttttccccccacactaaggagtcctcggctggttatcgcgcaccccctcgccaccgatccagtgcgtttatacacanttaaaatatagccccggatcccaggtatcgagtcccccaggtgtggactttttttccacattctgttcgcgcgacgggccacaccctgcgaacagctaccggtttatcgcaattgcggccgccgccgcgcccgcgtgctccgcagacccacgactaccgagcccacaacccgtctgntttcttcttagcacaactgaggacgcacgcacgaatgcgcggccccgccggctctgggccggcatgtacctcacgatttcctgtagacacccaccagacgacccctacccgacgttccctgacctgctcgagcgtgcccgcggaccatgcgtcgacgcctagcccctaaactacgactttcgcgccgaaagcaggatttagtttgttgattcccctcttacaccctcgagcgccaatcac

SEQ ID NO: 94930 - protein, 79 aa, Zea mays
  misc_feature: Ceres CLONE 1584927
  misc_feature (1)..(60): Pfam Name: MtN3_slv Pfam Description: MtN3/saliva family
  misc_feature (49)..(49): Xaa is any aa, unknown, or other
MKTVITTKSVEFMPFFLSFFLFLNGGVWATYAVLDRDIFLGIPNGIGFXPGTIQLDRLRDLHEQEGVPRRQGNNVPPRC

SEQ ID NO: 94931 - DNA, 902 bp, Zea mays
  misc_feature: Ceres CLONE 1584930
  misc_feature: Translation starting site: 171
  misc_feature: SWISSPROT Homolog: EC 3.2.1.39 Glucan endo-1,3-beta-D-glucosidase
  misc_feature (367)..(367): n is a, c, t, g, unknown, or other
  misc_feature (393)..(393): n is a, c, t, g, unknown, or other
  misc_feature (394)..(394): n is a, c, t, g, unknown, or other
  misc_feature (399)..(399): n is a, c, t, g, unknown, or other
  misc_feature (403)..(403): n is a, c, t, g, unknown, or other
  misc_feature (405)..(405): n is a, c, t, g, unknown, or other
  misc_feature (407)..(407): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (468)..(468): n is a, c, t, g, unknown, or other
  misc_feature (539)..(539): n is a, c, t, g, unknown, or other
  misc_feature (619)..(619): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
ctggagctccccgcggtggcggccgctctagaactagtggatcccccgggctgcaggaattcgtctcacccctagaaaaaaaacggctggggcgtggcttcacttcacgttgagcatcctctctttccttttcccccaaactccaaatccaatccaagcaagtcctccccatgctcctcccgctcctcctcctcgccgccttcctccatggcttggcggaggcgcagggcggcctcccgtcgctgccgatcggggtgaactacggcgcgaacgcagacaacctaccctcgcccgccgccgtggcggcgttcctggccagagcacgaccatcgaccgcgtgaagctgttcgacgcgaacccgggcttnctcgacgcgttcgcgtcaaagggccnntcatngccntngncgttttcattcccaaattcggcccttccgtcttttgccgaaagatctcggnnnntggaggncgcccccggggtggtccccaacaacttgtcccccacgggtccggggggggcaaaataacctttctattttngggaacaaaagttttggcccccccgcggggcggaaaaccccccggggggctctccccggcacgaccccccttctcaaagntttacgatgtggggggcgtccaaaggggtgttataaaaccccaaaaacgacctcgtttgggcccctgtgggggggcgactccaaacggnnntcccctctcgggggggggacaaaaaggggggggcgtccctggtatgtactgaaaaaaaaaggggcccttttttggtgggggaacgccccccctcttttaataaaaaccccccccccagggaaagaaagggggtggcccccccccccccgcggtgtgtaaaaacgcgggggcgggtttttataattttttttg

SEQ ID NO: 94932 - DNA, 866 bp, Zea mays
  misc_feature: Ceres CLONE 1584936
  misc_feature: Encodes the peptide sequence at SEQ ID NO. 94933
  misc_feature (522)..(522): n is a, c, t, g, unknown, or other
  misc_feature (526)..(526): n is a, c, t, g, unknown, or other
  misc_feature (527)..(527): n is a, c, t, g, unknown, or other
  misc_feature (536)..(536): n is a, c, t, g, unknown, or other
  misc_feature (547)..(547): n is a, c, t, g, unknown, or other
  misc_feature (550)..(550): n is a, c, t, g, unknown, or other
  misc_feature (551)..(551): n is a, c, t, g, unknown, or other
gagctccccgcggtggcggccgctctagaactagtggatcccccgggctgcaggaattcgtctcacccctagaaaaaaaaaaaccccgctctaataaatcttcctcccatctctctcgctcccaaccctcaagtccccaccaacccaaccctggtggcaccggccgcacacaccaaagcaagctagctagtcactattagagctatttggttgggagcagtttagctcagcaagatcgaactggcattgtcacacacatctcagctccttgggttttccctctccatgagcagcagccacacattgccgtcttccttgctgcacttgtagttacagctagatccatctccccgccacttgattttttggcaagaacaagagcaggagctactgagcaagaagtaagtgcgtacgtgcttagtgagttatacttatactagcttgcgggcgggcggggcgcgctgcaatggagctggtgactatcgtgacgctgacgctactggcgtactcggcggcaatgcntgcnncggtgctgntggcgcgcgcncanncgcgtcggtgctacctgctggactacgtgtgctacaaagctaacgacgaacggaaactgccaaacgaacttgtgcggggagaatattcaacggaaacaacctgctgggggttggaggaatacaaattcccccttaaaagggaattggaaacctccgggctcgcggaaaaagaaaataaggcccccccaaaaataaataaagggggggggagaggcccccggaaaacctttcccggagggttttaaaaaaaaataacaaaaacttttcccccggctcctcaaaaaaatttttcttcccgggggggggggcccgggg

SEQ ID NO: 94933 - protein, 109 aa, Zea mays
  misc_feature: Ceres CLONE 1584936
  misc_feature (19)..(19): Xaa is any aa, unknown, or other
  misc_feature (21)..(21): Xaa is any aa, unknown, or other
  misc_feature (24)..(24): Xaa is any aa, unknown, or other
  misc_feature (28)..(28): Xaa is any aa, unknown, or other
  misc_feature (29)..(29): Xaa is any aa, unknown, or other
MELVTIVTLTLLAYSAAMXAXVLXARAXXRRCYLLDYVCYKANDERKLPNELVRGEYSTETTCWGLEEYKFPLKRELETSGLAEKENKAPPKINKGGGRGPRKTFPGGF

SEQ ID NO: 94934 - DNA, 827 bp, Zea mays
  misc_feature: Ceres CLONE 1584937
  misc_feature: Encodes the peptide sequence at SEQ ID NO. 94935
ctccccgcggtggcggccgctctagaactagtggatcccccgggctgcaggaattcgtctcacccctagaaaaaagcgcgagggtcagtgttcgaggttgcttgggtagcactactttttcctagagctggggcatgcatatatccatgtgcaggagtgttgctagcagcattggatttgccccagtgtactacagactcgacaggtgagcataaaagaggagagccgataagcacaatggcgcctgaggaaaggatgaagcagacagagggcagtcacaaggcggtaacagcagcgggaggtggcaagatggcggtcggagtgaggagcatcgtgacctccctggtggctttcttcatcctagccagctccgtggtgttcctcctcgacagagaagccgggctccaagaagaaccggcgataagagccggcggcggcggcggcaacaagaagtgcagctggtctcgggggcgctgggtgtacgacaacgtgtcccggccgctgtacgacgggctcaagtgcgccttcatcttccccgagggtgcctgtgacaagtatgcaagaaaggatttcattgtacagcactggaaaatggcagccccattggcctggaatgcaaccctcccaagtaaggatggatgtatggaatggaatggaaacttttgggctggaaagaaatgcaagcatggccccccaaaaccttaccctttccgggaaaaaaaaattccgaggggcccaaaccccctttgggagactggaaaaaaaaaaacgtgtgggtttggggggaaacccgggaaaaaggaaaccaaagggggccttcccctggt

SEQ ID NO: 94935 - protein, 196 aa, Zea mays
  misc_feature: Ceres CLONE 1584937
MAPEERMKQTEGSHKAVTAAGGGKMAVGVRSIVTSLVAFFILASSVVFLLDREAGLQEEPAIRAGGGGGNKKCSWSRGRWVYDNVSRPLYDGLKCAFIFPEGACDKYARKDFIVQHWKMAAPLAWNATLPSKDGCMEWNGNFWAGKKCKHGPPKPYPFREKKIPRGPNPLWETGKKKTCGFGGKPGKKETKGGLPL

SEQ ID NO: 94936 - DNA, 953 bp, Zea mays
  misc_feature: Ceres CLONE 1584938
  misc_feature: Encodes the peptide sequence at SEQ ID NO. 94937
tggagctccccgcggtggcggccgctctagaactagtggatcccccgggctgcaggaattcgtctcacccctagaaaaaaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctggtgggccttgtggtgcgtcgtcgccgctttcgtcctcatcggcctccccatcatcatcgccaaacccatcccgcacaagaggccaggcccgccgccgccagatcagtacacagaggcgctgcacaaggcgctcctcttctttcacggccagaaatctgggcaccttcccaagaccaatgggatcaaagtggcgcggggaactttggcttgtcaaaagggctcgaaccccaagggaattcaaggggggccctttttgggggggtattaaaagcctgggcaaaaaaattaagttccccctttcccaaagggcttttcccccaaaccccttttaaacgtggcggggaataaaaaaacacgccccaaaaacaaagggcccgggggggagattacaccctttttggggggccccttttaggggggggccgcccaaatttggggaaacacccttaaaaccctcctgttttccccacaacaaaaaaattttcccccccgggggggggtgggcaaaaaataaaaggggggcggcgggggaaaaatatattttttttaacccccccgggagaagaaagagggccccccccccctctctttggggaggaaccccctccccgtagtgggggggg

SEQ ID NO: 94937 - protein, 163 aa, Zea mays
  misc_feature: Ceres CLONE 1584938
  misc_feature: SWISSPROT Homolog: EC 3.2.1.4 Cellulase
MYSANHWGGSFEIADGAAEDDHSRNMDLDRGALSARQHHELDETQQSWLLGPPEAKKKDKYVDLGCVVVKRKLLWWALWCVVAAFVLIGLPIIIAKPIPHKRPGPPPPDQYTEALHKALLFFHGQKSGHLPKTNGIKVARGTLACQKGSNPKGIQGGPFLGGY

SEQ ID NO: 94938 - DNA, 831 bp, Zea mays
  misc_feature: Ceres CLONE 1584940
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
ctggagctccccgcggtggcggccgctctagaactagtggatcccccgggctgcaggaattcgtctcacccctagaaaaacgggaaggaggaagatgacggtgacgccacggatcacggtgagcgacgggcggctgacggtgcgcggccgtacggtgctcaccggcgtgccggacaaccccttcgacaccgtcaccgccgccgtcaaggcggtggagaagcacctgcagacgttccaccacccgcgacagaagagctgccgtcgttcctcgactggttcggctgggtgcactgggacgcctttctacaccgacgttcaccgccgaacggggtttaaaaaacgggcctttttaaaacccttgttcccaagggggggggggggccccccccccccccggtttttttctttttttttttttaaaaccccccgtggggaaaaaaaaaaccccctccccaaaaaaaaaaaaaccccccccccccccccccattttttctccctttttaaggagggagggggggggcgcaaattttttttctcccccccccccgcgtttttttttccgggggaatattttgggaggaaaaaaaacccctttttttttttttaaaaaaaaaaccccccccctaattttttccgccaaaagaaaaaaaaaaaagcccccccgcggggggggggaaaaaaaaagggggtgggaaaaaaaaaaacacccccaccccccaaagaggtgtttttttttttttctcnnnnnnnnggtttttttaaaggaaaggagaaaaaccccccccgcggnnnnnnnnnnnnnnnnnnnnnnnnnnntnnnnnnnnntnnnn

SEQ ID NO: 94939 - DNA, 950 bp, Zea mays
  misc_feature: Ceres CLONE 1584944
ctccccgcggtggcggccgctctagaactagtggatcccccgggctgcaggaattcgtctcaccccttgaaaaaaaagaccaggtgctcatgcactacatcctccagctggacgagcgagaagccgcctccctggtccgaaagcgcccacgcgcccgacatggacctcccgccgccgggccgtcacatcatgggcgaactctccgacgttacggccgcaaccgccgccgctggtggtcctggcacgccggccgccgctagcgcgcagctacacgcgctgccccaccagctccaccagctgcccccaacgttgcaccaccacgcggcggaggtggacatgccccagtaacatcactcgcgggcccattctcaaggtggcggcgaggcgcccgcgtccaccaccgcgggggtggacggcatcttccgggacatcttcatgagcaccggccgggggtgcgttctccttcacccccctcgtccacaaggtccggcgagatcaatcgacccctggcaacccagggcctcgtcgtccctccttcgagggtccgccctccgtttccccttctcggccgccctaaccccccccccggcttgccttcagccagtcagcgtcctcttcccctttccacaggagactaccggcccggcccaccttggggggggctgggcgacttcccttttttcccgccaccggggttccctggacaaggcggccccccacccaaggacttggggcccccggggggcccagcccggcaaaccgggagggggaggaggggacactttccggggcgccgctggggtaaaccaaaataggtctcgcgaaccggccagggaggagaacgagctggtcgcccacgagttcgccgccttggggcgctacgggcccgccgtgtggacaatagaaagcccataaagtgatagaggccactggtgcatgaaaaataaaca

SEQ ID NO: 94940 - DNA, 837 bp, Zea mays
  misc_feature: Ceres CLONE 1584947
  misc_feature: Encodes the peptide sequence at SEQ ID NO. 94941
ctccccgcggtggcggccgctctagaactagtggatcccccgggctgcaggaattcgtctcacccctagaaaaatcacttggccaccataaccacaacctcttctcccctgtttcctctcgtgcgttctccgcaggagcgaggagggctcgcggcagcggcagggtctccgggtacgtcgtgaatgagaagagaaagggttggaggaaatatttccgaatctgtctccattacgattttggtggcgtagaatttggtttcaaacgcgcagttatgcgcacactagatcagatccgacttgttctgcggcattccgattgcttggcccttttttgccgattagttatctacgtaaaccatggtcggcataatgcgtttttgtttattgccttggtctctgaataaaggtagttattatttggttcttgggtaatggagtgccattgaatggtccctgcatagcgtggtattggttctgtagatttagatgaatcacagtgtcaagagagacaagattcacctgaatcctctgctaaatctgaaaaatagagatgatccaaggtcctctgctgaaaatgcagttttcttgttaataccaagcattctgccgtttcctattgagatagatattctgttactgatttttaccctagcttggtctcctctcctcctagtgtttttgttccagaatctgtagcaaatggctgacggcgaggacatccagccccttgttttgtgacatggaactggcatggtcaaggctggttttgctggtgacgatgcgccaagggctgttttcccaagcattgttggacgcccactgcacactgggcgtgac

SEQ ID NO: 94941 - protein, 29 aa, Zea mays
  misc_feature: Ceres CLONE 1584947
  misc_feature: SWISSPROT Homolog: EC 2.7.10.2 Non-specific protein-tyrosine kinase
MVKAGFAGDDAPRAVFPSIVGRPLHTGRD

SEQ ID NO: 94942 - DNA, 812 bp, Zea mays
  misc_feature: Ceres CLONE 1584950
  misc_feature: Encodes the peptide sequence at SEQ ID NO. 94943
gcggtggcggccgctctagaactagtggatcccccgggctgcaggaattcgtctcacccctagaaaaaatcgtcctctcctttgccagcgccgccgaacccgccaccagccttctcccatcctcgaagcacggaaggctcccagaaggagctctcacctcgcagccatctctggcacgtccgtccttcttctccctcggtccctccccttctccacagctatcggattggcgttggagtggagatcgacccgggctcggaattcccttcgttgttaattttctaggaagattggggtttcagctcaaactcccatgctcgacgctgaggacgaccctggcgggagatgacgaggatcttcgtgcagcgcgggaccgccggctcctcgtccagctccggccgctcggacacgcagccagtgcagccggcagcagctgcccgggaggaggagttgccgctgcaacctcaaccacagctgccggagctattggccatagatgatacaactgataatttaaatgagggcagcgagaatatcagcaataagcctttgaggacggatgacaccatttcagagagctcaagctccgcagaggagagggctgccagggagaagcctcttaaggatgactctaatgtaatcaaccccactttcttagtagaggaacctgtagggatccagatccctgatcagattgagcatgaaaattctgtgctgtcagtcactggttcatcacagatggcaggtgcagcatcgcacccaccaccaccgccagctcccacctcaaaaaacattggtggggaatatggcta

SEQ ID NO: 94943 - protein, 155 aa, Zea mays
  misc_feature: Ceres CLONE 1584950
MTRIFVQRGTAGSSSSSGRSDTQPVQPAAAAREEELPLQPQPQLPELLAIDDTTDNLNEGSENISNKPLRTDDTISESSSSAEERAAREKPLKDDSNVINPTFLVEEPVGIQIPDQIEHENSVLSVTGSSQMAGAASHPPPPPAPTSKNIGGEYG

SEQ ID NO: 94944 - DNA, 970 bp, Zea mays
  misc_feature: Ceres CLONE 1584952
  misc_feature: Encodes the peptide sequence at SEQ ID NO. 94945
aagctggagctccccgcggtggcggccgctctagactagtggatcccccgggctgcaggaattcgtctcacccctagaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctgggcgcgttctgcgccaacgccaccacctctgggcgcgtcacatgtccgcggagtggatgccggggagcacgccctggccactcgacggttcttctccgggggactcgggtttattccgctgggccctccgaccgggcccggaaaatttccaggggtttagggcccccccaccttttccccctggcccctggggcccatttttttgccctcccccggggatcccttggtggcccgaaaaattttgtgggccctgggcgcaaactgggggaaaaaaggcccacagagaaggggggggggggctctctcccccccggagaggggggggggggccccctttactcttggtggggcgcgccccccccggtgctgtcctggtggggggagaaatcattgttctcgacaaaactatatctttggtgggggtaaacaaaaatatatgtggtggggtgagacatgtcgttctctttttcccgcggaggagcaccccgccgccgcctccccctttggggaggaaggagccgctctctccttagaagaagaaaaaaaggatcccccgccggggggggagctgtttattaacccctcctcttgtgttttttttttataaaattccccccccccccaccccttgtgggtgggggggagagatgtctattggagaaaaaaaaaaaaaaagcgccctcccccccctccccagggggcgtatcccctgggccccccctctgggtgggtggggggg

SEQ ID NO: 94945 - protein, 171 aa, Zea mays
  misc_feature: Ceres CLONE 1584952
MVMASSSGLRSCSAVGVPSLLAPSSRSGRLGAFCANATTSGRVTCPRSGCRGARPGHSTVLLRGTRVYSAGPSDRARKISRGLGPPHLFPLAPGAHFFALPRGSLGGPKNFVGPGRKLGEKRPTEKGGGGSLPPGEGGGGPLYSWWGAPPPVLSWWGEKSLFSTKLYLWWG

SEQ ID NO: 94946 - DNA, 1134 bp, Zea mays
  misc_feature: Ceres CLONE 1584954
  misc_feature (28)..(28): n is a, c, t, g, unknown, or other
  misc_feature (510)..(510): n is a, c, t, g, unknown, or other
  misc_feature (517)..(517): n is a, c, t, g, unknown, or other
  misc_feature (599)..(599): n is a, c, t, g, unknown, or other
cacgcccaccccgacccccacacccccnccccccacccccgcgccccccgtccgcgcccggaggagcgccgccccacacaacggctccccccgggggggggcgctctagaatagtggatcccccgggctgcaggaattcgtctcacccctagaaaaagccgatctctcccacacaaacacaggtcacacgcacactgcagcgtggcgcggctactccccgccatggccaccacctccgtcgccgcctcctctccccatccccatctgtcccgcccccgccggcggaactccagcgccacctccagagcctcgatccggggctgcctcctgcccatccgatgctcgtccgcctcgtcgtcgcaaccgccggcaaccggcggtgaggagggagagtcggggcgccggcggctgtcgaagcagtcgtcgtgggaggacagagatgtggagggggacgactacctctaccgcctcgggaaggaggctgacaacttgaacatcacccgtcggcgncacgggncccgggcattcgtgaaacaaacttcttccctccggaaaaactttccttcggggaaaaaaaaacccgagaaatatcctggggnttttccccccacctcccccgggcgaaaaaaggggcgaattttaaaaaaaagtgtttcgaaaaaataaccctgtcgagtggggggggggttatttttattaacagttttccgggcaacccctggtggaccatcattcttccccgcgtgggagaagagataacaaccaaacagtttttggggggagaaaataaaaaaaattgggtgggtgataaaacgacgcgcaataattatattaaagcggtcgtttaaaaagaggggggagcccctcccctcgcgaaaacaaaaaaatattttcccccctgtgtgttgtttggtgcgggggggcacccacacagaaaactccagcaacaaaaccctcctcataagaggcggaccacaatttttccggctgtgaggggtcatacaacaccaaaactcagccccaacctttgtcttgataataaaagaatcaccctctcttgtttgtcaaacccagtatacttctcttttaaaaaaaaattaaccagagggggggtggctgcccccaaaaaaagaa

SEQ ID NO: 94947 - DNA, 907 bp, Zea mays
  misc_feature: Ceres CLONE 1584961
  misc_feature: Encodes the peptide sequence at SEQ ID NO. 94948
  misc_feature (852)..(852): n is a, c, t, g, unknown, or other
  misc_feature (907)..(907): n is a, c, t, g, unknown, or other
caaaagctggagctccccgcggtggcggccgctctagaactagtggatcccccgggctgcaggaattcgtctcacccctagaaaaatccaggtaaaaggaaaaatcgccccatcccctgactatcactggctcactgcccttccacctacaggttccagcggccatggtgaagaatcccaacagggtccccaaggccacagacacctctgctgacgcggtaccccagccatccaaggagaatccatccacccctgagttggtcaaggcctcgaagtttaaaaagagaaaggtcaaggcccaccgtgcgaaacatgcagtcgctgcagcacctagtgacgacgtcgcccctgtaggagcaggcactggtgatggcgatgcatctgcatcagcggctttaccccaaccatccgatgttgccaaggcgttacttctggtgcaaactccaaagtcaagcacttttcgctgaggcatccccagtgggacacacgccgaaagccgccacgggatgctgaaggattggtcccggcaccaataccaaccactggggaagaattccccttcttttccgaaggccaaaatcagttcaaccctaaggtggaaatttcacattggaattttctgcatacaggggccaaagggcggggtgtcctttttattaaaggggggattgttaaaaatacacccccgagaacccccgggtcctcatttataaaagggaaaaaaatttctctccaacaaggggggaaatttatgaacaaggttttccttgggaaaaaccccagggggtgtcccccactatatagccggggtagggggatatcccccttttcactcgctgtggtgtaactctnaaaagggacgccccctccactatctcgtctttaaaaagagtgaggcacgctagtn

SEQ ID NO: 94948 - protein, 100 aa, Zea mays
  misc_feature: Ceres CLONE 1584961
MVKNPNRVPKATDTSADAVPQPSKENPSTPELVKASKFKKRKVKAHRAKHAVAAAPSDDVAPVGAGTGDGDASASAALPQPSDVAKALLLVQTPKSSTFR

SEQ ID NO: 94949 - DNA, 1270 bp, Zea mays
  misc_feature: Ceres CLONE 1584965
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (412)..(412): n is a, c, t, g, unknown, or other
  misc_feature (687)..(687): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (768)..(768): n is a, c, t, g, unknown, or other
  misc_feature (770)..(770): n is a, c, t, g, unknown, or other
  misc_feature (806)..(806): n is a, c, t, g, unknown, or other
  misc_feature (812)..(812): n is a, c, t, g, unknown, or other
  misc_feature (815)..(815): n is a, c, t, g, unknown, or other
  misc_feature (843)..(843): n is a, c, t, g, unknown, or other
  misc_feature (963)..(963): n is a, c, t, g, unknown, or other
  misc_feature (974)..(974): n is a, c, t, g, unknown, or other
  misc_feature (1014)..(1014): n is a, c, t, g, unknown, or other
  misc_feature (1069)..(1069): n is a, c, t, g, unknown, or other
  misc_feature (1089)..(1089): n is a, c, t, g, unknown, or other
  misc_feature (1090)..(1090): n is a, c, t, g, unknown, or other
  misc_feature (1094)..(1094): n is a, c, t, g, unknown, or other
  misc_feature (1216)..(1216): n is a, c, t, g, unknown, or other
  misc_feature (1238)..(1238): n is a, c, t, g, unknown, or other
  misc_feature (1270)..(1270): n is a, c, t, g, unknown, or other
ggggggggggggggggggggagtgggtgttnntnnnttnntnnatttggnnnnnatnnnnnnccagagtggggctccccgcggtggcggccgctctagaactagtggatcccccgggctgcaggaattcgtctcacccctagaaaaagccccattgctcgctcgctcgccaagagttcttcttgttaggcaaggcaaaagcagaagcaaaaaaagaaaggaaaaagaaaggtcttgttgccgatggggagctcagggttctcgtggacgcttccggaccaccccagctccccaggggaaaccgggggctgtcccccgggcgggcgggtggggggaggccaacccccacaggggcgccgggttttttggcgcccagcacccccccccccctagagtgcgcggcttagcccccnctccctcgagcggggcgtgtcgatgtgtcggtgggacgcggtctcctcccccagcgggtcccgtccaaccgtgtagctttcctaggcgtcgtggagacgtttacccgcgcgacgcgggtgggggggggggggggaggttgtgcagcaatgacgtgcgtcggggcaggggggggggaaggaaacgccgccaccagagcgacgagacagggggtgcgagcgcatcgcggggggaggggaggacaggaacagccactccgaccctcccccccgcgacnccagaccgcgggggcgggcgagttagtccgtgcgtcctttttcccacaaaggtattgtgagcccccccccnnnnccggggngnggggatatggccccgggggtgaggagggggatgtgntcgggngcncgggagcgggaggtgaggtgtggaggtnacagagaggagcggcgcctccacgggacccgtcgcggtggcgcccgcttctcggcgaactcacctgcggaggaagcgacaatgtaggtgggtctctggggctgcccgcgggggcgctgtngtggtcggcgncatgcgctacgtttccacgggaggggaggagagaagcttnacgcacccataccttcgcaaatccccagacgctggctcattggtcgcatagcggncgagtgggggagccctacgnnaacntcctgcactgcgcgcgtgagagtaccaaatccatatctccccagcattgaacttatccggcagagttcatcggccgctgtcccatcggagtgaactttccgctgaggacatgaaagacagtnatctattaggctccaaaactcnagcttcgggcgtacgcccactacccaccacgn

SEQ ID NO: 94950 - DNA, 1094 bp, Zea mays
  misc_feature: Ceres CLONE 1584967
  misc_feature: Encodes the peptide sequence at SEQ ID NO. 94951
  misc_feature (12)..(12): n is a, c, t, g, unknown, or other
  misc_feature (13)..(13): n is a, c, t, g, unknown, or other
  misc_feature (19)..(19): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (64)..(64): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
ggggggtggttnnctctcntttcctcttacgcccgggggaggttnnnntatccccaccgaaatncgccnnnnnnnaaaaactggaactccccgcggtggcggccgctctagactagtggatcccccgggctgcatgaattcgtctcacccctagaaaaatcccacgctgccctcggcgctgcgcctggacccggcacctacctcccccctccccacctcgccgccggcgggtggagtcgggctggagcagccgctctcctctgttacccccctaaccccctataaagaaaaagaaaaaaaaacagagagagagagcgagcgaccggcggctcggcagccatggggcacggcgtcagctgcgcccgcaccggcgacgagcacgactacttccgcgcggcgcaggtcggggacctcgaggccctggacgcgctcctcgacgaagaaacctctctcgcccgccgcgccacgctctacgaccgcccccccgggctccacatcaccgccgcgaatggccgcctcgaggtgctgtcaatggtcattggatcacgggggtgcccgccgggacttggtgaaatcggcaacaagcaagacccccgctgaatggctggcggccgattgcacgggtaaagacttgtactggcgttgcctggaaagcctccctgccagggcccggggcgcccaaataataccctccaagtggttcggaatatccccaagtcaaacgggggcaggagaaccctatgcccttgaccaaccatacggccgggttcccttaaacttttccggggccccaaccgtttcggggcattggctccttgccatggggcacgcaattcccttcaaactggggccgggacccccggtgaaatcccacccgcccggggttggggcccgcgataccctccttgtggggggttgtttctgcacccgggggttccgcttctaaccgcctggaggggggaaacaaaacctcaccggggaggccctagaagcccgtagtcgccaccgcttggtactgtcccagggtttaagagggccccccccccccggggattgtgcgttagccaaggggacccttggcgtgagaaaaaaaa

SEQ ID NO: 94951 - protein, 86 aa, Zea mays
  misc_feature: Ceres CLONE 1584967
MGHGVSCARTGDEHDYFRAAQVGDLEALDALLDEETSLARRATLYDRPPGLHITAANGRLEVLSMVIGSRGCPPGLGEIGNKQDPR

SEQ ID NO: 94952 - DNA, 906 bp, Zea mays
  misc_feature: Ceres CLONE 1584968
  misc_feature: Encodes the peptide sequence at SEQ ID NO. 94953
aaagctggagctccccgcggtggcggccgctctagaactagtggatcccccgggctgcaggaattcgtctcacccctagaaaaagagatcgaaatcgaacccaaacggccaaaccaaccatcgtctactcggcggctgggctagcaccctccctaccaccatggcggccgtcgtgcctccgcccgacaacctggacccgcagccggctactcccccagccgccgctccttccgccacgctcaccccgcctcccgccgccacctccaccccaccaacccccttgacgccgggccccgcggcgcctagcccaaaccctaacctaccccctgcccctgcccctgcccctgcccccgcccccgcttccacgcctccggcggcagtcgcgccaccgatgcccccagctccgatctccttcgctgctaccttccgtccactcggtgccccagcgccaccgccgccgtaccaggtcccgcagtacgtcgcggtgccggcgaacccgggctacccgatgcagccgccgggcgtccccgtcgttatgcctccgggcgccgtgcggctgccggccatgtacgggccgccccagccgggagtatacatgccgcagcagggcgctgcgatcccccatcccggagaattgagaggatttgtaccatggaccttggcagtgtgttggttagcatttagagcgggggtcgtgcccagcattactccccacaacaagaggtgccggctcatgtttgattcttgcacctctagatcgtttgctccctcactgaggggggatgcttcagctctggggtgttcccaagaacttgctaagggatcctggaattttctgccggtttaaatttccaatggccggcaaaaatcctttttttttgccgggttccaaaataaacttctttt

SEQ ID NO: 94953 - protein, 151 aa, Zea mays
  misc_feature: Ceres CLONE 1584968
MPPAPISFAATFRPLGAPAPPPPYQVPQYVAVPANPGYPMQPPGVPVVMPPGAVRLPAMYGPPQPGVYMPQQGAAIPHPGELRGFVPWTLAVCWLAFRAGVVPSITPHNKRCRLMFDSCTSRSFAPSLRGDASALGCSQELAKGSWNFLPV

SEQ ID NO: 94954 - DNA, 883 bp, Zea mays
  misc_feature: Ceres CLONE 1584969
  misc_feature: Encodes the peptide sequence at SEQ ID NO. 94955
  misc_feature (883)..(883): n is a, c, t, g, unknown, or other
aaagctggagctccccgcggtggcggccgctctagaactagtggatcccccgggctgcaggaattcgtctcacccctagaaaaatttgttgtgaaactatgatgtatttgtcagttctgtaatgttcaaagattgaatcctattttgatgtcatttttgcgcttccacaatgtcctgattttaccattgccatgacttacagatctcaaaagttcagcgggtagcctatcaagatggccgaggaaactgccaatgacgctcaggtggcacaagataacgagattgctctcagcaatgaggcaatccaaggtgatgagttggtccatgttgaagagctgtcccaaggtgatgatttggttcaaggaaatgagctagttgtttctgaggtgacaactcctactattggaaccagacgaaggagaaagaagtctttggtatgggagcacttcactattgaagccgtcgcaggtggggccactagggcatgctgcaagctctgcaagcaaacctttgcttacagctctggttcaaagattgctgggactagccatctcaagaggcacatcaccttgggctcttgtcctaagataaagaatcaagagcagaggctggcgctgccctcaactggagggactgacaatgatggcgagggaactatagagcggcgacccaagagacgctacagatacactggttatgcaaatgctgcttttgatcaggaccgcagttgctcatacttggcaaagttgatcattcagcatgactacccactttacatggttcaaaagccgtcgtttgccatttttattgaaagtctgcagcccccctttcagagttgtgggaatgttgaaacgatgggaaggagaaggtttatggctgtttn

SEQ ID NO: 94955 - protein, 216 aa, Zea mays
  misc_feature: Ceres CLONE 1584969
  misc_feature (66)..(117): Pfam Name: zf-BED Pfam Description: BED zinc finger
MAEETANDAQVAQDNEIALSNEAIQGDELVHVEELSQGDDLVQGNELVVSEVTTPTIGTRRRRKKSLVWEHFTIEAVAGGATRACCKLCKQTFAYSSGSKIAGTSHLKRHITLGSCPKIKNQEQRLALPSTGGTDNDGEGTIERRPKRRYRYTGYANAAFDQDRSCSYLAKLIIQHDYPLYMVQKPSFAIFIESLQPPFQSCGNVETMGRRRFMAV

SEQ ID NO: 94956 - DNA, 1246 bp, Zea mays
  misc_feature: Ceres CLONE 1584979
  misc_feature: Encodes the peptide sequence at SEQ ID NO. 94957
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (44)..(44): n is a, c, t, g, unknown, or other
  misc_feature (48)..(48): n is a, c, t, g, unknown, or other
  misc_feature (49)..(49): n is a, c, t, g, unknown, or other
  misc_feature (1216)..(1216): n is a, c, t, g, unknown, or other
cacaaagcggatgcccgtcgctcccccnnncntttttnnnnccncccnnttgtggcccctctggcggggggaagctggagctccccgcggtggcggccgctctataactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaagtggaggagttctacgtcatcacggggacgtccccccaaggagcaggtgttcgaagatgcccacccggccggcgccgtccatcatgctggaaggggccccaaccctcttggaaagctgggtcccccaaaggagtcattggccctggtccgcttgggcacccagggttggccgcttcccaaggttccaaggaatcacactttccctattttctttactcgccttttttttccaccaaaacggagacggaaaggggggctaaattatacccttccccaccccgccccgaagggtgacacgggagggtttctgttatcctccagagtgaagaaaaaaggggggtcccaaaacgcccccccggcgggaaaaaagaaggttaagaagagggccgaggtttccgggggccccctggtataaaccttttcctacgactagaggtacactaccctggtgtaataatagaataagcgtatttctatctactcccctcataattcgtaaaaaccctgcctaaaaagctgttgagaaacgggcggcaagagggacgcgacactccctgtgtccgggtagaagaaatcacaataataaagtttcttcccaggggatgaaggcgcgcggagtggtgcctcttccaaataccgtgtgggtgtgtctctaaatgtttttgatggggagagcgagggtcgcgggccggtcctcataattatcaataatcagcaagagaggctggtgcgtgncaaacttctctgcacaggcccctgccgcca

SEQ ID NO: 94957 - protein, 182 aa, Zea mays
  misc_feature: Ceres CLONE 1584979
MAMATQASAATRHLLAAAWAPAAKPRQLSSQLALPSSSSRGPAPLRASTEEAVEAPKGFVAPQLDPSTPSPIFGGSTGGLLRKAQVEEFYVITGTSPQGAGVRRCPPGRRRPSCWKGPQPSWKAGSPKGVIGPGPLGHPGLAASQGSKESHFPYFLYSPFFSTKTETERGAKLYPSPPRPEG

SEQ ID NO: 94958 - DNA, 897 bp, Zea mays
  misc_feature: Ceres CLONE 1584983
ctccccgcggtggcggccgctctagaactagtggatcccccgggctgcaggaattcgtctcacccctagaaaaagcaatactcactcctagtcctggagtatagtcactactacccctagaagggaagcgcatccgctcgatacggggggtggcaggttggcgaggagacgaaaggcacggcgagcgagagcccaacgaccgtccagttccagttccagcggtccgagcgagatcgatcgcccctccgcaaggccgcaacaacagacgcggcaagcgggtacaagggagttcttctggaggcgcgggagatcacgcgagtgtgttgcgcttgaaaagaagaaaaaaacaagcagggaggagggagtcccgttcccgaacccgaactacaagcccacgcaactgctgctgccgccgcccgcccagcaggaggagcgagggcattgcccggccccatcgccgtcgcgccgtcgccgtcgccgcgctgcaggcagaggaggacggcgccggccagcatgggcgggtacgagctcgtcaggagcgacgacggcggcgggcgccgacgggagccgacctcgagtccggcttcgggagcaggaaagggggtcgggcgccctgccgaccatggcgggccccagtccggggtcaaccggccggcaaggcagctaaaacctggccttcggttcgaggtacttccgcgggggtaacccctcctggattatgatcattggtaggaccaaccctggggagacttcctgggcggggggctttaacccagtgctccccgggggacggggggacacaaaaaattcgaattggaatcatggcccgttccttcccttttttcgcaccgtgcgaaactcttttctttaaaaggcttcgcgggcccacacccgtgg

SEQ ID NO: 94959 - DNA, 914 bp, Zea mays
  misc_feature: Ceres CLONE 1584986
  misc_feature (793)..(793): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (802)..(802): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (811)..(811): n is a, c, t, g, unknown, or other
  misc_feature (812)..(812): n is a, c, t, g, unknown, or other
  misc_feature (816)..(816): n is a, c, t, g, unknown, or other
  misc_feature (818)..(818): n is a, c, t, g, unknown, or other
ctggagctcaccgcggtggcggccgctctagaactagtggatcccccgggctgcaggaattcgtctcacccctagaaaaactctacagccttacggctctcgctgagcctgcaggatctgaatccgagctcgctaggatcctctatgtgtctgccccacacgccctgttacttcctcccgctaacaatcggcctggtcccggtttgatccgttgaattcagccccggtcgcggggggcttgccggtggacagctgaagcatgcgtcaatgttctgggccaaaattctgtgcccgggagggggcctccttgtggagattttgaccgggccggctttgggccccttcccctccccccgggggaattttgtttttctcggggttccccaaggggaaacgccgccccccccccccacccaaaataatcacagccgcccaaaaaaaaacagtgggggtgctcccgagggaccaaacaaaacaaagagaatataaatcattcgttggctccaggccccccccccgccccgcttcttttttacaaacacaaaaaaaaggggtgggggcgggttggaccccgtccctgggccccgctccgttaaggtaaggagggcccaataggaaaaaaaaaggtttctctcgaaattaggtgggggggcggaggtggctctctcaatggtatatactcgcaccccaccgtgccggcggattgggaggccgcaggtaggttcaagcccgggaagggcggagataaagacactactattcatctgtggatctaagtatgcgtagccaaaanannnnnngnggggnnngnncctntncctcgggggggtgtagtgttgtggtgtttggtgtgtttcggcacccgcgatcctgccaggtgagactagagtggttagcggatgtggctgaggtga

SEQ ID NO: 94960 - DNA, 870 bp, Zea mays
  misc_feature: Ceres CLONE 1584987
  misc_feature: Encodes the peptide sequence at SEQ ID NO. 94961
ctggagctccccgcggtggcggccgctctagaactagtggatcccccgggctgcaggaattcgtctcacccctagaaaaaaataatgggagcgaggagtagtagcacttggacgcagcacctcctgctgctgttcttcctcgtcctcggcgtcgctaccaacagcagccattcttccaccatcaacatcaccaaccgatgctcctacacagtgtggccggccgccacaccagtgggcggcggcatgcagctggagcctgggaagacctgggtgcttcaagtgcctggcaacacgcaaagtggccgcgtgtgggcgcgcacgggctgttcgttcgacggccccggaaagaaatcctgccagacgggtgactgcggcggcgtgctggcatgcactaccagcggccaaccgccgatgacgatggcagagttcaccctgagtgactccaacaacatggacgactacttcgacatcaccgtcgtcgacggctttaacttgcccatggactttctgccggtgccgtcgtccaaggggtcgtcggggtgcagcaggggtccacgctgcgccgccgacatcacgtcgcagtgccccgatgagctcaaggtgccagggggttgccgcagcgcgtgcaacggatcttcctgcgacgccagcacggtaaacagcaacacggttttctacgctcggatgtgccccgacgcctatacctacgccactgataatggtcccgttacatattcgtgtccgtcaggaacagattaccagatcattttctgtccccccgtcgatcttgtgtcattgtctccacctccaacttcaccattgtctccgcctccaacttcacctactgcaacaaatggaacaagcagcatc

SEQ ID NO: 94961 - protein, 262 aa, Zea mays
  misc_feature: Ceres CLONE 1584987
  misc_feature (37)..(231): Pfam Name: Thaumatin Pfam Description: Thaumatin family
MGARSSSTWTQHLLLLFFLVLGVATNSSHSSTINITNRCSYTVWPAATPVGGGMQLEPGKTWVLQVPGNTQSGRVWARTGCSFDGPGKKSCQTGDCGGVLACTTSGQPPMTMAEFTLSDSNNMDDYFDITVVDGFNLPMDFLPVPSSKGSSGCSRGPRCAADITSQCPDELKVPGGCRSACNGSSCDASTVNSNTVFYARMCPDAYTYATDNGPVTYSCPSGTDYQIIFCPPVDLVSLSPPPTSPLSPPPTSPTATNGTSSI

SEQ ID NO: 94962 - DNA, 805 bp, Zea mays
  misc_feature: Ceres CLONE 1584993
  misc_feature: Encodes the peptide sequence at SEQ ID NO. 94963
  misc_feature (68)..(68): n is a, c, t, g, unknown, or other
  misc_feature (387)..(387): n is a, c, t, g, unknown, or other
  misc_feature (400)..(400): n is a, c, t, g, unknown, or other
  misc_feature (480)..(480): n is a, c, t, g, unknown, or other
tccccgcggtggcggccgctctagaactagtggatcccccgggctgcaggaattcgtctcacccctangaaaaaaaaaaatgccctccactgcagcctgcaccacacggcccctggcactgccaacctcgtcgcccacccaagtctcttcatttgcagcgacaaaaataggaacggagcaaaggtccggcgagccagagcaatagttaacaaccatctccacaaacaggctaccacgtagctacgtatatgccggaactgaactgagctgagaaagctcaggcgtgaactgaactagatggtgtttcctgccatcctccccaaggtggccgtgcgattgctcttcacgttctaccgcgccgccaggaagctcaggcggcacgccttncagctctacaccngtaggaaccgccgccatgcgccttcgttcttcgtctcccagcagcagggccgtggccgcaactttcaagaacgacgccgncatccctgaaggcgccgggcggaacgtccttctgtaaagtgaacggaaccctggttgggttcctccgggtttttcccctaatttagggtcctgggcttacaagggggggagccttttgtgggcccttgtttgttggttttggcctttcccctttgtttggggaccccgggggaaaacaaaaggggggggcctggggcccctcccgggggaaaggggtttccccaccctttcggggggttctggcccccggggaataggacccctttggggggcccccccccctctgtcccccaaaaatttttttggggggggggcctctcccccc

SEQ ID NO: 94963 - protein, 63 aa, Zea mays
  misc_feature: Ceres CLONE 1584993
  misc_feature (30)..(30): Xaa is any aa, unknown, or other
  misc_feature (35)..(35): Xaa is any aa, unknown, or other
MVFPAILPKVAVRLLFTFYRAARKLRRHAXQLYTXRNRRHAPSFFVSQQQGRGRNFQERRRHP

SEQ ID NO: 94964 - DNA, 801 bp, Zea mays
  misc_feature: Ceres CLONE 1584996
  misc_feature: Encodes the peptide sequence at SEQ ID NO. 94965
ctccccgcggtggcggccgctctagaactagtggatcccccgggctgcaggaattcgtctcacccctagaaaaagcctgcccgccgccgccgtcctgcccacccgcccacctgcacgcacccagatgccacctgccgctgccggccgccactgctgccggcggccacgtccgcggcgctgaccaccgcccgcctcgccatgccccgcatcctcctcgcccagttctcccgccgccggctccacgctcacctctcgcgtcccctcgccattctctcgaacgccttctcggcgtccgccgcctcgtctcggccgcgcccgccgccgctcccgccactctctccgctgctcccagcgcgccccgaggacgcgcgcctcgtagccgcgtcctcgtccgccatcgccgccgccttccacgactggttccacgagtcccgcaactccgcttctgcgccgacaccgcccaaggcgctcgacgcgatctacgaggcgctcgcgtccgatgagacggccccgctagaggcgctcccgctctcggagacgctcgtcctcgccgtgctccgccaccatccgagggggttccacaacgacgccgccctgctgctgctccgcctcaagttcttcgactggtcgggccgtcaccggcgctaccaccacacgcgggccgtctaccacaccgtcttccgcctccttagatgcgcgcgccgcaatgccgtccttctcgattggctccaccgcttcttcgacacctccgcgagaggcggccacctgcgtttccacgacacgctcatcatcggctatgcc

SEQ ID NO: 94965 - protein, 201 aa, Zea mays
  misc_feature: Ceres CLONE 1584996
MPRILLAQFSRRRLHAHLSRPLAILSNAFSASAASSRPRPPPLPPLSPLLPARPEDARLVAASSSAIAAAFHDWFHESRNSASAPTPPKALDAIYEALASDETAPLEALPLSETLVLAVLRHHPRGFHNDAALLLLRLKFFDWSGRHRRYHHTRAVYHTVFRLLRCARRNAVLLDWLHRFFDTSARGGHLRFHDTLIIGYA

SEQ ID NO: 94966 - DNA, 1181 bp, Zea mays
  misc_feature: Ceres CLONE 1584997
  misc_feature: Encodes the peptide sequence at SEQ ID NO. 94967
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (335)..(335): n is a, c, t, g, unknown, or other
ggggggggggcttttccccaccacacacaaaaaaaaaaaaacaacaacacggcaaatannnnnnnggnnnnnnnnccaaactggagctcaccgcggtggcggccgctctagaatagtggatcccccgggctgcaggaattcgtctcacccctagaaaaatctgccccatccggccgtccgtcatccaacttcgccccactcttctcggacctccacctgcggcggcggtagaggtcacgtagccctcgtcgctcgtcggagcgtcttggatccttccttgaccctactcatctcagattccggtcagatggaaggcggcgagggatccggattcnatggggcacacatgaagaagcggcggagcagcgcggtgaggcggccgaggccggagggcggccctgccgcggtgcagcgggacaacggctcccctccgcccctgtcggtgacatccaggaacggcccgaaggagtctgctgttcccctccccacaaaaacgcccaccgggcccccaccggggggcaaccgctaaggcggtaaatttccccccctgaaacgcctacggtttcccccggaaccgcggcgaaccaaaggagggaagccattccccggggtttgcgttttccccaagaggggcccccacacccccggtggggcctcctcccaggagaaagaaacccgaaacccggttatagcccagagccccaatgttccccccccctgtgtaagagggggggaaaaatttcctgcttggaaaaagaaaaagacctctcggggtggcgggaaaaaggggggtgcgaaaaaaaacgcctctcacaggagcaatttttctccgtaaaccaactgcggggggcgccctcacctccggtataacaaccccccaaaaacgccccgccgtgtaaataaacacactctcacgcccctcggggtagtgagaagccccccccccccgccgggaggcccttggttaaaaataattttccgcccggggccacaccctcgtctacaaataaaggcaatttgcggccactattctttgtaaagggaaaggggccccccaaaaagagattctcttgagtaaggggggcataaacccttcttttccccgaagaacacaaaaaaaccccccacaacagggaaaaggggccctatttctacgaaaaaccaacgtgggcacttgaagc

SEQ ID NO: 94967 - protein, 73 aa, Zea mays
  misc_feature: Ceres CLONE 1584997
  misc_feature (10)..(10): Xaa is any aa, unknown, or other
MEGGEGSGFXGAHMKKRRSSAVRRPRPEGGPAAVQRDNGSPPPLSVTSRNGPKESAVPLPTKTPTGPPPGGNR

SEQ ID NO: 94968 - DNA, 815 bp, Zea mays
  misc_feature: Ceres CLONE 1584998
  misc_feature: Encodes the peptide sequence at SEQ ID NO. 94969
  misc_feature (765)..(765): n is a, c, t, g, unknown, or other
  misc_feature (783)..(783): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
ggagctccccgcggtggcggccgctctagaactagtggatcccccgggctgcaggaattcgtctcacccctagaaaaaaaaaaaaaaattcgctccagctcgcatcccacagccaagccagttagcccgggagatctccaagaaaccatcttggaatccgagaacgcccagcattcttggtcggccaaggattcgaattccgacgaacggcttctacggccgaaaaaagtccgataatttccgcggggagctcaggaggtgtctcggtctcgggaaccggaggaggaggccgtgggggattgacgagggggcaagatggtgaggctgccgtacacaacggcgctgaccacgctgttcagctacggcctgctcttcgccttcggccagctcagggatttcttccgcaagttcgtcgactggttcaaggccaagaacgtcaaggggtacgcgccgatctgcctgggcctggaggatttctatgtgcgacgcctgtacttgcggatccaggattgctttggtaggccgatcgcaagtgcgccagattcatggtttgatgttgttgagcggacctcaaaggacaataacaagacactacagcgtacctcgaataccaccagatgcctcaacttgggctcctacaactaccttggctttgctgcagcagatgagtattgcacaccacgtggttattgagtctctcaagaatactcagcaagtacctgcagtgttcgtgtcgatggcggtacgacaaagcttcaaatgagnctggaagagttggctgcncgtttttgttggaaagctagannnnnnnnnnt

SEQ ID NO: 94969 - protein, 125 aa, Zea mays
  misc_feature: Ceres CLONE 1584998
  misc_feature: SWISSPROT Homolog: EC 2.3.1.50 Serine C-palmitoyltransferase
MVRLPYTTALTTLFSYGLLFAFGQLRDFFRKFVDWFKAKNVKGYAPICLGLEDFYVRRLYLRIQDCFGRPIASAPDSWFDVVERTSKDNNKTLQRTSNTTRCLNLGSYNYLGFAAADEYCTPRGY

SEQ ID NO: 94970 - DNA, 890 bp, Zea mays
  misc_feature: Ceres CLONE 1585002
  misc_feature: Encodes the peptide sequence at SEQ ID NO. 94971
aagctggagctccccgcggtggcggccgctctagaactagtggatcccccgggctgcaggaattcgtctcacccctagaaaaaatcgttcctctctctctgccccgcctacgcctcgccccagacgcatcaaaccgctctcctctccctccctgcccccctcgcaaccctgaagaagcccccacacgcaaggccgcaaacgcgccgcgcaccgcaaggtcccagggagcgacacgaggcggcctcattgcagcatggctgctatggccgccgctggcggcgtcgggctccacctcattggcgctgccacggccacgctcatcgtggcggtccttgttgcggccgtgctggggcgccgccgccgggcccgggcccgggcccaggcgcctccggtggaagggaaacccgcgccggaggcaggctgcgcggtcggtgacggcgcgggtcccgacgtcgggacggacgtcatcatcgtcggcgccggagtggctggatctgcgctggcgtacacgctcggaaaggatggccgccgggtgcatgtcatcgagagggatctgacagaacctgacagaattgtgggcgagctgttgcaacctggaagttacttgaaattaattgagttaagcctccaagaatgtgtggaagaaattgatgcctcacgtgtgcttggttacgcattactcaaagatggaagaaacacaaagcttgcttatcccttaaagaaagttccattcttgatgttgctggtaggagcttttcccatggggaggtttaataccgaggatgcgtcagagaagctgcggtctattgcccaaggtttcaattaggaacagggaaactggttccatcactttctcgaagaaaaatggctacctggttaaagggtgtttt

SEQ ID NO: 94971 - protein, 190 aa, Zea mays
  misc_feature: Ceres CLONE 1585002
  misc_feature: SWISSPROT Homolog: EC 1.14.99.7 Squalene monooxygenase
MAAMAAAGGVGLHLIGAATATLIVAVLVAAVLGRRRRARARAQAPPVEGKPAPEAGCAVGDGAGPDVGTDVIIVGAGVAGSALAYTLGKDGRRVHVIERDLTEPDRIVGELLQPGSYLKLIELSLQECVEEIDASRVLGYALLKDGRNTKLAYPLKKVPFLMLLVGAFPMGRFNTEDASEKLRSIAQGFN

SEQ ID NO: 94972 - DNA, 805 bp, Zea mays
  misc_feature: Ceres CLONE 1585003
  misc_feature: Encodes the peptide sequence at SEQ ID NO. 94973
  misc_feature (774)..(774): n is a, c, t, g, unknown, or other
tcaccgcggtggcggccgctctagaactagtggatcccccgggctgcaggaattcgtctcacccctagaaaaaagatccctcccgcagtctcgcgcgctctcccccacccacccaccccctatccatccatccatcccacctcctgctccacatcctcccctccgcccaccaacgcagcagcagccagcagccccgccacttcccccctcgccgcttgcgatggcggtcacgcgcgtcaccgtggccgccgccctctcggaggacccgctctcctcccgccgccaccgggttgccctcccctccgcctgccgccttctccccgcctcggccacctgctgcaacagccgcgcgccgatgtctctgcaggccgccgccgccgcacctgccgccggcgcggtcgaagaggagactcctgcctcctcccctccgtcagatgctagcaagggggtggagaacctggtgatcatcggctctggaccagccggttacaccgctgccatctacgccgcccgggcgaaccggaagcctgtcgcgtttgaagggcgccagatggggggtgtccccggcgggcagctgatgaccaccaccgaggtggagaatttccctggcttcccggacggtataaccgggcctgatctcgtggacagaatgcgcaagcaagcgtaacgctgggggcgcacagctctaccgagaggatggtgagcttgggaatgtcaaggagcatcccgattgctaattcgaaacaacgaccggggaaggggaaaggccataantctagattatgggcatccgaagccaccgggg

SEQ ID NO: 94973 - protein, 148 aa, Zea mays
  misc_feature: Ceres CLONE 1585003
  misc_feature: SWISSPROT Homolog: EC 1.8.1.9 Thioredoxin-disulfide reductase
MAVTRVTVAAALSEDPLSSRRHRVALPSACRLLPASATCCNSRAPMSLQAAAAAPAAGAVEEETPASSPPSDASKGVENLVIIGSGPAGYTAAIYAARANRKPVAFEGRQMGGVPGGQLMTTTEVENFPGFPDGITGPDLVDRMRKQA

SEQ ID NO: 94974 - DNA, 879 bp, Zea mays
  misc_feature: Ceres CLONE 1585005
  misc_feature: Translation starting site: 155
  misc_feature: SWISSPROT Homolog: EC 1.2.1.27 Methylmalonate-semialdehyde dehydrogenase (acylating)
ggcggccgctctagaactagtggatcccccgggctgcaggaattcgtctcacccctagaaaacactcccacccggtggctcgtcctcggacgccaagccactccgcgccccaatccggaagcgccgccgccgccgatcgaccggccgtcgacccatgctccgctcggcgctcttccgctcagcccccgggctccgccggtctccggcgacggcccacttatccaccgccgccgccgccgccgcagcgtggctctccaacggccctgcctccgccccgtctagggtgcgcctcctcatcggcggggagttcgtcgagtcgcgcgccgacgagcacgtcgacgtcaccaaccccgcgacgcaggaggtggtgtcccggatcccgctcaccacggccgatgagttcaaagctgccgtcgatgccgccaggacggccttccccggctggcggaacacgcccgtcacgacgcggcagcgcgtcatgttcaagttccaggagctcatccgggctaacatggacaaagcttgcagagaacatcactacggagcagggggaagacgctaaaagatgcttgggggcgacggttccgcggcccagaggtgggggagcttgcttgtgggaatgggaacacctgcaaaggggcgaatatgttgccaaatgtttctaaaggggattggacccccttcgccccttccgggaagccccttggtggttttgcgcctggggaaattgccccattttaatttttccctgcctatgatttcccccctatgggatgttttccccttttgccattttaccttggcgggccatatcctttttggttctttaaggcccttccgggagaaagggccccccgggggggcttccctcttgaaatg

SEQ ID NO: 94975 - DNA, 1020 bp, Zea mays
  misc_feature: Ceres CLONE 1585006
  misc_feature: SWISSPROT Homolog: EC 2.7.11.24 Mitogen-activated protein kinase
  misc_feature (391)..(391): n is a, c, t, g, unknown, or other
  misc_feature (392)..(392): n is a, c, t, g, unknown, or other
ctggagctccccgcggtggcggccgctctagaactagtggatcccccgggctgcaggaattcgtctcacccctagaaaagtctcccaccacctatcttccctccccatgtgggcggcctcgagctctgcttaggtctcacagctgtgctctcgttggttgggtgatccgccccttgtcggctcctttcaactcgagagctccgggacagcgagatctgcgctgtcgccgccttacctttcttgcgagctcgcgtgcaggcaggcactgagcagtgagcccccccccgtcttcctcagcctcgtttcccctctcgttgctggatctggctcgcaagatccaatctttcgtgccccctttttccaagatcctcgcttgggtgggtcttcctgnnacatgctgggaggatgcagcacgaccagaaagagaaggcaccttcagagatggattttttcccagattatggcgaaggcagcaggtacaaaattaaagaaggcataggccaaagcagcctacggcggggttttgctctgccgggaacacctcttactggggaaaaggttccttttaaagaaaaaaaaacgaaatttttccaaacctttgtttttaatgcaacccggaaacctccggggaaaaaaaacgtgttttaaggttcccgggggttcccggaatattttggggaaaaaaaaaaaattttttttgtcccccctcttctcagggagggggttttcggggtatttttatgtttgcttttttaaacccccggggggcttttttccccccccccttttttaaagggggtgaagggaatttttttcccccaagaataaacccggtttttttttgtaaaaaagagcgcgggcgggggggagaagaacaccccccgcgccaggtgttgttttctggggtggtctcccaaaaaaatatttttgggggggaggggttggtgggcgacacaatatatatttgttgtttttttcaaaaaaagattttttatttataatcccccccacccctctttt

SEQ ID NO: 94976 - DNA, 863 bp, Zea mays
  misc_feature: Ceres CLONE 1585010
  misc_feature: Encodes the peptide sequence at SEQ ID NO. 94977
aagctggagctccccgcggtggcggccgctctagaactagtggatcccccgggctgcaggaattcgtctcacccctagaaaaaaacccctccgccgcccccgaaaaaacatataaaacagaaccctcgcatcctgtaaatggcgacacgcctcgcctccatcttctctgccgtgcgcagccccacctcagccccgccccacactctccgccgcgctctcccaagcttcagctaccggcgagcgcatccatctcagccccgcatgtcctcctcttcagccgcctcctccgcgccgccggccgccgagaagcctacagtggcgccgttcgggtcctggaggtcgcccatcactgcggacgtcgtatctggcgcggataggcgcctcggcggtatcgctctcgctggagatggacgccttctctggatcgagggccgccccgaggagaaagggcgtatggttattgtaaaggaggaggataatcctgtggatgtcatacctcaggaatttgcagcacgcacactggctcaagaatatggaggtggtgcatttgcagtcgacaagagtgttgttgtgttctcaaattacaaggatcaacgtctatacaagcaaacaataggaactggtggtccacctgtgcctcttacacccgattatggtgcgccaaatgtcagttatgctgatggtgtatttgatcctcacttcgaccgttatgttactgtgatggaagatcgtcgaaaggatagcttgaatcccaacacaaacaattgctgctataaacttgagtggcagtgatgttcatgaaacaaaggtgctgatcagcggcaaacgatttctatgcattttcctcgcattgatcaaaataa

SEQ ID NO: 94977 - protein, 176 aa, Zea mays
  misc_feature: Ceres CLONE 1585010
MSSSSAASSAPPAAEKPTVAPFGSWRSPITADVVSGADRRLGGIALAGDGRLLWIEGRPEEKGRMVIVKEEDNPVDVIPQEFAARTLAQEYGGGAFAVDKSVVVFSNYKDQRLYKQTIGTGGPPVPLTPDYGAPNVSYADGVFDPHFDRYVTVMEDRRKDSLNPNTNNCCYKLEWQ

SEQ ID NO: 94978 - DNA, 871 bp, Zea mays
  misc_feature: Ceres CLONE 1585012
  misc_feature: Translation starting site: 449
  misc_feature: SWISSPROT Homolog: EC 1.1.1.100 3-oxoacyl-[acyl-carrier-protein] reductase
  misc_feature (786)..(786): n is a, c, t, g, unknown, or other
  misc_feature (803)..(803): n is a, c, t, g, unknown, or other
  misc_feature (830)..(830): n is a, c, t, g, unknown, or other
ctggagctccccgcggtggcggccgctctagaactagtggatcccccgggctgcaggaattcgtctcacccctagaaaaaacttcgttatctatacaaaccaaactcgcgctccagaccacagctcacctgcgacctgtgcgcattcacagccgccggcgccacacgtgcccgcgcgccgggcgccacctctctcccatacacggtccaccagccttcctctcccgggccgggcggcgcccctcaaatggctgccaccttcaccgtcgccgcccgcctcccgctgcggggccccgcgcgcgctccgtcccggccggttgtcgctgctgtaacccggctccgaagccggcaggagcggcgcggcctagcggcgacaggcgggaggggacctgcccgggttcgggccgagactttctccggtggtggaggcgtgggggcggagggaccccatggcgccgccttacaatgtcctcatcaccggctctacgaaaggtataggatatgcattggcaaggaaatttctggaggctggtgataatgttataatctgctcgagatcagctcaaaaggtagaatctgtggtcggtgacttgaaggaggagtacggagagcaacatgtggaactgtctgtgatgttagaaatggaaaggatgtaaagggcacttgtggagtttgcacgtgacaaacttaagcatatttgatatatgaatcaacaatgctggatcaaatgcatatacatacaaaccactagtggagacctctgatgaggctctcatggaaatcatcnacactaacacccttggnatgatgatatgttgtcgtgaggcaatnaatatgatgaggaaccaccctcgaggtggtcccagatcacc

SEQ ID NO: 94979 - DNA, 1333 bp, Zea mays
  misc_feature: Ceres CLONE 1585013
  misc_feature (45)..(45): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (1002)..(1002): n is a, c, t, g, unknown, or other
  misc_feature (1153)..(1153): n is a, c, t, g, unknown, or other
cagtagtgcttacccccaataatattagtgtatgccccccttaanattacttaataaannnnncnnnnnntcaaagctggactccccgcggtggcggccgctctagaactagtggatcccccgggctgcaggaattcgtctcacccctagaaaaacttttccgctccagacacagcagcccctcttgtaccagtaaaccgtgctgctatcccccgctagccgccgcgctgctgcggctcgcctccctcctccccagtccccacgccccgccgccgccgccgccacctcctctcgctccctccttttaccccgagcttaagctcgcgcgtacctgcctacctatccgtaggagaggaagaggggacaaggcccggtcggtcggtcggtcggtcggggggcacttcggatctcgccgctgcctccccgttcgttcgttcgatcggtgggaactcacgtcatggacgccgacaacccccccccagcccccgcgccggcaccgggttcctggctccggctcctggccaccgaggcctggccccggaatcagacccatggatcctgctgaaaaaaagtttgacggcttcggaattccccaagcccaaaatcccggttggaaagcctaacgcaaacgcctggtttgtctggtctccccggccaaaaaaaagggggtcccccccggggcggaactcacagccccgctgagaagccgctgggggccaatatcctcctccacccggagagccccgacctccacttttaacgcccacccggcgtgggatagcctacaggagcacatcttttatcgccggtgtgaatcctcccccccaagcacccggtggggcttctttaaaacgtgcgtatcacgcgcgcaggaccgggtgatatttactcttcctatcaaccgcagaaagaggagcgagtcaagactcgtacagagtgtaatctctcgctgcagtgtagatcccgagaatattgtgggggaagaaggtacatatattttgngtgcccccgcataagagcatagtatccgtacgaaaaatttctgattcaaagctgtgtgcagaggtgttcgtgacaagaatatttgtgccacacgcactaacgcgtgaggactagatacaccactgaggagaattaatttctatcactgggnagagttatcgagcgggacataccgcactgttctctgcgtcgacgcgggggtgtcactacgtgtcaaccccagcgtgcctactctttctccgtcacagagggtgtcccacaaagcctacttcgtagtgcagggcatataaatattattcttgtgggcatgccctggctgaatttagagtcc

SEQ ID NO: 94980 - DNA, 993 bp, Zea mays
  misc_feature: Ceres CLONE 1585015
tccccgcggtggcggccgctctagaactagtggatcccccgggctgcaggaattcgtctcacccctagaaaaaagttcctgacctcctatcctgctcgtcgagttgtcgtcagtggtcgctcgaattcgccctccggcgcgatcgcgatgaccacgatcctccgccatctcctccgcgcggctctacctcccgcccccgcttccctctccagtcacctccccttctccaccagatctcgccgcacctctcaccgcttccgccgcagtcccaaaccggcgccgccctcccccgacgccgtgtccgcagctatcgcatccctcccgtcccgcctcaccccgcccgtgctcgcctccttcctagcctccacctccgacgcccgcctcctcctccccccgctcacccactccctccggatccccgcattccgtcccggaccccgcccccttcctcgtcggcattaaagcgccttggccaccttccgacctcctacaaggacttcgacccgcacctggcgcggctatccttttcttctcccttcccctcggtctccttctccctgggcccccctccttcggaaagggggcgtttagctttctactggcccagtttcgggcgagggctccgggcaaggggccctttcccccggttctaacacccccttggaggggagggcactttcggtccgaaacacctggtgaagggcgcgccttttttcttctggagcgccgtagctagtgggggctcctcttaaaccggggtattgttgttttcctcgcgggaggggggggggaccaccccttgtgtcgcctattacgcttgtgcctttgggacaaccagggttccgggcccgtattactggggcaagaaactctacagggggtgggagacccgcgccggaaaggacgcgagcggctaaaagggtggccgaaataggggctaccctcctgtgtagcggtggaattcaacggccggatggcgtccgtcggattccg

SEQ ID NO: 94981 - DNA, 922 bp, Zea mays
  misc_feature: Ceres CLONE 1585016
  misc_feature: Encodes the peptide sequence at SEQ ID NO. 94982
  misc_feature (421)..(421): n is a, c, t, g, unknown, or other
  misc_feature (473)..(473): n is a, c, t, g, unknown, or other
ctggagctcaccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcagggaggtcagtgatgcgtctgntcagagtgatatcaagttgtggcccttcaaggtcatttctgggcctggtgangagccaatgattgttgtcccagcacagggtgagggagaacagtttgcagctgaagagatctcctctatgggtcctatcaagatgcgtgagaatgctgaagctttactttggtagcccgatccagattggctgggggccaaggccctggcctacttaaaggactccaaagggcgggccccaaagggacccggggggaattcccgggcttaaagggggcgggggataaaaaagaggcccaaaggtgtgggcgttttccccttggggctttgaaaagaaggggcacccggtgcggggggaaaaaaaggccctcctttttttattttggggggggggcccccttggatgtcccccccccccccccctctggagggaaagattttttggtggggggggccccccgtgtggagacccccctttgggggggaggaggcgtttctcaccgggggggg

SEQ ID NO: 94982 - protein, 140 aa, Zea mays
  misc_feature: Ceres CLONE 1585016
  misc_feature (86)..(86): Xaa is any aa, unknown, or other
  misc_feature (103)..(103): Xaa is any aa, unknown, or other
MAGKGDGPAIGIDLGTTYSCVGVWQHDRVEIIANDQGNRTTPSYVAFTDSERLIGDAAKNQVAMNPINTVFDAKRLIGREVSDASXQSDIKLWPFKVISGPGXEPMIVVPAQGEGEQFAAEEISSMGPIKMRENAEALLW

SEQ ID NO: 94983 - DNA, 819 bp, Zea mays
  misc_feature: Ceres CLONE 1585018
  misc_feature: Encodes the peptide sequence at SEQ ID NO. 94984
tggagctccccgcggtggcggccgctctagaactagtggatcccccgggctgcaggaattcgtctcacccctagaaaaactagaaaaaacgacgcccgcgacaaatccctgcgcgacggcatcttcgcctcccatcccctcccagcttcccctcccactccggccctcacacaaattgcccctctccttgtcctcctctttacacgctgccgaccacggctgccgccaaccacccgccccacccgtccaccgctgccgagtgctagccatttggagctgccgcgccatggcgtccgtggccgccaccaccacgctggcaccggcactcgcgccccggcgccgggcgcggccagggaccgggctgctgccgccgcgccgggcctcggccgtccgctgctcgctcgaccgtaacgtctccgacatgggcgtcaacgctcccaaagggttattcccacccgagccagagcactacaggggcccgaagctcaaggtggccatcataggggcaggccttgcgggcatgtccaccgctgttgagctcttggaccagggccatgaggttgatttgtacgagtcccgtccgtttatcggtggtaaggttggctcctttgttgacaggcaaggaaaccatatcgagatggggctgcatgtgttcttcgggtgctacagcaatctcttccgcctcatgaagaaagttggcgctgataataatctgctggtgaaagaacatacccatacttttgtaaataaagggggcacgaatgggtgaacttgattttcggttccccggtggggagctccctttacatggcatttcaa

SEQ ID NO: 94984 - protein, 160 aa, Zea mays
  misc_feature: Ceres CLONE 1585018
  misc_feature: SWISSPROT Homolog: EC 1.14.99.30 Carotene 7,8-desaturase
MASVAATTTLAPALAPRRRARPGTGLLPPRRASAVRCSLDRNVSDMGVNAPKGLFPPEPEHYRGPKLKVAIIGAGLAGMSTAVELLDQGHEVDLYESRPFIGGKVGSFVDRQGNHIEMGLHVFFGCYSNLFRLMKKVGADNNLLVKEHTHTFVNKGGTNG

SEQ ID NO: 94985 - DNA, 980 bp, Zea mays
  misc_feature: Ceres CLONE 1585019
  misc_feature: Encodes the peptide sequence at SEQ ID NO. 94986
  misc_feature (386)..(386): n is a, c, t, g, unknown, or other
  misc_feature (387)..(387): n is a, c, t, g, unknown, or other
  misc_feature (392)..(392): n is a, c, t, g, unknown, or other
  misc_feature (393)..(393): n is a, c, t, g, unknown, or other
  misc_feature (434)..(434): n is a, c, t, g, unknown, or other
  misc_feature (435)..(435): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (503)..(503): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (569)..(569): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (628)..(628): n is a, c, t, g, unknown, or other
  misc_feature (629)..(629): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (685)..(685): n is a, c, t, g, unknown, or other
  misc_feature (688)..(688): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (888)..(888): n is a, c, t, g, unknown, or other
  misc_feature (889)..(889): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (924)..(924): n is a, c, t, g, unknown, or other
  misc_feature (925)..(925): n is a, c, t, g, unknown, or other
aaagctggagctccccgcggtggcggccgctctagaactagtggatcccccgggctgcaggaattcgtctcacccctagaaaaaagtcacagacacacaccgctgcttcaagaaaccaccgagagcccaaccgcacaggcaggagagagagcagggagccagggacagtagcgtggggccggggagcaacgatggaggggaaggaggaggacgtgcgcctgggcgccaacaagttctcggagcgtcagcccatcggcacggcggcgcagggcgccggcgccggggacgacgactaggactactaggagcccccgccggcgccgctgttcgagcccgggggagctcagtcctggtcttctacccgcgcggcatcgcggagtcctggnntcttnnctcaccctacccaagggccccaggggggagcccagacccannggtggggcgggcggccgcccgctgggnnnnnnnnnncnnnnncccctttcccttcggaggagtacganacnnnnnnnnnnnnnnnnnnnnnnnnnnnnnnnnnnnnnnnnnnnnnnccccccnnnnnaacctcnggggtggtggttcggtgcttgggggggggggggnnnnnnnnnnnnnnnnnnnnnnnngnnggggnnnnnnncctttnnnnnnnnnnnnnnnnnnttgtgggnnnnnntgnnnnngnctnctgggggtttttttgtggacgtannnnnnnnnnctnnnnnnnnnnnnnnnnnnnnnnnnnnnnnnnnnnnnnnnnnnnnnnnnnnnnnnnnnnnnnnnnnnnnnnnnnnnnnnnnngggnnnnctnnnnnnnnnnnnnnnnnnnnnnnnnnnnnnnnnnnnnnnnnnnnnnnnnntcccccccccacccaccaaaaaaannggggnnnnccccccnnncccccccccccccccccnnggaggggaaaaaaaaaaaagggaggcgccgcgctataaaaaaaaggaagggaggg

SEQ ID NO: 94986 - protein, 34 aa, Zea mays
  misc_feature: Ceres CLONE 1585019
MEGKEEDVRLGANKFSERQPIGTAAQGAGAGDDD

SEQ ID NO: 94987 - DNA, 1056 bp, Zea mays
  misc_feature: Ceres CLONE 1585026
  misc_feature (4)..(4): n is a, c, t, g, unknown, or other
  misc_feature (5)..(5): n is a, c, t, g, unknown, or other
  misc_feature (12)..(12): n is a, c, t, g, unknown, or other
  misc_feature (18)..(18): n is a, c, t, g, unknown, or other
  misc_feature (35)..(35): n is a, c, t, g, unknown, or other
  misc_feature (42)..(42): n is a, c, t, g, unknown, or other
  misc_feature (46)..(46): n is a, c, t, g, unknown, or other
aagnnggttttnttaggngatgtatgcctcaaaanataaaanacgnccgaaaaaccaataatattttcaaactggaactccccgcggtggcggccgctctataactagtggatcccccgggctgcaggaattcgtctcacccctagaaaaattccctccccacacacaaactagtttgcatctaagaatatcaccatccgctgagttctgtatagtctggatccttctcaaccttccatcagctcgctatcataggatggacccccacaaattcccccgacggcgtacctcgatctggccacgctatgcctatcgtctaggcggctgtgcacatagaggacctgtttgtaaacgtcaatacaggagctcagatagacatagccgattcgatacgattgaacttcagcaccacttctgcaacccccgacgaatacaagatcttgatcgcttctgttccgggctgggttggtgagcaaagcggggggcaacagcagcgggatccccgtgctggtcgacgaagacgacccgctcgcgctcgaatcgtttcttaacatcactctggtgaacaaagcaaggctgctccctaaacttgaaagatggatgttctccagaaccctactttcgtggccttacctagcaagggcagctgctcgttgcctccctcaaaaaaaataaggcccgcaccgattcttcgtcgagcaaaatctgcttaacaaccggtgggcccctgggtggaaaacaaaatttcaggcttccctggttaacccgaaacctagcctggtcgactgccctggccgaaccggcaaacggaatctctgggggttctcggggcttttggccaaatgccaaaaagaatcttctaaaaaaaagcccaattaccacatcgcacgattttccgagtttccccacactcgggcatacaaccccactcccaaaaaataaaaacctctaaaaaacgggggggggtctgtccccgccccctgactaaactactatattggtcgcgtcataaacataccaggaaaatcaatatcccccccccaaaccatctgaaaa

SEQ ID NO: 94988 - DNA, 840 bp, Zea mays
  misc_feature: Ceres CLONE 1585029
  misc_feature: Encodes the peptide sequence at SEQ ID NO. 94989
ctccccgcggtggcggccgctctagaactagtggatcccccgggctgcaggaattcgtctcacccctagaaaaaatcccagatcaggattagccgaccacccgccgaaggccagagagaaatatctcatcttctctccaccggatcggttcaatcgagagcgagggacaaagggaggtggtgcgtcgaggggggccgagattttgccggtttggagccaaataggggtatgagctgcttcgcgcaccgactccgctccgacgtcgcccgccgccaggacggcctcctcgtcttcgtcttcttcctctcgattcccatacgtaccagtagttttaatttaagtagtagtaattgtagtaacaatctcttgtaaactgcgctcgcctttgcgtgttcgtggtccttttgcgctttctcgtccctctttctctcaatctctccttattcttctccttccacggcgaagccggcggctggtatggatcccaatggcctcaaaactggaggccttttgctcccgaccatcgagaggcggtgcacgtcgcctccatccgtcattgtcatcggcggtggcatctcgggcgttgcagctgcccgtgccctctccaattcttcatttaaggtgactgttttggaatcgagagatcgtactgccgggcgcattcatactgataactcggttggatgcccaattgatatgggagcctcatagctacacggcgtgtgcaatgcagatccactgggcaagtagataagctatcttgcgctgatgttataccggcacagcgatgaatactccgttcctgtatgaatcatgattcagaaaactatgctctggttt

SEQ ID NO: 94989 - protein, 77 aa, Zea mays
  misc_feature: Ceres CLONE 1585029
MDPNGLKTGGLLLPTIERRCTSPPSVIVIGGGISGVAAARALSNSSFKVTVLESRDRTAGRIHTDNSVGCPIDMGAS

SEQ ID NO: 94990 - DNA, 887 bp, Zea mays
  misc_feature: Ceres CLONE 1585030
  misc_feature: Encodes the peptide sequence at SEQ ID NO. 94991
  misc_feature (779)..(779): n is a, c, t, g, unknown, or other
  misc_feature (781)..(781): n is a, c, t, g, unknown, or other
  misc_feature (845)..(845): n is a, c, t, g, unknown, or other
  misc_feature (848)..(848): n is a, c, t, g, unknown, or other
  misc_feature (887)..(887): n is a, c, t, g, unknown, or other
aaagctggagctccccgcggtggcggccgctctagaactagtggatcccccgggctgcaggaattcgtctcacccctagaaaaaacctcgaaacttcttttcctatttaaccgttttatgtgcccccttcttcccgttacgattaccatcgtcaccgccaatgccgccgcctccaccaacgggcgaaccgaagcgccgccggctgctatccctcatggcagtctacccatgcgagagcatcgcgccggcgcctctgttcagctcgcttctcgcacttgcggccgacttggcgagccaagggctcggcgccgacgccggcgccttccctgttctccggcgcggcttacggcaggcagtgcggattgcaggcctcctcctcgcgtttctggaggaggtccaagacgtgtcagtgacgaagacggcacctctgccatcatcggcggtgctggggctcacggagctgcacatggccatgcagaagctgcggttactcctcacggactgcgcgcgacggggcgcgcggctgtgggtgctcgtgaacgccggattggccgcgtctgagctccgagtgattctcgggtccgtcgctgcggccatggacgcgctgccgaaggacgttgtggacgcctccgtggaggccggggagctcgcgcggctcatgtcggagcatgcgtggcgggtggcggtgcgtccggacgccagctacgagcgcgcggcgaggagcgtgcggtcgatactggagcagttcaagagcggcgtctcgccggactgcgaggacncnaggcgggtgctagagcacatcggggttagaagctggtccgagtgctacgaagagatggctttcntgnagacgagctgctcacgctgttggaacgacgcagctgcan

SEQ ID NO: 94991 - protein, 242 aa, Zea mays
  misc_feature: Ceres CLONE 1585030
  misc_feature (207)..(207): Xaa is any aa, unknown, or other
  misc_feature (229)..(229): Xaa is any aa, unknown, or other
  misc_feature (230)..(230): Xaa is any aa, unknown, or other
MPPPPPTGEPKRRRLLSLMAVYPCESIAPAPLFSSLLALAADLASQGLGADAGAFPVLRRGLRQAVRIAGLLLAFLEEVQDVSVTKTAPLPSSAVLGLTELHMAMQKLRLLLTDCARRGARLWVLVNAGLAASELRVILGSVAAAMDALPKDVVDASVEAGELARLMSEHAWRVAVRPDASYERAARSVRSILEQFKSGVSPDCEDXRRVLEHIGVRSWSECYEEMAFXXTSCSRCWNDAAA

SEQ ID NO: 94992 - DNA, 858 bp, Zea mays
  misc_feature: Ceres CLONE 1585032
  misc_feature (170)..(170): n is a, c, t, g, unknown, or other
  misc_feature (679)..(679): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (755)..(755): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
aaagctggagctccccgcggtggcggccgctctagaactagtggatcccccgggctgcaggaattcgtctcacccctagaaaaaaccgcagagagaggacagaggagcgagccatcatccccccccgagccgtgccaaccaagagccatccacccaccaccaccaccccnggccgcttccttgtccctgcccctccgttggtctcctttgcccatctcatcctctctctctctctccctctctctctctctggcggtcggcgtggctccgggggcgcgaagcgcgggctccggcggggcgactccgcggcggcaactgcaagtttgggattaaaagggtcacccacgggggcccacccaaaggcccccccgcccccggggaccctcagggaaggcccccccatttttttttttacttttgggggccccccgggggggggggggaaaaaccttgaaaaaccgccctcttaattttataaccccccccgggaaacctttttttttttggaaacccccccccgaaaaaatattattttggggggggtaaaaaaacccaccctctcctctccgggggattttataattattttggtgccccccccccccccccaataaattttttcccccccccccgcggggtttttttttccccccccccttttggggggggagaaaaaaanccccccccccccctctcttaaaaaaaaataaattttgttggggggggggggggttttatttttttnnnnnccctcnccggggcgcgcttttttttttccccccccccgttttttattttttttaagccccctctcccgcgnnngcccgcccgcccccacacctaattattttggtgtgg

SEQ ID NO: 94993 - DNA, 1050 bp, Zea mays
  misc_feature: Ceres CLONE 1585033
  misc_feature (960)..(960): n is a, c, t, g, unknown, or other
  misc_feature (1050)..(1050): n is a, c, t, g, unknown, or other
ccgctctagaactagtggatcccccgggctgcaggaattcgtctcacccctagaaaaacccccctcgaccacgcacgcaaatgaaagcgctcccctcgattgggcggcacgtaacccatcaccaccaccaccaacccggacccgtcaagcgctgcgtcgtcccgtgcaaagaccgcgcattccgtgcgtgccgtgtccacgcgcgcgcgcgcggtggcgttaagttgtctaacgcccgaggagcgccactagtcgtcgatcgatttgatcccacccaggaggcgttggcccccaggggagtgaggctcgcgagcctctggtgtgtggggctttaatcgctagcttcccaccgggggggggaagaaagaggccacttatccccccccccccccctggggttttggggtcgggcgcaagggtgatgaacattattctttatcttttctgtgggggggggggcgcctgggtttttgtatctttgtggggctgtcggcgacgatttgtctggaacgctacgccacattttgtggtcagcgtgcttgggtatgaaaatattatagccacctcgggggtttgtgtcagataaaagtaaaaacatgtgcctcatgtattaggcgtcgaacggggggggtcgctgtttcgacttttgtgggggtgggggggtggtcttgtaaatcgagggtcttacatgtcgtgggtgcgtgtgctgcccttgcgcgtgaatcatagcttgagatttagatgacgaatatctgagagggtgggtgccgttaggaagtatttcgtcccttgtggcagagagtggcggaggagggaatgatgagtgagctagcggtcgcgctatgattactgctcgctgaggcgcagcgactgcagccgtgagcgtggtggtgtggcttgtagtgttggcggacatactatgtgtgagttgagccccccgtggcgcggtgtgtcataatnaatgaggggtagctcgtggtgggtggggcgctcgtcgctttatacactttaccggcgggtgttatgaggagacattcgggtgttagatan

SEQ ID NO: 94994 - DNA, 864 bp, Zea mays
  misc_feature: Ceres CLONE 1585036
  misc_feature: Encodes the peptide sequence at SEQ ID NO. 94995
gagctccccgcggtggcggccgctctagaactagtggatcccccgggctgcaggaattcgtctcacccctagaaaaatacacgtacaaaccacataatgtggaccatgggggatgattttaactaccagtatgctgaatcctggttccgaaatatggacaaacttatccagtatgtgaacaaggatggccgagtgcatgcattatattctactccgtccatctacacagatgctaaacatgcatcaaacgaatcttggccagtaaaatacgatgattatttcccctacgccgattcaacaaatgcatactggactgggtattttacaagccgtccaactttcaagcgatacattcgagtgtacagtggatactatctggctgcgcgtcaaatagaatttttgatgggtaggagctccttgggattgttcacttccagcttggaagatgcaatgggtattgcccagcatcatgatgcaatctcaggtactgcaaaacagcacacgactgatgactactcaaaacggattgctattggagcatcaaaggtcgaaaaaggtgtaaacgctgctctgacttgtctaaccaactctaacaaaacatgtgtatcctctgtaccaaaatttagtcagtgtccacttctcaatataagctactgcccttcgactgaggaagcaatttcagcaacaaagcatttagttgtagttgtttacaatcctcttgggttggaaacgtagtgacttcataagggttcctgtcaatgatgaagacctggtggtcaaagctctgatggaaatactgttgtgtcacaaatagtttgtggtttgatatgtgacaaacactttagaaaagtatatgtgaaggga

SEQ ID NO: 94995 - protein, 209 aa, Zea mays
  misc_feature: Ceres CLONE 1585036
  misc_feature (67)..(141): Pfam Name: Alpha-mann_mid Pfam Description: Alpha mannosidase, middle domain
  misc_feature: SWISSPROT Homolog: EC 3.2.1.24 Alpha-mannosidase
MGDDFNYQYAESWFRNMDKLIQYVNKDGRVHALYSTPSIYTDAKHASNESWPVKYDDYFPYADSTNAYWTGYFTSRPTFKRYIRVYSGYYLAARQIEFLMGRSSLGLFTSSLEDAMGIAQHHDAISGTAKQHTTDDYSKRIAIGASKVEKGVNAALTCLTNSNKTCVSSVPKFSQCPLLNISYCPSTEEAISATKHLVVVVYNPLGLET

SEQ ID NO: 94996 - DNA, 809 bp, Zea mays
  misc_feature: Ceres CLONE 1585037
  misc_feature: Encodes the peptide sequence at SEQ ID NO. 94997
ccccgcggtggcggccgctctagaactagtggatcccccgggctgcaggaattcgtctcacccctagaaaaagagaagttcttgtaaaatactccgtactacttactgaaaagaataaaaacttcggtcttaaaagtttttactactagcaaagactcctcgactcgagcgaggtcgaggaaaagtttcgccatccggtttggttgtgttggattttccttctattaaaccacaccatctgtgctcctgactccgctgctctggtctttcccaccaccgcgaacacctggcaatggcggcccccgccccgtcggccacctcccagatgtcctcaagcggcctcctttcttactgagctcacccaccacccgccacgcccccgactcccacgaactcctccgcctacccacccctaccctacttctctcgcccgccggacgcatctcggggctctgctccccggttctcggggccggtggatgcgaccgcgtccccgcccccgaaatcagctgcccggcgtcctcatagcgttcccgggatctaggccctgagcaatggcagcggcggtggcgccgccgctctgcacctggctcgtcgccgcctgtctctccgcggcctgcggcgatggcgagaaggagaatgaacgcaggcaccgcggtggcggcgtagggggtttcttcggctcgcgccgccgcctcggctcagggcgccgcggcgtggggcgctctggaatggccatgtctgttgccttgcatcctgaaaagacagctgtggaaaataagaaacctgatatgaaacagaggagagtg

SEQ ID NO: 94997 - protein, 85 aa, Zea mays
  misc_feature: Ceres CLONE 1585037
MAAAVAPPLCTWLVAACLSAACGDGEKENERRHRGGGVGGFFGSRRRLGSGRRGVGRSGMAMSVALHPEKTAVENKKPDMKQRRV

SEQ ID NO: 94998 - DNA, 881 bp, Zea mays
  misc_feature: Ceres CLONE 1585038
  misc_feature: Encodes the peptide sequence at SEQ ID NO. 94999
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
ctccccgcggtggcggccgctctagaactagtggatcccccgggctgcaggaattcgtctcacccctagaaaaaacgccatacaattctcacacgcgcgcgcccaacacactagcctgcaggatcgtcgagcgcgaggcggctgccccgccggccggttcgttcgctctatagcttgagaccgatcctagctaggccaagacgatatcggcggcgatgatgatggacgcggcgaggatcgtagagtacttcaagggcaagtgcatcctcgtcaccggctcaacagggtttcttgggaagatccttgtggagaagatactgcgggtgcagcctgacgtgcgcaagatttacctgcttgtacgcgcggtcgacgagccatcagcgaagcagcgcgtccaacaagaggtgatagacaagggagctgtcggcctgctgagagagaaacacggcaaggggcttccagcagttcgtagagggccaaggtcgtcgctttgggcccggagacatcctatacaaccgcctgggggcttggagcaacccttctgggacccccttgcccagggaagtttaaattcattggttaaaatttcaagcaaccccccaatttttatcaaaaaaaccaatgttttccctgggacctaaacattcctggaaatgaaaaacccctgggatttttttccccaaaaaagggccgagggttctgggaattttctggccctgtnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 94999 - protein, 141 aa, Zea mays
  misc_feature: Ceres CLONE 1585038
MMMDAARIVEYFKGKCILVTGSTGFLGKILVEKILRVQPDVRKIYLLVRAVDEPSAKQRVQQEVIDKGAVGLLREKHGKGLPAVRRGPRSSLWARRHPIQPPGGLEQPFWDPLAQGSLNSLVKISSNPPIFIKKTNVFPGT

SEQ ID NO: 95000 - DNA, 975 bp, Zea mays
  misc_feature: Ceres CLONE 1585039
  misc_feature: Encodes the peptide sequence at SEQ ID NO. 95001
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
tttgtgtttttttnnnnngnctggcttacctcttgtggactgttgtcgcccgattggccttctctacgattttttttttattatggaactcacctcggtggcggccgctctagaactagtggatcccccgggctgcaggaattcgtctcacccctagaaaaagagaagttcttgtaaaatgctccgtactacttactgagggagaataaaaacttcggtcataaaagtttttactactagcaaagactcctacgactcgagcaaggtcgaggaaaaattacgccatccggtttggttgtgttgggattttccttctattaaaccacaccatgtgtgctcctgactccgctgctctggtctttcccaccaccgcgaacacctggcaatggcggcccccgccccgtcggccacctcccagatgtcctcaagcggcctcctttcttactgagctcacccaccacccgccacgcccccgactcccacgaactcctccgcctacccacccctaccctacttctctcgcccgccggacgcatctcggggctctgctccccggttctcggggccggtggatgcgaccgcgtccccgcccccgaaatcagctgcccggcgtcctcatagcgttcccggggatctaggccctgagcaatggcagcggcggtggggcccgcccgctctgcacctggctccgtcgcctacctggtctctccgccggcctgcgggcgatggcctaaaaaggagaaatgaaacgcagggccccgcggttgtgccggcgtaaggggggttttctttccggcttggagcccggccggccctcggatttcaggggtcccccgtcgacccctggaggcccgctcctgggaatttgggccctagtttctggttttgccccttgtacactccccggtaaaagggaataagccctgttgggggaaaaaattatagcgagaaaaccctgtggaatagttggaaaaa

SEQ ID NO: 95001 - protein, 32 aa, Zea mays
  misc_feature: Ceres CLONE 1585039
MAAAVGPARSAPGSVAYLVSPPACGRWPKKEK

SEQ ID NO: 95002 - DNA, 941 bp, Zea mays
  misc_feature: Ceres CLONE 1585040
  misc_feature: Encodes the peptide sequence at SEQ ID NO. 95003
  misc_feature (451)..(451): n is a, c, t, g, unknown, or other
  misc_feature (485)..(485): n is a, c, t, g, unknown, or other
ggagctccccgcggtggcggccgctctagaactagtggatcccccgggctgcaggaattcgtctcacccctagaaaaaaccagcgcacgcgcaccgtcacgcgagggcccctcccttctcgccccgtccggacccccgcccgtcgccgtctctcccgtcgcgcgcgccacgcgaacagcacctaggatgaggccgggcgggccgccgaactcgcgggcgctgcagccgccgggcacgccggggcggtcgcgccggcgcccggacctcaccctgccgctgccgcagcgggatctgacctccctcgccgtgcctctgcccctccctcccccgccgtcgtcggggtcgctgtcggcgccggcgtcgctcggcgcgccgaacccgccgacctcggccggcgccgcgccgccgaacccgccgccgctgtgcgagctggagcgcgtgcggcgcgtcnggagcggcgcgggcgggacggttgggatggtgcngcaccgccccaaggggcgcgcctacgcgctcaaggtgctctacggcaaccacgacgaacccgtgcggcgggcaaatccccccggaaatcgccattcctccgaaccggcaaacaccccggccgggggggcccttcccccgggattgtacaaaccaggccgggggagatctcaaatcctggtgggagaaaatgggacccgggggttcctctggaaaccccccttttcccaaaaaaagcttttccttgggcacacgtgggccccccaggggtttttggggatttcccctatcctccccggcgcccacttttttccgccgggaaaaaaacgccctcaaccgttttattatacctgggggggcccccgaaaaaagaaacccaatttctgggggggggccctctttgaaaaaaaaaagggccccccgatattcctcctggggggcacctctctcatgtagag

SEQ ID NO: 95003 - protein, 250 aa, Zea mays
  misc_feature: Ceres CLONE 1585040
  misc_feature: SWISSPROT Homolog: EC 2.7.12.2 Mitogen-activated protein kinase kinase
  misc_feature (89)..(89): Xaa is any aa, unknown, or other
  misc_feature (100)..(100): Xaa is any aa, unknown, or other
MRPGGPPNSRALQPPGTPGRSRRRPDLTLPLPQRDLTSLAVPLPLPPPPSSGSLSAPASLGAPNPPTSAGAAPPNPPPLCELERVRRVXSGAGGTVGMVXHRPKGRAYALKVLYGNHDEPVRRANPPGNRHSSEPANTPAGGALPPGLYKPGRGRSQILVGENGTRGFLWKPPFSQKKLFLGHTWAPQGFLGISPILPGAHFFPPGKKRPQPFYYTWGGPRKKKPNFWGGALFEKKKGPPIFLLGGTSLM

SEQ ID NO: 95004 - DNA, 838 bp, Zea mays
  misc_feature: Ceres CLONE 1585041
  misc_feature: Encodes the peptide sequence at SEQ ID NO. 95005
  misc_feature (289)..(289): n is a, c, t, g, unknown, or other
  misc_feature (297)..(297): n is a, c, t, g, unknown, or other
  misc_feature (298)..(298): n is a, c, t, g, unknown, or other
  misc_feature (324)..(324): n is a, c, t, g, unknown, or other
  misc_feature (621)..(621): n is a, c, t, g, unknown, or other
  misc_feature (774)..(774): n is a, c, t, g, unknown, or other
  misc_feature (798)..(798): n is a, c, t, g, unknown, or other
ggagctccccgcggtggcggccgctctagaactagtggatcccccgggctgcaggaattcgtctcacccctagaaaaaactcggtcttttgtccatcaatccctctctttcccatcgccagatcacctggccggccttctcctgcaatggatgctaccatggcgttcacctccggaagccctacccccacgcgcttctactcttcagctttgctatcgttgcgcacccccaagagcctctctgtctacggcccatggcgatggcgtgggcgtgggcgccccctcctcgngcttcggnnatcgtcccaggcccaggccgccccancggcggccggggccggcaaaccttccaccacaatgtttaattttggggccctggaatccaagggttttcaatttggggcccccctcctctcaactttttttttttgttggcaaagcaaaaaaatggccccccccttttttggggcccaagggggggggggggggaaaaattttttgtgttccccccccacccggggggaaaaaaaaagggggggggggccccccccaaaaaaaaaaaatattttggggggggaggccgccccaccttttttttccccgggggggggggggggcggcnaaaaaaaaaaaaatgtggtggtgtgggaaaaaaaacaccactctttttttttgtgtgggaaaaaaaaaaaaaaaaaggggtgttgataaaaaaaaaaaaaaaaaaaaaaccctctctctttcctaaaaaaaaaaataaaaaaaaaaaaaaatntttttctctcctcctcccctcttnccccctccacccccccccgcagggcggggggggggggggg

SEQ ID NO: 95005 - protein, 186 aa, Zea mays
  misc_feature: Ceres CLONE 1585041
  misc_feature (48)..(48): Xaa is any aa, unknown, or other
  misc_feature (51)..(51): Xaa is any aa, unknown, or other
  misc_feature (60)..(60): Xaa is any aa, unknown, or other
  misc_feature (159)..(159): Xaa is any aa, unknown, or other
MDATMAFTSGSPTPTRFYSSALLSLRTPKSLSVYGPWRWRGRGRPLLXLRXSSQAQAAPXAAGAGKPSTTMFNFGALESKGFQFGAPLLSTFFFCWQSKKMAPPFFGAQGGGGGKNFLCSPPTRGEKKRGGGPPPKKKNILGGEAAPPFFSPGGGGGGXKKKNVVVWEKKHHSFFLCGKKKKKKGC

SEQ ID NO: 95006 - DNA, 837 bp, Zea mays
  misc_feature: Ceres CLONE 1585042
  misc_feature: Encodes the peptide sequence at SEQ ID NO. 95007
  misc_feature (553)..(553): n is a, c, t, g, unknown, or other
  misc_feature (640)..(640): n is a, c, t, g, unknown, or other
  misc_feature (698)..(698): n is a, c, t, g, unknown, or other
ctccccgcggtggcggccgctctagaactagtggatcccccgggctgcaggaattcgtctcacccctagaaaaaaccaatccccgattccttacacgctaagccacgcaacgcaacgcaactagccatgacgatgaagtccagcagcggcggcggccatgtcatcggggtcccggtcacctccaaggcgcacgggatagaggaggtgtccagggatccgtccttcggcaagggcgccggcgatcacctcgccgtctcgttgacgcaccccagcccttacgcgtctttcggctacaagcacacaggcagcaaaggccaggtgacccactgggtgagcaagctgagcagaagggcgcagggcttcagagagcatgtgaccttggggccgaagctgtcggagacggtgaaggggaagctgagcctgggcgcgcggatcctgcaggccggcggggtggagcgcgtgttccgccaggccttctccgccgccgacaagggcgagcggctgctcaaggcgctgcagtgctacatctacaccacgggcgggcccatcgccngcatgctcttcgtctccaccgggaaggtcgccttccgcagcgaccgccccatcaccgtcacctccccccggcggcggcggcgacacngcgcgggtcacctaacaggtggcatcccgcctgcggagaatcgcagggtgcggcccancgagaacgtccacagcccccaggagaagtacatcacgttttccacgtcgaaggctttaaggtttggttcatgggcttcctcgccaccagaagtcctgcaagtacttcaacaggccctctcgaaaaagcaaaaaccgggt

SEQ ID NO: 95007 - protein, 237 aa, Zea mays
  misc_feature: Ceres CLONE 1585042
  misc_feature (143)..(143): Xaa is any aa, unknown, or other
  misc_feature (172)..(172): Xaa is any aa, unknown, or other
  misc_feature (191)..(191): Xaa is any aa, unknown, or other
MTMKSSSGGGHVIGVPVTSKAHGIEEVSRDPSFGKGAGDHLAVSLTHPSPYASFGYKHTGSKGQVTHWVSKLSRRAQGFREHVTLGPKLSETVKGKLSLGARILQAGGVERVFRQAFSAADKGERLLKALQCYIYTTGGPIAXMLFVSTGKVAFRSDRPITVTSPRRRRRHXAGHLTGGIPPAENRRVRPXENVHSPQEKYITFSTSKALRFGSWASSPPEVLQVLQQALSKKQKPG

SEQ ID NO: 95008 - DNA, 938 bp, Zea mays
  misc_feature: Ceres CLONE 1585047
  misc_feature: Encodes the peptide sequence at SEQ ID NO. 95009
  misc_feature (396)..(396): n is a, c, t, g, unknown, or other
  misc_feature (398)..(398): n is a, c, t, g, unknown, or other
  misc_feature (563)..(563): n is a, c, t, g, unknown, or other
ctggagctccccgcggtggcggccgctctagaactagtggatcccccgggctgcaggaattcgtctcacccctagaaaaagctcctccgcggcgcgccgcgtgctccccgcagccccagccaccatttaacgccggggtcaccagatgccaatccaatccccctgcaccagacgccaatcccgatcaccgccgcccaacctcacctcccctccgtcccccgagccacctcacaaaccctgttcggtgcctctcactccggctgccagatggacagcgccgacgcggcgacggcgctgggcgcgtggatccggggctacttcacgccggccacgttcttcctcgtcgtcaacctcgtcatcggcaccatcgcgctcacctcccgtggcacccagcancnccgccgcagggagaactactaccacgacgacggccacagccacggccacggccaccaggaaacgctgcacccgcagatggagcagccggggtacggccactactaccaaccgggaccacacgcacacgctgtacgcgggggcggcttcggcccgggccggttggngcgaaggtcctctggtcttcaaccgccttcaggtcgctcgggccggaaccgctttccccctcgggggactttcccgccccgaataaagggcccccagccgcccaaaccacgccccaggaagtggccccccccccgggggaagaaggaaaaaaacaaaatcctttgggccacaaaaccccaggaaccgggtccgaaaccgggccctttttttcccgggaaagggtaaaaaagaagccccggcccccccccggggaaaaaaaaaccggctctggaaggggaagaaaaaccccggggtgttcgggggggggccccagaaaattgcccggggggtccccaagagaaacaactctctccttaaaaaaaaaccgggcgggg

SEQ ID NO: 95009 - protein, 173 aa, Zea mays
  misc_feature: Ceres CLONE 1585047
  misc_feature (43)..(43): Xaa is any aa, unknown, or other
  misc_feature (44)..(44): Xaa is any aa, unknown, or other
  misc_feature (99)..(99): Xaa is any aa, unknown, or other
MDSADAATALGAWIRGYFTPATFFLVVNLVIGTIALTSRGTQXXRRRENYYHDDGHSHGHGHQETLHPQMEQPGYGHYYQPGPHAHAVRGGGFGPGRLXRRSSGLQPPSGRSGRNRFPPRGTFPPRIKGPQPPKPRPRKWPPPRGKKEKNKILWATKPQEPGPKPGPFFPGKG

SEQ ID NO: 95010 - DNA, 882 bp, Zea mays
  misc_feature: Ceres CLONE 1585049
  misc_feature (862)..(862): n is a, c, t, g, unknown, or other
ctggagctccccgcggtggcggccgctctagaactagtggatcccccgggctgcaggaattcgtctcacccctagaaaaaatttcatgaccataggcttagcagtttagaagttatgattttcccaagtccagtttcagaatctgtccagattctgttctgatttcgaaaattgttttgtttgactaaattaaacttataataagcccttagtaattatagaagaattgtagtacttttcttaaggtttccaacaaattttggatcaccctttttggtgatctataagttaagttacagctgtttgaagtgcgatatctgaatctgtccaaatttggacagcagagcctttctcatattttctgaccttgatatatattgaattaacctgggatgtttataaattaattgtagacaattttattagctttctaaagagtctaggatcacctgatttggatgcctgaaactctaattatggatttttgaagtaagtagtcgaattctgtccaaatctgggcagaatttatgtttagttctgtttgacctttctaaaggtcgaatcatgttgtggtgataatataaaagttatagaggactttataagctttccaaaaagtcttggtttactatttttggatgaatatcatgtgagttatgaataaaacaactgattgctgtactgctgtccaaaatcggcaaggattaagatgattgcttggagtttcttttctgtgagtatggtgaccttagtaatacaaaggagttttagtagacatgtttacctagcattaaaaagtgattcagtaatattatgtttataaagggtatgtaaatgtctttatgataagaacagtgtgatngtccatttgatggcatgcta

SEQ ID NO: 95011 - DNA, 1333 bp, Zea mays
  misc_feature: Ceres CLONE 1585051
  misc_feature (69)..(69): n is a, c, t, g, unknown, or other
  misc_feature (278)..(278): n is a, c, t, g, unknown, or other
  misc_feature (309)..(309): n is a, c, t, g, unknown, or other
  misc_feature (317)..(317): n is a, c, t, g, unknown, or other
  misc_feature (318)..(318): n is a, c, t, g, unknown, or other
  misc_feature (325)..(325): n is a, c, t, g, unknown, or other
  misc_feature (344)..(344): n is a, c, t, g, unknown, or other
  misc_feature (348)..(348): n is a, c, t, g, unknown, or other
  misc_feature (350)..(350): n is a, c, t, g, unknown, or other
  misc_feature (351)..(351): n is a, c, t, g, unknown, or other
  misc_feature (359)..(359): n is a, c, t, g, unknown, or other
  misc_feature (372)..(372): n is a, c, t, g, unknown, or other
  misc_feature (374)..(374): n is a, c, t, g, unknown, or other
  misc_feature (376)..(376): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (389)..(389): n is a, c, t, g, unknown, or other
  misc_feature (395)..(395): n is a, c, t, g, unknown, or other
  misc_feature (396)..(396): n is a, c, t, g, unknown, or other
  misc_feature (456)..(456): n is a, c, t, g, unknown, or other
  misc_feature (544)..(544): n is a, c, t, g, unknown, or other
  misc_feature (1016)..(1016): n is a, c, t, g, unknown, or other
tatatgtaagtacgctctggtgttgtgtgggagcgactgcttcttgttatggataatattttttgaatnctaaaaaaactggagctccccgcggtggcggccgctctagaatagtggatcccccgggctgcatgaattcgtctcacccctagaaaaatttcatgaccataggcttagcagtttagaagttatgattttcccaagtccagtttcagaatctgtccagattctgttctgatttcgaaaattgttttgtttgactaaattaaacttataanaagcccttagtaattatagaagaattgtagnacttttcnnaaggggnccaacaaattttggaaaancctntnntggagaanaataagttaagtnananctgnnnaaagtgnaatatnngaatatgtgcagatgtggacagcataccctttcttttactttcccaccttgatagaaccngaaaaaaccgagagaggaaccaacattgttttgttttttatgtttgagtgaggtttctgtttgagtctaagaatcacccccgatttgncataaacttgtaaacttctacattactgcgattgaattgagaggtgagtagttccgtaatttcttggtcccaagatcgtggggggaggaggattttgtggtcttaaggtctcctgattgtcgaaccattgtctcataaaaggggttcggatatgtcaattgagtttggtggtggtggtagtaaaatggattgaaaacacggctctatattaagtaagagggaaagcttttataattacagggccctctttcttccctagacaaacaagggctctcattttggtggctcttaatacacccgtaatatatttttacgttctgggcggcaatcggggagatatctcaatcgcaaatgtgtgttaggggaacaaaatttttaaatcgcgtgtaaaatttgcaaggaaatacctagatctcctgtggaaaattttagagcctctgtatatctaacccgggagagatgggcatccganccatagagaatataggacggggctcttaataggggaaaatgaaataaaggaaatatgggtaattctcgtcgccatattggaaaaaggtactcattcacctatctcttctccagggagtggagagatacaagacggcgggagcgactctctgtgtatattgcagatatcgcacaagcaaggcgagagtctatccacgtgctcatgaaaccatcgcgttatgtcacacgtaagacaccattataaattaaacgtctagatcatccaatggctagaattctcatggctatctcactgagaagagcgctagatggtcacag

SEQ ID NO: 95012 - DNA, 894 bp, Zea mays
  misc_feature: Ceres CLONE 1585054
  misc_feature: Encodes the peptide sequence at SEQ ID NO. 95013
  misc_feature (848)..(848): n is a, c, t, g, unknown, or other
  misc_feature (854)..(854): n is a, c, t, g, unknown, or other
  misc_feature (861)..(861): n is a, c, t, g, unknown, or other
  misc_feature (894)..(894): n is a, c, t, g, unknown, or other
ctggagctccccgcggtggcggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccagctccctcctcacggcccccaagccctccgccgcggcctccgacctccccgagggcgctcagtggcgctacagcgagttcctctccgccgtcaagcgcggcaaggtcgagcgcgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttcccttttatcgcgttcgctggcctcttcttcctcttccgcgcgcgcagggcgggcctggcgccgggcctggtggcctcggcgggcccatggactttcggctgctccagagcaagttcaggaggtgcctgagacggggatcacctnctcgancgtgccnggcgcgaccagcctagctcgagctgcaggaggn

SEQ ID NO: 95013 - protein, 226 aa, Zea mays
  misc_feature: Ceres CLONE 1585054
  misc_feature (103)..(211): Pfam Name: FtsH_ext Pfam Description: FtsH Extracellular
MAPPSVSASHLLITASLPKPKPSSLRPPRLPLAKPLPASAALLALAASPALAADAPAPAPAPTPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGFVAFVGNLLFPFIAFAGLFFLFRARRAGLAPGLVASAGPWTFGCSRASSGGA

SEQ ID NO: 95014 - DNA, 941 bp, Zea mays
  misc_feature: Ceres CLONE 1585055
  misc_feature: Encodes the peptide sequence at SEQ ID NO. 95015
  misc_feature (402)..(402): n is a, c, t, g, unknown, or other
  misc_feature (941)..(941): n is a, c, t, g, unknown, or other
aaagctggagctccccgcggtggcggccgttctagaactagtggatcccccgggctgcaggaattcgtctcacccctagaaaaagcctaatcctctttctttagctcaagaccggcgactaaatttggcgccagccggcagcagggggtataagtagtcgccgccgccgtcttcctcgcacctccccgctccgctctcccttgtcgagttctcagcaccggccgatccatcctcctccgcctccctcggttcggcctctggcctgcacaccatgaactctcgcttccggagcctctggagagccatggctggggctttgcagccgccgtgccgcctcggagctgccgcgtgtagcttgctcgctaagcagcagctatagtagctgagcgagtgcgtccatcnatcggagtcgtccacctccgtctccttttgcgattcggcgtcgtgaacttcgtgttcttgagcgtgggggcaaggggcagagcaaacagggagacacttctttcttcttttttacaacaaaaaagaaaagcaacgggcattggaagggagcctggtttgcattggacatggaacccaagcccatggaatccccgaaccctttctgggcgggcttctaagttggggcaaactctgggctcaaaagactccccccggggggaaaacctataaaagggggggggggggcggggtttttgaaaaattgaaaaaaccgcgggggggggggggttcccggggggaaaacccccccccggggccccctgggcccccccccccgggggtttaaaccctacacccttttccacaaggggggggttatttcccccggtgggaaaacccaacctccagggctttgggggccccccgggggtttatttgggccccccaggtttttgggttttgggggcgggggggataaaagtggcctcttttggggtttn

SEQ ID NO: 95015 - protein, 35 aa, Zea mays
  misc_feature: Ceres CLONE 1585055
MNSRFRSLWRAMAGALQPPCRLGAAACSLLAKQQL

SEQ ID NO: 95016 - DNA, 855 bp, Zea mays
  misc_feature: Ceres CLONE 1585056
  misc_feature (154)..(154): n is a, c, t, g, unknown, or other
  misc_feature (155)..(155): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (295)..(295): n is a, c, t, g, unknown, or other
  misc_feature (297)..(297): n is a, c, t, g, unknown, or other
  misc_feature (333)..(333): n is a, c, t, g, unknown, or other
  misc_feature (334)..(334): n is a, c, t, g, unknown, or other
  misc_feature (351)..(351): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (386)..(386): n is a, c, t, g, unknown, or other
  misc_feature (387)..(387): n is a, c, t, g, unknown, or other
  misc_feature (391)..(391): n is a, c, t, g, unknown, or other
  misc_feature (400)..(400): n is a, c, t, g, unknown, or other
  misc_feature (405)..(405): n is a, c, t, g, unknown, or other
  misc_feature (413)..(413): n is a, c, t, g, unknown, or other
  misc_feature (462)..(462): n is a, c, t, g, unknown, or other
  misc_feature (463)..(463): n is a, c, t, g, unknown, or other
  misc_feature (467)..(467): n is a, c, t, g, unknown, or other
  misc_feature (468)..(468): n is a, c, t, g, unknown, or other
  misc_feature (482)..(482): n is a, c, t, g, unknown, or other
  misc_feature (483)..(483): n is a, c, t, g, unknown, or other
  misc_feature (493)..(493): n is a, c, t, g, unknown, or other
  misc_feature (516)..(516): n is a, c, t, g, unknown, or other
  misc_feature (522)..(522): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (533)..(533): n is a, c, t, g, unknown, or other
  misc_feature (536)..(536): n is a, c, t, g, unknown, or other
  misc_feature (537)..(537): n is a, c, t, g, unknown, or other
  misc_feature (559)..(559): n is a, c, t, g, unknown, or other
  misc_feature (594)..(594): n is a, c, t, g, unknown, or other
  misc_feature (603)..(603): n is a, c, t, g, unknown, or other
  misc_feature (620)..(620): n is a, c, t, g, unknown, or other
  misc_feature (647)..(647): n is a, c, t, g, unknown, or other
  misc_feature (672)..(672): n is a, c, t, g, unknown, or other
  misc_feature (701)..(701): n is a, c, t, g, unknown, or other
  misc_feature (702)..(702): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (711)..(711): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (736)..(736): n is a, c, t, g, unknown, or other
  misc_feature (738)..(738): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (749)..(749): n is a, c, t, g, unknown, or other
  misc_feature (750)..(750): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (761)..(761): n is a, c, t, g, unknown, or other
  misc_feature (773)..(773): n is a, c, t, g, unknown, or other
  misc_feature (774)..(774): n is a, c, t, g, unknown, or other
  misc_feature (776)..(776): n is a, c, t, g, unknown, or other
  misc_feature (779)..(779): n is a, c, t, g, unknown, or other
  misc_feature (781)..(781): n is a, c, t, g, unknown, or other
  misc_feature (787)..(787): n is a, c, t, g, unknown, or other
  misc_feature (793)..(793): n is a, c, t, g, unknown, or other
  misc_feature (795)..(795): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (826)..(826): n is a, c, t, g, unknown, or other
  misc_feature (828)..(828): n is a, c, t, g, unknown, or other
  misc_feature (830)..(830): n is a, c, t, g, unknown, or other
  misc_feature (831)..(831): n is a, c, t, g, unknown, or other
ctcacccgcggtgggcggccgctctagaactagtggatcccccgggctgcaggaattcgtctcacccctagaaaaaactcggacggacgagcgaggcagacccgcaggtcgcagccacaacccaagcgcagcgctctgcctgcctccgctccgnngctcagctcccgccctgcctccgccttcattccaccgcgcggcgctgccgagtgccgacgtcgtccccccgcccgaaaaagtttttcctggggttnnnnnnttccctgggggnnnnngggggggnnnntcnnntnnnttntntttttttgtttgggggggggggggggggggggcggnngatattttttttttccnccccgccccnnnnccccagcaggagcaaggttggnncccncccaaagcnggggngtgagagnttataaaaaaaaaaaaaaaaaaagaggcggtttctttttctttcccccnntttnncctctcccccccgnngggggggggntgaggggaagaaaagtaaaaaantttccntttnnnggagngtnnatagtatttatttccccccgcnccgcccccgcgcttaaaaaaaaaaaaaaaaaaaanaggagtttntttagggcgccgccccncgccgggagggtaaaataaagaaaaanaatataaaaaataaagggggggggnggggggcgcaccaaaaaaaaaaaaaagtnntccnnntgncggcgggcgcggnnnnnnnnnnctntnggnnnnnnatnntnnntggcccnacgcgcgcgcgnntnttntnttttantttttntncttattttagggcggcgccgcgnnnnnnntntntnnttattttttttctgttgggggggg

SEQ ID NO: 95017 - DNA, 861 bp, Zea mays
  misc_feature: Ceres CLONE 1585062
  misc_feature: Encodes the peptide sequence at SEQ ID NO. 95018
  misc_feature (635)..(635): n is a, c, t, g, unknown, or other
  misc_feature (744)..(744): n is a, c, t, g, unknown, or other
  misc_feature (816)..(816): n is a, c, t, g, unknown, or other
tggagctccccgcggtggcggccgctctagactagtggatcccccgggctgcaggaattcgtctcacccctagaaaaaccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgncagtcctgcaagttcgacgaggacagcctggcgttccagtcgcgtctgctggccaaggtcggcatcggcgaccagtcgtacatgccgcgctgcgtgttcgagcctacgncagctgcgccacatgaaggaggggcgcgccgaggcgtcacggacatgttcgcggccctggacgagctgttcnaaatggccgcttccggcccaggacgtgggcttgctggtgttcaaa

SEQ ID NO: 95018 - protein, 224 aa, Zea mays
  misc_feature: Ceres CLONE 1585062
  misc_feature (115)..(224): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature (186)..(186): Xaa is any aa, unknown, or other
  misc_feature (210)..(210): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARQSCKFDEDSLAFQSRLLAKVGIGDQSYMPRCVFEPTXAAPHEGGARRGVTDMFAALDELFXMAASGPGRGLAGVQ

SEQ ID NO: 95019 - DNA, 877 bp, Zea mays
  misc_feature: Ceres CLONE 1585063
  misc_feature: Encodes the peptide sequence at SEQ ID NO. 95020
  misc_feature (461)..(461): n is a, c, t, g, unknown, or other
  misc_feature (462)..(462): n is a, c, t, g, unknown, or other
  misc_feature (475)..(475): n is a, c, t, g, unknown, or other
  misc_feature (478)..(478): n is a, c, t, g, unknown, or other
ctggagctccccgcggtggcggccgctctagaactagtggatcccccgggctgcaggaattcgtctcacccctagaaaaaaaccccaccttcattgattgattacagcccgttcatccttccttcccccgtcgaatcccaccttccttcccccgcccgttaagcagccgagtcagcagcaatggcggccgtgctgaggagagccgtggcgcagtgcttcgcgtcgtcgtcgtcgtcgtcgccggcgacgttcgggctccggcggttcctgcaggagcagccggcgttccgccccgccgtgccgcccgaccgcttcatgcccctggccgaccggatccgggacctcggggtcggcgtcgcattcccgcggatcaacctcgacggcctcgtgccgcccgcgccggcgccggcgccggccaagcgggagccggacgcggcgctgcccgcggcgagcctcacggnntggaggaggcgcncanggtgctgcgcgccacacagatggaggcggcccgcgcgcggattcgggagtccggcgccggcgccgtgccgtacgccgacttcctgcgcctctgctgcgacgcccgcggtccggacgccggcccctccgtcgcgcgcgggctcgacagatcgggatcgtcatcgtgctcggaaggccgtcttcctaaggccgacttgaaaaaattcaaaaaaggggccttttctaaaccaaaataaaaaattttccccccaaatttggggaatttttccccccccaaaggggattttttttcctccaacccggaaaaaaaaaccctatttttaccccccccggaaaatttggaggaaaaaaaaaattattctccccctaaaaaaaacgggggagatctccctcccccttt

SEQ ID NO: 95020 - protein, 164 aa, Zea mays
  misc_feature: Ceres CLONE 1585063
  misc_feature (94)..(94): Xaa is any aa, unknown, or other
  misc_feature (99)..(99): Xaa is any aa, unknown, or other
  misc_feature (100)..(100): Xaa is any aa, unknown, or other
MAAVLRRAVAQCFASSSSSSPATFGLRRFLQEQPAFRPAVPPDRFMPLADRIRDLGVGVAFPRINLDGLVPPAPAPAPAKREPDAALPAASLTXWRRRXXCCAPHRWRRPARGFGSPAPAPCRTPTSCASAATPAVRTPAPPSRAGSTDRDRHRARKAVFLRPT

SEQ ID NO: 95021 - DNA, 877 bp, Zea mays
  misc_feature: Ceres CLONE 1585064
  misc_feature: Encodes the peptide sequence at SEQ ID NO. 95022
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (283)..(283): n is a, c, t, g, unknown, or other
  misc_feature (284)..(284): n is a, c, t, g, unknown, or other
  misc_feature (286)..(286): n is a, c, t, g, unknown, or other
  misc_feature (300)..(300): n is a, c, t, g, unknown, or other
  misc_feature (341)..(341): n is a, c, t, g, unknown, or other
  misc_feature (457)..(457): n is a, c, t, g, unknown, or other
  misc_feature (609)..(609): n is a, c, t, g, unknown, or other
  misc_feature (713)..(713): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
ggagctccccgcggtggcggccgctctagaatagtggatcccccgggctgcaggaattcgtctcacccctagaaaaagtcttgccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctcccgnnntcccgnncntccccgggccgccngtccttctcataacctcatcggatctgtattggggttttcnagtaaggagcagaaaacgcccttaggggaatgcagaaaagaatgtgctttgcaccgtcgaaaaaagccttacctttgggggaaggggggaactttgggcccaggggaaaaaaagcnaaggggcccaaaaactctcttgtaatttcctcgggcccccctcctttgagaaaaactttccaaaaccttcaaaaaaaaaaaccacccctttttttcagcccccctaggggggggttttttcccagaaaaaaagggagggggttctaaaaacntggggggggggggctaaccccgcctttttttttaaaaaaccaaccacctctccgggcgggggaaaaaacacgtttaaaaaaaatttttttttaaaaaacacccntttttaaaaacaaaaattggggggggggcgcccaatttttttttttttacacccgcggcggagggggagaaaaaaaaaannnggaggggccgcccccccggtgtggggggggaataccccccaccccccccccacccccccttttttgtgggggtttttttttc

SEQ ID NO: 95022 - protein, 77 aa, Zea mays
  misc_feature: Ceres CLONE 1585064
MQKRMCFAPSKKALPLGEGGNFGPRGKKAKGPKNSLVISSGPPPLRKTFQNLQKKKPPLFFSPPRGGFFPRKKGRGF

SEQ ID NO: 95023 - DNA, 889 bp, Zea mays
  misc_feature: Ceres CLONE 1585069
  misc_feature: Encodes the peptide sequence at SEQ ID NO. 95024
ctccccgcggtggcggccgctctagaactagtggatcccccgggctgcaggaattcgtctcacccctagaaaaaagctcactcgtgccgtgcactcgtcccgtccccctccaccctccaagacctcgcattgccaccgccgccgccgagccaggggagaggagagaggccagccgcgtcgcggcgggcggaggaggaggacgagcgggagagcggagcgagccggccgggcaggatgttcgggcgggatccctggggcgggccgctggagatctccaacgccgactcggcgacggacgacgaccgcagccgcgacctggaccgggcggcgctgatgcggcagctggacgagacgcagcagagctggctcctggccgggcccggcgaccaggccggcaagaagaagaagcggtacgtcgacctcggctgcctcgtcgtcgaccgcaaggtcttcatgtggaccgtcggcaccgtcctcggcctcggcgtcttcatcggcttcgtcatcatgatcgtcaagctcgtcccggaaaagggccccccggcgccgccgcccgaacagtaaaggcaggggctgcacaaggggctcatgttcttcaacgcgcagggattcggcccccttgccaaacacaatggcggggcctgggggggccactcctgctggagggaggggctccccaaaaaaacctcccccggagcctggggggagggttccccaccggggggggcccccccaggttccactcccccggggggggggccggaccaggctccaggggggggcctctccaaaaaggggccaaaaaaaggcccctttgggagtctcacccatttggggggtcttcccgggggggggaggggaacattctcccaaagacttaattttgggg

SEQ ID NO: 95024 - protein, 109 aa, Zea mays
  misc_feature: Ceres CLONE 1585069
  misc_feature: SWISSPROT Homolog: EC 3.2.1.4 Cellulase
MFGRDPWGGPLEISNADSATDDDRSRDLDRAALMRQLDETQQSWLLAGPGDQAGKKKKRYVDLGCLVVDRKVFMWTVGTVLGLGVFIGFVIMIVKLVPEKGPPAPPPEQ

SEQ ID NO: 95025 - DNA, 814 bp, Zea mays
  misc_feature: Ceres CLONE 1585070
  misc_feature (427)..(427): n is a, c, t, g, unknown, or other
  misc_feature (624)..(624): n is a, c, t, g, unknown, or other
ctggagctcaccgcggtggcggccgctctagaactagtggatcccccgggctgcaggaattcgtctcacccctagaaaaaaaccgcagcccgggatgcgctccaccccgaccgccaagcgcctgtcgccgcccgcgatgcgctcgaccccaacaaattctctcacaagatctggcgaaacccgtcacctccgctctcctcctctaccctcgggatcctggtggccaacgtcgtcctcgttggcgagatgacctccaagctccaccagacctcgcgctccaccgacgactggaggcctctgccccttcgggatctccttattcacaaggcgtcgaggccgccgtcgaccacgtcatgccgctacgctaggaggaggcgtcgaccaacatcggcttcgcagtggcctaggcgtgccgtgctgatgtgcntcgccgtttcgcccgcctccctcccaaagctgcttctaggccgtcgcgatggaggcaatcagcaacaccaggttaaccctcgagatcctggtgggcgacagcgtggtcctcgtcggcgagatggtgacctccaagctcctccaaatctggcactccgctgacgtccagaggccctccgccctttggggatctccttnaatcacaaggtggaacaagccacacgggtttctaacttttacttgagcggacccaacttgggaacctacggggggggggaaagggccgtccccatattggggggccaaaaagcccaggggggccccaaagggggggcacaaaaacccctgtggggctttcttgggggccccccttttagagaaaaaaggg

SEQ ID NO: 95026 - DNA, 881 bp, Zea mays
  misc_feature: Ceres CLONE 1585073
  misc_feature: Encodes the peptide sequence at SEQ ID NO. 95027
ctggagctccccgcggtggcggccgctctagaactagtggatcccccgggctgcaggaattcgtctcacccctagaaaaagaggtagtgtctgcaaccgtctaagtccaccccaagtctccgccgtcaacacgttctcccccatggacgccgctgccaccatctctctatcctacgactttcgtttccggccgcccctttgatcttcacgtatccccacgcgccacgctcccttttcacatgatctcctcttcccttcatgcccgcagccgcctctgcgtctctcccggccgaccctcaccgtacacatggcgccccgacgagcgggcgcgcgctagaagcagcatctgggcgccgcatgcaattagtgcaccgggcagtacaaatgcagacggaccgactacgatacgatgtgttgtacccgacaatgaaggcggtcaactacttatgcgttcgcgtcacagtaggagaggtctactctatggctagactgcatctcgtgcatgaagagctcttatctctaggacttttcatcgaccactgaggcttactgaagtgatctgaggacgtggaagtgctttacgtcttcccaaaggactaccgggaaaaatgggtgggaaaaccttaagatgccggtcaaatctttggttgacaatccaaccaatggggggacttattgggaccttcttttgatagaaaatgccaaaggggctaaattggggggggtaaattaaaataattggcatttccgaaacctaagaattttttaaaaattgtctggggaggaggccaaaaaatttttgggtgtaccttattttttccccagggattttttgggggacacgaagggaggtttttttttaaaggtttcaactgaaaagg

SEQ ID NO: 95027 - protein, 94 aa, Zea mays
  misc_feature: Ceres CLONE 1585073
MPAAASASLPADPHRTHGAPTSGRALEAASGRRMQLVHRAVQMQTDRLRYDVLYPTMKAVNYLCVRVTVGEVYSMARLHLVHEELLSLGLFIDH

SEQ ID NO: 95028 - DNA, 817 bp, Zea mays
  misc_feature: Ceres CLONE 1585074
  misc_feature: Encodes the peptide sequence at SEQ ID NO. 95029
tccccgcggtggcggccgctctagaactagtggatcccccgggctgcaggaattcgtctcacccctagaaaaaaaccgcagcccgggatgcgctccaccccgaccgccaagcgcctgtcgccgcccgcgatgcgctcgaccccaacaaattctctcacaagatctggcgaaacccgtcacctccgctctcctcctctaccctcgggatcctggtggccaacgtcgtcctcgttggggagatgacctccaagctccaccagacctcgcgctccaccgacgactggaggcctctgccccttcgggatctccttattcacaaggcgtcgaggccgccgtcgaccacgtcatgccgctacgctaggaggaggcgtcgaccaacatcggcttcgcagtggcctaggcgtgccgtgctgatgtgctccgccgtttcgcccgcctccctccccaaagctgcttctaggccgtcgcgatggaggcaatcagcaacaccaggttaaccctcgagatcctggtggccgacagcgtggtcctcgtcggcgagatggtgacctccaagctcttccaaatctggcactccgctgacgtccagaggcctccgccctttgggatctccttaatcacaaagtgggacaagcaccacggcttctagctctacttgagcgacccagctggcaactacggcgggtggaaaggcgtcccctattggggccaacagcctagtgggcacaaggggggaacaagagccctggtggctttctggtgccccgtttgaggaaaggtgaaggcaaagggggctcccccttgcccacttcaagga

SEQ ID NO: 95029 - protein, 59 aa, Zea mays
  misc_feature: Ceres CLONE 1585074
  misc_feature: SWISSPROT Homolog: EC 3.4.25.1 Proteasome endopeptidase complex
MEAISNTRLTLEILVADSVVLVGEMVTSKLFQIWHSADVQRPPPFGISLITKWDKHHGF

SEQ ID NO: 95030 - DNA, 973 bp, Zea mays
  misc_feature: Ceres CLONE 1585077
  misc_feature: Encodes the peptide sequence at SEQ ID NO. 95031
  misc_feature (320)..(320): n is a, c, t, g, unknown, or other
  misc_feature (321)..(321): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (756)..(756): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
ctggagctccccgcggtggcggccgctctagaactagtggatcccccgggctgcaggaattcgtctcacccctagaaaaaaccgcacgtccgcacgccgctcttcttcccctgcttgctctgggttcctccattcctctccagtctccatcacaggagcacgcgacgcgcgccacaggaaggaagggaaaaaacatggcggcggcgaacggggacgcgtgccgcagcgtcggcggggtgccgcgcccgacgaaccccatggtgacgccgctgctcaccgacctgtacccagtcaccatgggctacgcctactggaaggcnnggcagcactcgaccgcgcagtctttgatctctactccggaaaaatccatttgccggggagtcaccattacgtcggggccccaggaattgataagggtcattggtaaactcaggttccgggggggatttnnnnnnnnnncccaaccccccgccccccccggagggaaaaacccccggaaaacccccccccaattgggccgcccaaaggggggggttttcccccccccgagggggagggggggggggccccatccccccccggcagaaaaaaaaaggggggggggggggggggggcggtgggaaaaccccttttaaaatgtgggaaaaaattttctttggggcccaaaaaaggggcggcccctcacggttttggggggagaaaaaaaannnnnnaaacnnnntttgnnnnnnngcggggggcgggggnnnnncgggnaagcgnnnncgggattttttggggggggggggggccccccaacccgccgcgcgccggggagggtgtggtgagaaaaaagagagggtttctctccccttggggtggcgcctgccgggggggaggaggagaaaaaaaaacaaacacccttctttttgtgtgggaagaaaaaaaaattttttttttttgggggggcgggggaagaagaggatttattctt

SEQ ID NO: 95031 - protein, 146 aa, Zea mays
  misc_feature: Ceres CLONE 1585077
  misc_feature: SWISSPROT Homolog: EC 2.4.2.11 Nicotinate phosphoribosyltransferase
  misc_feature (43)..(43): Xaa is any aa, unknown, or other
  misc_feature (86)..(86): Xaa is any aa, unknown, or other
  misc_feature (87)..(87): Xaa is any aa, unknown, or other
  misc_feature (88)..(88): Xaa is any aa, unknown, or other
  misc_feature (89)..(89): Xaa is any aa, unknown, or other
MAAANGDACRSVGGVPRPTNPMVTPLLTDLYPVTMGYAYWKAXQHSTAQSLISTPEKSICRGVTITSGPQELIRVIGKLRFRGGFXXXXQPPAPPGGKNPRKTPPQLGRPKGGVFPPPRGRGGGPHPPPAEKKRGGGGGGRWENPF

SEQ ID NO: 95032 - DNA, 906 bp, Zea mays
  misc_feature: Ceres CLONE 1585079
  misc_feature (32)..(32): n is a, c, t, g, unknown, or other
  misc_feature (35)..(35): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
ggaaaagagagagagggaggggagcgccatcnttnttgattgggggagggtgggggggccccctnnnnnnaaaaactggagctcacgcggtggcggccgctctagaatagtggatcccccgggctgcaggaattcgtctcacccctagaaaaaaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcgtcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctggcctccatcgcgactggcgtcctcatctggctcatcccgccccccgccggcgtgccccgcaacgcgtggcagctcctagccatcttcctctccaccatcgtcggcatcatcacccagccgctgcccctcggcgcggtcgccctcctcggcctcggcgccgccgtgctcagccgcacgctcacgttcgcccgcggcctttctcggccaccgggcgaccccgattccccttgggctcattcgcggctccccccttccttcctttcgcgaagggggggttccaatccaagaaccgggccctccgggcttccccgcggttcggcccttccggccttttgctgtcggcccggccctttccgggg

SEQ ID NO: 95033 - DNA, 904 bp, Zea mays
  misc_feature: Ceres CLONE 1585082
  misc_feature: Encodes the peptide sequence at SEQ ID NO. 95034
  misc_feature (668)..(668): n is a, c, t, g, unknown, or other
  misc_feature (771)..(771): n is a, c, t, g, unknown, or other
ctccccgcggtggcggccgctctagaactagtggatcccccgggctgcaggaattcgtctcacccctagaaaaaacccgtgcactggcccccgttcgccgccctccccgccgtggggtccggtccgccgccctccccgcccatcccccgcccaacccgccgccggttcccgtccagccgcacgcgccttcttcctcccccggcgccttctcggtgaaccagacccgtccggccgtccctcacccgtgcgactcccgcagcgccggcccctccgtcacctccgcatcctccccgtccttgcggccatatccgtcgtctccgcatcctccttcctacgctctgtcggcgtggcctccccatcccggtgttctccgattttggggggcgtccctttgcccgctccggtctgctcctccagagtccggtccagcggagcgcactacgacacagatcggcagccgtccatccctttccagctctccagagcctccgccggcgcatccggcgactgatttgcaggggttacatggcacccgagtacttggatgatggagtgatcacaatgaagacagacatctatagcttgggtgtgataatcagacacatgggtgagggacgtaactcggcagacaccactgatgaaagagtactggcaaactggttgattangctggaaaaggatccatcacagatgatgaggcagcagacgacccgatttatatttgaaacagagtacaagagcaaataaaagcgtgcatggatatatcatggnagtgcacgctgcgtaaaccaatggacaggtcacgacgcagcacatcctacttacactggagggaacagaaagcaagatcaatcggtcgttgggccctactcacaaatgcgggcagcttcagattgcaaattga

SEQ ID NO: 95034 - protein, 73 aa, Zea mays
  misc_feature: Ceres CLONE 1585082
  misc_feature: SWISSPROT Homolog: EC 2.7.11.1 Non-specific serine/threonine protein kinase
  misc_feature (48)..(48): Xaa is any aa, unknown, or other
MAPEYLDDGVITMKTDIYSLGVIIRHMGEGRNSADTTDERVLANWLIXLEKDPSQMMRQQTTRFIFETEYKSK

SEQ ID NO: 95035 - DNA, 872 bp, Zea mays
  misc_feature: Ceres CLONE 1585083
  misc_feature: Encodes the peptide sequence at SEQ ID NO. 95036
  misc_feature (814)..(814): n is a, c, t, g, unknown, or other
gagctccccgcggtggcggccgctctagaactagtggatcccccgggctgcaggaattcgtctcacccctagaaaaacttttccgctccagacacagcagcccctcttgtaccagtaaaccgtgctgctatcccccgctagccgccgcgctgctgcggctcgcctccctcctccccagtccccacgccccgccgccgccgccgccacctcctctcgctccctccttttaccccgagcttaagctcgcgcgtacctgcctacctatccgtaggagaggaagaggggacaaggcccggtcggtcggtcggtcggtcggggggctctcggatctcgccgctgcctccccgttcgttcgttcgttcgttgggatctcgcgccatggccgccgtcgcgccgcccccggcccccgcgccggcaccggttcctgctcctgctcctgccaccggccctgtcgcggatcaaaccacggatctgctgcagaagctgtcgctcgactcgcagcccaagccggcggacgcaacacagcctgctgctgccaccgccaaaaagggcgccgcggcgagccagccgctgagcgtggcgatcccgccggagccgtccatcacgccggtgatccaagactttacggatcccaacctgttttatctaccagcgtattactacggaggctacgacagttccatgagcgagtgggatgattatccgagatatctaaattcagatggagtggagattgccccagcggtatacggagatattatgggatatgggtatgctccttacggggcatactctcctgccacttcccccagtnccacagttgaatggtcagatgtttggtgcacagcattaccagtatccagctgcgtatt

SEQ ID NO: 95036 - protein, 164 aa, Zea mays
  misc_feature: Ceres CLONE 1585083
  misc_feature (146)..(146): Xaa is any aa, unknown, or other
MAAVAPPPAPAPAPVPAPAPATGPVADQTTDLLQKLSLDSQPKPADATQPAAATAKKGAAASQPLSVAIPPEPSITPVIQDFTDPNLFYLPAYYYGGYDSSMSEWDDYPRYLNSDGVEIAPAVYGDIMGYGYAPYGAYSPATSPSXTVEWSDVWCTALPVSSCV

SEQ ID NO: 95037 - DNA, 790 bp, Zea mays
  misc_feature: Ceres CLONE 1585085
  misc_feature: Encodes the peptide sequence at SEQ ID NO. 95038
gcggtggcggccgctctagaactagtggatcccccgggctgcaggaattcgtctcacccctagaaaaaactcccgactccacctctctccgatcgtctcatcttcttccttctcttccaccacatccttgctatctcatccggatcgaccagtacacgccccagtagtactaaagaaccagtttcgttctgagtaaaacatggcggcgtcgccttccccgtccggcagcggcggcggcaaggccggcgtggaccggatcaagggcccctggagccccgaggaggacgaggccctgcagcgcctcgtgcgccgccacggcgcgcgcaactggtccctcatcagccgctccgtcccgggccggtccggcaagtcgtgccgcctccggtggtgcaaccagctgtcgccgcgggtggagcaccgccccttcacgccagacgaggacgacgccatcctccgcgcgcacgccaggttcggcaacaagtgggccaccatcgcgcgcctcctctccggacgcacggacaacgccatcaagaaccactggaactccacgctcaagcgcgagcgcgagcgcgagcgcgagtactacgccgatgcgcgccccggccccggcgaccagcgctcgctcaagcgcaccagcagcgacgggccccccggaagcccgtccgggtccgacctcagcgactccagccaccagagccttcacaccgtgatgccggtcgccgcttctaccgccatcacgtcccagcagcggctacaacgcgttgtactagccgccccgtggcggggcggc

SEQ ID NO: 95038 - protein, 197 aa, Zea mays
  misc_feature: Ceres CLONE 1585085
  misc_feature (21)..(67): Pfam Name: Myb_DNA-binding Pfam Description: Myb-like DNA-binding domain
  misc_feature (73)..(118): Pfam Name: Myb_DNA-binding Pfam Description: Myb-like DNA-binding domain
MAASPSPSGSGGGKAGVDRIKGPWSPEEDEALQRLVRRHGARNWSLISRSVPGRSGKSCRLRWCNQLSPRVEHRPFTPDEDDAILRAHARFGNKWATIARLLSGRTDNAIKNHWNSTLKREREREREYYADARPGPGDQRSLKRTSSDGPPGSPSGSDLSDSSHQSLHTVMPVAASTAITSQQRLQRVVLAAPWRGG

SEQ ID NO: 95039 - DNA, 884 bp, Zea mays
  misc_feature: Ceres CLONE 1585090
  misc_feature: Encodes the peptide sequence at SEQ ID NO. 95040
  misc_feature (36)..(36): n is a, c, t, g, unknown, or other
  misc_feature (43)..(43): n is a, c, t, g, unknown, or other
  misc_feature (73)..(73): n is a, c, t, g, unknown, or other
  misc_feature (80)..(80): n is a, c, t, g, unknown, or other
ggggggtttgggggtgtgtgacgtctgtatttatantgaaaanaaattgtaactaaattctcttttatacttnttttttncaaactgggactccccgcggtggcggccgctctagaatagtggatcccccgggctgcaggaattcgtctcacccctagaaaaatttcttctcagcttccttcttcttcattagcttctgctcctatcgactgagctccgaaacgttccctcttctcgctacctttcctgtagaaaacccaacctttagctagctaactgctcctcttctccccctacctactccccttgcccaatcacgagaagatatttaactgatgacgggaacgagagaatatctacctgactgttgattgatggtcccggctacggcgttcttcagtcccgacatgaccgcactgtggttagagacctctcccggttgcatgcaagatgtgtccccggacatgcgtaagaagatgctgtcatgggtcggaaggataaatgtaccgcaagaacgactcggcactctcctgtttctacctcttcctcctctggttcttcttcttgaaatagaccagcgcctgccaccaggtagctacctactagctagcagcccagttgcaactggggacaggctgctgcttgcaagttggaatcttggagcaggagcacaggagcgggagatggagctggatctgaacgtggccgaggtggcgccggagaagccagcggcggcgctggaggctagcgactcggggtcctcaggctcgtcggtgcttaacgccgaggcggcttcggcggggctggcggggggaaccgccatcgggggaatgatcgattcaaatttctccccgggacattttgccaatttcagcagttctcat

SEQ ID NO: 95040 - protein, 159 aa, Zea mays
  misc_feature: Ceres CLONE 1585090
MTALWLETSPGCMQDVSPDMRKKMLSWVGRINVPQERLGTLLFLPLPPLVLLLEIDQRLPPGSYLLASSPVATGDRLLLASWNLGAGAQEREMELDLNVAEVAPEKPAAALEASDSGSSGSSVLNAEAASAGLAGGTAIGGMIDSNFSPGHFANFSSSH

SEQ ID NO: 95041 - DNA, 819 bp, Zea mays
  misc_feature: Ceres CLONE 1585091
  misc_feature: Encodes the peptide sequence at SEQ ID NO. 95042
gcggggcggccgctctgaactagtggatcccccgggctgcggattcgtctctacccctagaaaaacccactccgggccctcacacaaattgcccctcttcttgtcctcctctttacacgctgccgaccacggctgccgccaaccacccgccccaccgctgccgagtgctagccatttggagctgccgcgccatggcgtccgtggccgccaccaccacgctggcaccggcactcgcgccccggcgccgggcgcggccagggagcgggctgctgccgccgcggcgggcctcggccgtccgctgctcgctcgacagtaacgtctccgacatgggcgtcaacgctcccaaaggggtattcccacccgagccagagcactacaaggggcccgaagcccaaggggggcatcataagggggaaggccttgccggggatgttcccccgctggttgagctcctttggacccaagggccatggaggtttaattttgtaacaaaatccccccccccttttttcggggggggaaggggggggggccccctttgtttttaacggggcaagggaaaacccatttcccccaattggggggcgccccggtgtgttttttcttgggggggggacaaaaaaaaaattctttttcccccccccctttaaaaaaaagggggtggggcccgcaaaaaaaaaaaaccagccgggggggggagggggagaaaataccccccccccattttttttgtaaataaaaaaaggggggggcccaacaatgggggggaaaaaaacaaaattattttgggggccccccccgcggggggggggaccccca

SEQ ID NO: 95042 - protein, 118 aa, Zea mays
  misc_feature: Ceres CLONE 1585091
  misc_feature: SWISSPROT Homolog: EC 1.14.99.30 Carotene 7,8-desaturase
MASVAATTTLAPALAPRRRARPGSGLLPPRRASAVRCSLDSNVSDMGVNAPKGVFPPEPEHYKGPEAQGGHHKGEGLAGDVPPLVELLWTQGPWRFNFVTKSPPPFFGGGRGGGPLCF

SEQ ID NO: 95043 - DNA, 836 bp, Zea mays
  misc_feature: Ceres CLONE 1585092
  misc_feature: Encodes the peptide sequence at SEQ ID NO. 95044
cggccgctctagaactagtggatcccccgggctgcaggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgaccctggcgcgcagtccggcaagttcgacgaggacagcctggcgtttcagtcgcgtctgctggccaagtccggcatcggcgacgagtcgtacatgccgcgctgcgtgttcgacccaacgccagctgcggcaccatgaaagaagggccgcgccgaagcggtcaccggcatgttcgcggcggctggacgagctgttccacaagggccccggtccggcccaaggacggggg

SEQ ID NO: 95044 - protein, 190 aa, Zea mays
  misc_feature: Ceres CLONE 1585092
  misc_feature (115)..(190): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDPGAQSGKFDEDSLAFQSRLLAKSGIGDESYMPRCVFDPTPAAAP

SEQ ID NO: 95045 - DNA, 825 bp, Zea mays
  misc_feature: Ceres CLONE 1585094
  misc_feature: Encodes the peptide sequence at SEQ ID NO. 95046
  misc_feature (675)..(675): n is a, c, t, g, unknown, or other
cggccgctctagaactagtggatcccccgggctgcaggaattcgtctcacccctagaaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaacctgaccgggcaaactatcacccctcgagtggagtcttcagacaccatcgacaacgtcnaggccaagatccaggacaagaagggcttccccccgaacagcaacggcttatctttgcttgaaaagcacttgaggaccggccccacctgggccaactccaacttcaaaaaggaaaggcccctccccctggggctggccccccaagagaagg

SEQ ID NO: 95046 - protein, 228 aa, Zea mays
  misc_feature: Ceres CLONE 1585094
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (179)..(179): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKNLTGQTITPRVESSDTIDNVXAKIQDKKGFPPNSNGLSLLEKHLRTGPTWANSNFKKERPLPLGLAPQEK

SEQ ID NO: 95047 - DNA, 808 bp, Zea mays
  misc_feature: Ceres CLONE 1585095
  misc_feature: Translation starting site: 363
  misc_feature: Pfam Name: B56 Pfam Description: Protein phosphatase 2A regulatory B subunit (B56 family)
  misc_feature (808)..(808): n is a, c, t, g, unknown, or other
ctccccgcggtggcggccgctctagaactagtggatcccccgggctgcaggaattcgtctcacccctagaaaaaaaaatccctattcctcctcagcataccccttcttccttcgtccccattgatccccttcccccctccactcgtctcccaaatcgccagcgagcgccatgccgccgcctcccctgccctcgccgcccctgaccggctgacccgacctccccactgttctttcccttccacctgggcgccacagcgtttcccttcccgtcaccacgaaatcccggagggacgaggagggagttcgtcgcctgatcgatcggccgatccacgccgccggcctcccaatccttcgctgccgccatgttcaacaagataatcaagaggggaaaccgcaagggcgcgcgcggggacagcgcggaggtcgccgcgcgccccgcagcgccctcgtcgtcctccgggagcggcggcggcggcgcggggggagctgcgcccgtcaccgtcaaccactcctcgagccgctcccgctcctccgcgacgtcgccgccgcagaccgtccgggcctcatcctccgcaagctccgcctcgtcgcggcgctcttcgacctctcggactcgctcaagcacccgcgagagaaggaggccaaacgccaggcgctcctcgagctcgtagattacgtgcaggctccagctcaggccgcgggcgccaacgcgcccacgcgcctcccggaccacgtccaggaggcgctagtccttgccatctctgccaacatcttccgcccgctgccacccgcgctgcacgagtccgcn

SEQ ID NO: 95048 - DNA, 830 bp, Zea mays
  misc_feature: Ceres CLONE 1585109
  misc_feature: Encodes the peptide sequence at SEQ ID NO. 95049
ccccgcggtggcggccgctctagaactagtggatcccccgggctgcaggaattcgtctcacccctagaaaaaagcacggcttgctaaacacgcagaaaagaaaagccgttctccctccgtttccccaaaccccaaggttcccaaccatggcagccgccgccgattctgcctccgaccaaaaccctaaggacgccgagcggcacgtgctcaccgccgaatccgacgccgatttctccgaggaggactacgacgaggatggggaggaggaataccaggaggaggaggagctggacgggccggcggcggcggcggcggagcgggagcggatgcagtccgtgttacggaggctgtcatccgaccccgtgggcatccgcgtccacgacgtgatcatcaagggcaacaccaagacgcaggacgagctcatcgaggcggaggtcgccgagctgctccgcgccgcccccaccgtgcaggacctgctccgcgccgccagtgtcgccactgcgcggctgcacgatctcgacatcttcgacgccgtcgagatcacgctcgacgccgggccgcccgagctgcctggcaccaccaacgtcgtcatcgaggtcgtcgaggtggccaaccccctcactggcaccgccggcgtctattcgaagcccgaagcaagatcttggtcgctgggaagggtcacttaagtttgaagaacttggtttgggtatgggtgacatctggggatgcatccaggaatcctttggtttggggacccaaccaaacagagggttgggtggttgggagtccttggcctaccggagggttttaaaatcaattagcgaacaact

SEQ ID NO: 95049 - protein, 179 aa, Zea mays
  misc_feature: Ceres CLONE 1585109
MAAAADSASDQNPKDAERHVLTAESDADFSEEDYDEDGEEEYQEEEELDGPAAAAAERERMQSVLRRLSSDPVGIRVHDVIIKGNTKTQDELIEAEVAELLRAAPTVQDLLRAASVATARLHDLDIFDAVEITLDAGPPELPGTTNVVIEVVEVANPLTGTAGVYSKPEARSWSLGRVT

SEQ ID NO: 95050 - DNA, 811 bp, Zea mays
  misc_feature: Ceres CLONE 1585115
  misc_feature: Encodes the peptide sequence at SEQ ID NO. 95051
  misc_feature (376)..(376): n is a, c, t, g, unknown, or other
  misc_feature (390)..(390): n is a, c, t, g, unknown, or other
  misc_feature (393)..(393): n is a, c, t, g, unknown, or other
  misc_feature (396)..(396): n is a, c, t, g, unknown, or other
tcaccgcggtggcggccgctctagaactagtggatcccccgggctgcaggaattcgtctcacccctagaaaaagtctcaagctcgccatttcgcctccgtttccaactcccagtgccggtcttccactcctcccttcttcgcctcccaatttccaaacctctctcttgggagcacgtacacgcggaggaaaagcgatcggccccgcggcggcaagatgactgcggcggcgacgatgacgtggcacgaggacctggccactctcgtgggggacacggacgttcacctcacaggcgccggggggcacacgccggcgccggcgaatgttgcggcggcgggggccgggtggtacggggaggaggaagaggtgagggcganggaaggggtgggcncancangcgaaggggttcgcggagtcgacggcggagatgctgcgggagctgggccgggggctgtgggacgtcgccgcgcagagcctcgccggcgccgaggacagcgagctcgggcggcggctgcggaagcgggcggcggccacgggggagcgcctcagcttcatgaacgagtaccttcccgaggagcgcgacccggtgaggtgttggctcatcgtcgccgcagtctcattcgtcacgctcctagttttaagtgctgggaatggcaatgaaactccagtgggagcttccagagaaacttaccatcggtcccccaagtgctgataaaatccaacttcctgatggacgacatctggcttatgaaaaaacaaggagtctcagctaacagagcaagattttccactgatggctcctcattcttttt

SEQ ID NO: 95051 - protein, 94 aa, Zea mays
  misc_feature: Ceres CLONE 1585115
MLRELGRGLWDVAAQSLAGAEDSELGRRLRKRAAATGERLSFMNEYLPEERDPVRCWLIVAAVSFVTLLVLSAGNGNETPVGASRETYHRSPKC

SEQ ID NO: 95052 - DNA, 826 bp, Zea mays
  misc_feature: Ceres CLONE 1585118
  misc_feature: Encodes the peptide sequence at SEQ ID NO. 95053
ccccgcggtggcggccgctctagaactagtggatcccccgggctgcaggaattcgtctcacccctagaaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgggagcagatgcggaagggcaactacaagcagacggtggacgcggaggagagccgccgccgccgcgagggccagatggtggacatccgcaaggccaagcgcgaggaaagcctccagaagaagcgccgcgatgggtttcccgcctccgccgctggtgtgccgccgatgggccactccaccgcgctccagcagaagctcgatggcttgccggcgatggtgcaggccgtccactccaacgacccctccgtgcagcttgaggccaccacacagttcaggaagctgctttctatagaacgtagtcccccaatcgaagaggtgatcagcacaggagtggtgccgcgattcattgagtttcttacacgtgaggaccatccccaactccagtttgaggctgcatgggcactcaccaacattgcatcaggcacatcagagaacactaaggtggtggttgagagtggtgctgtgcccatctttgtcaagctactcaactccctcagcgaggatgtccgtgaacaggctgtatgggctttaggtaatgttgctggtgactccccaaggtgtcgtgatctggtacttggtcatggg

SEQ ID NO: 95053 - protein, 202 aa, Zea mays
  misc_feature: Ceres CLONE 1585118
  misc_feature (106)..(147): Pfam Name: Arm Pfam Description: Armadillo/beta-catenin-like repeat
  misc_feature (149)..(189): Pfam Name: Arm Pfam Description: Armadillo/beta-catenin-like repeat
  misc_feature (4)..(97): Pfam Name: IBB Pfam Description: Importin beta binding domain
MSLRPSEREQMRKGNYKQTVDAEESRRRREGQMVDIRKAKREESLQKKRRDGFPASAAGVPPMGHSTALQQKLDGLPAMVQAVHSNDPSVQLEATTQFRKLLSIERSPPIEEVISTGVVPRFIEFLTREDHPQLQFEAAWALTNIASGTSENTKVVVESGAVPIFVKLLNSLSEDVREQAVWALGNVAGDSPRCRDLVLGHG

SEQ ID NO: 95054 - DNA, 934 bp, Zea mays
  misc_feature: Ceres CLONE 1585123
  misc_feature (53)..(53): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (362)..(362): n is a, c, t, g, unknown, or other
  misc_feature (372)..(372): n is a, c, t, g, unknown, or other
  misc_feature (383)..(383): n is a, c, t, g, unknown, or other
  misc_feature (385)..(385): n is a, c, t, g, unknown, or other
  misc_feature (386)..(386): n is a, c, t, g, unknown, or other
  misc_feature (391)..(391): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (408)..(408): n is a, c, t, g, unknown, or other
  misc_feature (410)..(410): n is a, c, t, g, unknown, or other
  misc_feature (416)..(416): n is a, c, t, g, unknown, or other
  misc_feature (433)..(433): n is a, c, t, g, unknown, or other
  misc_feature (434)..(434): n is a, c, t, g, unknown, or other
  misc_feature (442)..(442): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (473)..(473): n is a, c, t, g, unknown, or other
  misc_feature (490)..(490): n is a, c, t, g, unknown, or other
  misc_feature (493)..(493): n is a, c, t, g, unknown, or other
  misc_feature (528)..(528): n is a, c, t, g, unknown, or other
  misc_feature (687)..(687): n is a, c, t, g, unknown, or other
  misc_feature (724)..(724): n is a, c, t, g, unknown, or other
  misc_feature (731)..(731): n is a, c, t, g, unknown, or other
  misc_feature (736)..(736): n is a, c, t, g, unknown, or other
  misc_feature (742)..(742): n is a, c, t, g, unknown, or other
  misc_feature (774)..(774): n is a, c, t, g, unknown, or other
  misc_feature (804)..(804): n is a, c, t, g, unknown, or other
  misc_feature (812)..(812): n is a, c, t, g, unknown, or other
  misc_feature (818)..(818): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (872)..(872): n is a, c, t, g, unknown, or other
  misc_feature (873)..(873): n is a, c, t, g, unknown, or other
  misc_feature (901)..(901): n is a, c, t, g, unknown, or other
  misc_feature (917)..(917): n is a, c, t, g, unknown, or other
tggagctccccgcggtggcggccgctctagaactagtggatcccccgggctgncaggaattcgtctcacccctagaaaaatccccccgccacgaccccgtcagccctcacacaagtagacgcagctgcgagtccgccagccttatcctcctccccgtctccggctccaaccgcaagcgcggtaaggatggcttctacattcggtgccacttctactgtcggccttatggctgctccaacaggtaagaatgtgcgcccttcagagggaggggtggaacttcagaaactaaagaagccnnnntaaagggaggggggccccnnnnaaatataagagagagggcccccnnnnnaacaaaaaacaanccaccaaganccacagggtgntnntaggngaaaagaannngtgagnanagaagngaaaatgaaaaaaaagnntaggaaanaaannnnagagaaggagaaacaagaattggnagaagaagaggaaaagnagnagaaggaagaaggaggatagagaagaggggagacngctagggagactaatcacaaaatgtggagaggcgagggaaatcctcaaaagataggggcacatggaagagagaggcgcaaggggggagaggaagataatttcaatgattgataagagaggcatatagagcgataggggcggtgagggaggggggcgganagggaaagaagcgagaggcgaggtaaggggaccatanagaaggngtggngagatnagggagcgacaaaatcaaagaggattagtgcnttgagagatatggggaaagagaccaactgncagaaganccatgngctgcgggaggtgaaggatgttcnnngtgccccagacctgggggggggaaccgnnccgagggaggaaccagggatttgggagntaatttaccttcatcnaagccagtgagggtgat

SEQ ID NO: 95055 - DNA, 863 bp, Zea mays
  misc_feature: Ceres CLONE 1585128
  misc_feature: Translation starting site: 249
  misc_feature (635)..(635): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
aagctggagctcaccgcggtggcggccgctctagaatagtggatcccccgggctgcaggaattcgtctcacccctagaaaaaaccgccaccgccaccgccggctcctgttgccaccgcccgctggctggcttagcgcgtaggctgtgactgactgactgactgactgcgagaccacagcaccggaggacgcccgcgcgcgcgaaccgcagcgcagaggcaggggaaccttgtccgcggctcggccggcatgaagctcccgctgctgcgtccgctgtggccgggcctggggcctgcggcggcggggccgcccgacgcggcgccggagccggccaagccctcgctgccggccacgtggctgctgctgcacgcgctcttctgcgccacatccatggccgtcggcttccgcttctcccgcctcatcgtcttcctcctcttcctgcccaccccgcccatcaaccccgccgcgcacctcgtctcgctcgtgtcctcgcccgccgtggcgctcgcgggggccaacgccacggccacgatcaccacgaccaccaccaccaccaccaccgtcaccaccaccaccaccaccgtggccgccgacatcggcggcgcccaaccgcaccaccaccaccaccgccacggnccccgtcttcgtccgccacggcataggnnnnnnnnnnnnnnnnnnnnnnnnnnnnnnnnnnnnngnnnnnnnnnnnnnnnnnngnnnnnnnnnnnnnnnnnnnnnnnnnnnnnnnnnnnnnnnnnnnnngnnnnnnnnnnnnnnnnnnnggnnnannnnnnnnnnnngnnnnnnnnnnnnnnnnnnngnnnnnnnnntnnnnnnnnnnnnnnncgnnnnnnnnnnnca

SEQ ID NO: 95056 - DNA, 837 bp, Zea mays
  misc_feature: Ceres CLONE 1585129
  misc_feature: Encodes the peptide sequence at SEQ ID NO. 95057
  misc_feature (658)..(658): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (683)..(683): n is a, c, t, g, unknown, or other
  misc_feature (684)..(684): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (692)..(692): n is a, c, t, g, unknown, or other
  misc_feature (693)..(693): n is a, c, t, g, unknown, or other
  misc_feature (696)..(696): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (708)..(708): n is a, c, t, g, unknown, or other
  misc_feature (709)..(709): n is a, c, t, g, unknown, or other
  misc_feature (714)..(714): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
tccccgcggtggcggccgctctagaatagtggatcccccgggctgcaggaattcgtctcacccctagaaaaaacatgtgcatctcagcagcactagcagtgacaaactcgaagcttgccttcttgtttacaccctaaaactaaaactagagtcgtcggcggcaacaagcggtacgtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtgtccacgggcaagggcgccaccaagtacaggtgccgcgacttcctccccgaaaactgcgggtgcaagatccactaaactcatccaattccaccatggccacagcagccgatggatccttcttccatatgcatgttctcctccgtccgtccgcctagctttgctacaagcaggcgctaataagcaagctgctgttgttgttttgcatgtttgattaggtgaccctttccactcgagatggaataaaataaacgtcaggcgcacgtactgacgtgttattncgnnnnnnnntnnnnnnnnnnnnanncnnnnnanntcntcaaagnnnaannaaatnannnacgacaaaaaaaaaaaaaaaccggaaaacccaaggaagaaaggggtttcccaaccccttccggggcggtaaagggggggaaaaaaccccgggcccagatttggggggctcctcgccaaa

SEQ ID NO: 95057 - protein, 89 aa, Zea mays; identical to SEQ ID NO: 73295
  misc_feature: Ceres CLONE 1585129

SEQ ID NO: 95058 - DNA, 816 bp, Zea mays
  misc_feature: Ceres CLONE 1585130
  misc_feature: Encodes the peptide sequence at SEQ ID NO. 95059
tccccgcggtggcggccgctctagaactagtggatcccccgggctgcaggaattcgtctcacccctagaaaaactagaaaaaagggttcctcccacagccgccgctacgctttggctgcatcactcgctcctcttcggagcctccctttcgccggcggcgtaggaagagatggcagagcgtttgacccgtatcgccatcgtcagcgaggacaagtgcaagcccaagaagtgccgccaggagtgcaagaagagctgccccgtcgtcaagactgggaagctttgcattgaagtaacttcggcatcaaaactagctttcatttctgaggagctgtgcatcggttgtggtatctgtgtaaagaaatgtccatttgatgccattgaaatcatcaaccttccaaaagacttggaaaaggataccactcaccgatatgggcctaataccttcaagttgcacagattgcctgtcccaaggcctggtcaggttttgggccttgttggaacaaacgggattggaaagtcgacagctcttaaagtgttggctggcaagctgaaacctaacttggggcgcttcaaaaacccacctgattggcaggaaattcttacatactttcgtgggtctgaacttcagaactacttcacacgcatattggaagataacctgaaggcaatcatcaaacctcagtatgttgaccacattccaaaagctgttcaagggaatgtaggacaagtacttgaacagaaggacgagagggatatgaaatctgaaactgtgtgttgatcttgaattaaaccaagttattgacccgaaatgtagga

SEQ ID NO: 95059 - protein, 202 aa, Zea mays
  misc_feature: Ceres CLONE 1585130
  misc_feature (6)..(37): Pfam Name: RLI Pfam Description: Possible metal-binding domain in RNase L inhibitor, RLI
  misc_feature (48)..(71): Pfam Name: Fer4 Pfam Description: 4Fe-4S binding domain
  misc_feature: SWISSPROT Homolog: EC 1.2.7.7 3-methyl-2-oxobutanoate dehydrogenase (ferredoxin)
MAERLTRIAIVSEDKCKPKKCRQECKKSCPVVKTGKLCIEVTSASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKSETVC

SEQ ID NO: 95060 - DNA, 957 bp, Zea mays
  misc_feature: Ceres CLONE 1585132
  misc_feature: Encodes the peptide sequence at SEQ ID NO. 95061
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (77)..(77): n is a, c, t, g, unknown, or other
gcgagagggggggggggttgggagcgattggtcgtcgatggggggggggggggggggggcccccctggctannnaanaaaaaaactccacccgggggcggccgctctagaatagtggatcccccgggctgcaggaattcgtctcacccctagaaaaactcccaaagccatcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagtttagtgttgccctgtcccctgcattcaatgtcatcaacgggggggttcccagtgctgggaaaccaagcttggcttatgccaggagttttattgatcccttccctaccttggaagctgccctccctttaaagggaggggcttattaaaggaaggggtggttggaaaggttttattccacccccccttggaaggacgccggttttttcgaaagaaaggcaagtttttggggggctaaggcattttcccctccccgaaaatggtttaggggtttgaacctgacaaaggggggggggattttgtgcca

SEQ ID NO: 95061 - protein, 196 aa, Zea mays
  misc_feature: Ceres CLONE 1585132
  misc_feature (4)..(140): Pfam Name: Enolase_N Pfam Description: Enolase, N-terminal domain
  misc_feature: SWISSPROT Homolog: EC 4.2.1.11 Phosphopyruvate hydratase
MAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQFSVALSPAFNVINGGVPSAGKPSLAYARSFIDPFPTLEAALPLKGGAY

SEQ ID NO: 95062 - DNA, 919 bp, Zea mays
  misc_feature: Ceres CLONE 1585133
  misc_feature (368)..(368): n is a, c, t, g, unknown, or other
  misc_feature (384)..(384): n is a, c, t, g, unknown, or other
  misc_feature (405)..(405): n is a, c, t, g, unknown, or other
  misc_feature (406)..(406): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (417)..(417): n is a, c, t, g, unknown, or other
  misc_feature (423)..(423): n is a, c, t, g, unknown, or other
  misc_feature (434)..(434): n is a, c, t, g, unknown, or other
  misc_feature (472)..(472): n is a, c, t, g, unknown, or other
  misc_feature (473)..(473): n is a, c, t, g, unknown, or other
  misc_feature (479)..(479): n is a, c, t, g, unknown, or other
  misc_feature (481)..(481): n is a, c, t, g, unknown, or other
tcaccgcggtggcggccgctctagaactagtggatcccccgggctgcaggaattcgtctcacccctagaaaaacccatatctctgtcctgcatcactcgccgccatccactcccgatccaaacccgagagctcccacctccgccgccctgttcgctcgtccgccttttcactccccgtagctagctgctgtcgcggagcaaccccgcgattccaagaaaagcaacttggtcaagaaagagtgcaagaaaggaggacggtgctgacgatgatggcgataagccaccccatgattcgccccatcattccgtcgcctccggggcctgcgcgctagctgctagaagggcctcgccgtccgtcgtggtggtgngtggtggtggtgtgcngcggggcgggagggggagggnnannnnaaaaanaaaaangaagaagaaanggaaaaaaagtaaaaaggaaaagggagagggggagggnnaaaaanangaaaaggaaaaaaggggggggggaagaaaggaaagaaaaagggggagaggggggaaagaaaagaaagaggggggagagaaaagggggaaaggggggggggagaaaaagggggaaaaaagggggaaaagaaggggggagaaaaaaaaagggggtagggggtattaagaaaagggagaaaaaaaggggtgaaggaggggggggaaaaaaataaggtgagaaaaaaggatgggaaaaaaaaaaaaaaagaggaaaaaaaataaaagggataaagggggattgtattaaaaataaataggagagggagaaaaaataaaagggtggagaaaaggggggagagttatatgggggaggaaaaaagggggaataaaaaagggttgtaatagtgagggttaaaaaaggtgtaatatatatttgggggggatagaaaaaaatcagaga

SEQ ID NO: 95063 - DNA, 829 bp, Zea mays
  misc_feature: Ceres CLONE 1585134
  misc_feature: Encodes the peptide sequence at SEQ ID NO. 95064
ctcccgcggtggcggccgctctagaatagtggatcccccgggctgcaggaattcgtctcacccctagaaaaactccatgcctccagtgtccagtccagagtccaggctccaggactaccaccacttcgtctcgtcctcacacctcactccaccacctctgccttgcaaagccttccaccgatccgccgcctcgtccgcgcgctcgcaggcagcagtgtggactacccgccccatactccatcccctactcgaaggatacaccgtgagtaggcgtgatggtgcttgataccccgttttcgtgcagcttgttgctaattcgttttagtttgagggatcaagaaccaccttgttctttctttctttctttcttggaacaattatgatgaatcattgcaaatctcttgaatatatttttcactgtaaaatactgccttgcctttgagctccttggttcacgtgcaatgtttctttgccctccgattttgcaggacctcgagttaagttgggcgaggagaggtggttcattccagcagggatccttctcgtgagcccagtcgatctgaccgtccttggtatctggggggggttgttctgtactctctctttaatttgtgagtcgtgacaggttcttgaagtgcaattgttaagagttttagttgtagaggaaagagaggatttgctaatatggcgttggcagggacctcaaagtagtgctgggatgtatcgcctttgggattttctgggtgatgggcgtcttccccacccgtccgttcatgcctgttgggcggaccgctgggtccctccttggggctatgcttatggtcctgtt

SEQ ID NO: 95064 - protein, 35 aa, Zea mays
  misc_feature: Ceres CLONE 1585134
MVLDTPFSCSLLLIRFSLRDQEPPCSFFLSFLEQL

SEQ ID NO: 95065 - DNA, 823 bp, Zea mays
  misc_feature: Ceres CLONE 1585137
  misc_feature: Encodes the peptide sequence at SEQ ID NO. 95066
gcggtggcggccgctctagaactagtggatcccccgggctgcaggaattcgtctcacccctagaaaaaacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaacctcttcttcagcactgatgttgagaagcacgtcgctgaggctgacattatctttgtctcggtgaacacccccaccaagacccgtgggcttggagctggcaaggctgccgacctcacctactgggagagcgctgcccgcatgattgcggatgtctccaagtctgacaagattgttgttgagaagtccactgtccctgtcaagaccgctgaggctattgagaagatcttgacccacaacagcaaggggcatcaactaccagatcctttccaacccagagttccttgcggaagggcactgcccattgggggacctgttcaagccctgacagaagtgcttaatcggggggccggggagacccccgtgagggcaaggaagggccgtcccagggcttctc

SEQ ID NO: 95066 - protein, 196 aa, Zea mays
  misc_feature: Ceres CLONE 1585137
  misc_feature (2)..(182): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGHQLPDPFQPRVPCGRALPIGGPVQALTEVLNRGAGETPVRARKGRPRAS

SEQ ID NO: 95067 - DNA, 843 bp, Zea mays
  misc_feature: Ceres CLONE 1585138
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
ctccccgcggtggcggccgctctagaactagtggatcccccgggctgcaggaattcgtctcacccctagaaaaaatcaccttttcactgctccagcgaagaaggcacacagccagccgccgccgccgattattcatcttcctcacagcgccggcgctacatcttccgctacctcggcacaggcgacggcgggggcgctcaggctcgggctcgcgctcggagcgacggcgtcagcggcttccccctccgcctcttgccagtcgcctcgcgcccttgcctccggtcctccgcacaccagccggtgaccctgtgtgcgtgcccccctctctctctcctcccgcctccggtggatcgtcaaacggagccaggcctcggcgtctgcgccgcgcgcggcgagggcaggccggggggggggggggggggggnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 95068 - DNA, 971 bp, Zea mays
  misc_feature: Ceres CLONE 1585140
  misc_feature: Encodes the peptide sequence at SEQ ID NO. 95069
  misc_feature (336)..(336): n is a, c, t, g, unknown, or other
  misc_feature (405)..(405): n is a, c, t, g, unknown, or other
cggccgctctagaactagtggatcccccgggctgcaggaattcgtctcacccctagaaaaaatcctctctttccagccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtnctcaagaaggaaaaggtgtccctggccgggcatgaggagtatattgtgagggggtggggagggatctgntccccgctgtttacgggaaggccttcaagggaaatcaaacagatcgggtgtaaatccggctgggggctcggaagggtccctggcgcaaggcttcagaaactgggagagaaatccactttgttggaagggaaaaaggcaaaaaatttggttggtaaaaaaatggggtcttcccgggaaaagggttcctaaaatcctttttggaaaaaaaacccccgaacccaccccggggaattcccccccaaaaaaaagatggggaaacccctgggggtgaaaaaatttggggaagaactggtatcaaaaacagaggggaatccttggttttgggctacccggaaaaaaccgaaatttctgcgcccccgggggtggttaacctctccggaaaaaatatttttcctccgcccccttggaaaacccaacccggggtgttctctcggggttttgtggccaaagggaggagttttcctcccccggggagaaaattttgaaagatctcccgcgggggggtttgtatatttttccccccaaaaagaaaaacccaggggtgggttaggtcgtgtttataccca

SEQ ID NO: 95069 - protein, 95 aa, Zea mays
  misc_feature: Ceres CLONE 1585140
  misc_feature: SWISSPROT Homolog: EC 1.1.1.86 Ketol-acid reductoisomerase
  misc_feature (33)..(33): Xaa is any aa, unknown, or other
MPSLDFETSVLKKEKVSLAGHEEYIVRGWGGIXSPLFTGRPSREIKQIGCKSGWGLGRVPGARLQKLGEKSTLLEGKKAKNLVGKKMGSSREKGS

SEQ ID NO: 95070 - DNA, 821 bp, Zea mays
  misc_feature: Ceres CLONE 1585142
  misc_feature: Encodes the peptide sequence at SEQ ID NO. 95071
tcaccgcggtggcggccgctctagaactagtggatcccccgggctgcaggaattcgtctcacccctagaaaaaacacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgaatcagttgtagctggtgaatttggcaagactcaatttctctcatctgagttcagaaacgtttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcactgcagcctgctgaagtctttacttgctgcattctgtgctcacttttgaaagctgctctcttctgctctgcgttgttgatttctgcactcaagcttctcttgcctgtgcactcaagcttctctcttcctgggcaactagtgatctccttgaagcatttcagcttttacctagagatctttctgtttgttaaaggcaagagaaggctttagggtgatggcgcaaactagcctgccctctgggttttcgtttccacccacccaatgttgagcc

SEQ ID NO: 95071 - protein, 29 aa, Zea mays
  misc_feature: Ceres CLONE 1585142
MSAEVAGGHPYFLSCYFWFIYCIKFRDFT

SEQ ID NO: 95072 - DNA, 817 bp, Zea mays
  misc_feature: Ceres CLONE 1585143
  misc_feature: Encodes the peptide sequence at SEQ ID NO. 95073
ctccccgcggtggcggccgctctagaactagtggatcccccgggctgcaggaattcgtctcacccctagaaaaaaacacatcaaacccaactccccgcaccaatgtccttccaagtgccttccaactcgctcccaaatgcagacgagaaaaagctgcgcgtctgcggtttgattgcgctagcgcgccttccgaatcctctgcgccgcccgccgccgtcgtgaacgaagaccacgaccacgaccccggcgcgtcgtcgccggccgccggagagcggtgcccgtgctgctcctccccctcctcctcgccggccgtgccgtggcggcggtccgtgaagcggaagctgggcgcggagaagggggaggagggcgcggaggcggggcccacggcgcgggtcgaggcggaggacgagtgcgcggcgctgcgggaggcggtggcggcggcccagtccacggcgtcggcgctgcgggccgaggtcgaggaggagcggctcgccgcggccagcgccgccagcgaggccatggccatgatgcttcgcctgcagcgcgacaaggccgaggtccagatggagctccgccagttccgccgcttcgccgacgagaagatggcgctcgacgccgcggacatcgaccagctgcgcgcgctcatcgcccagcgcgcgcgccgcctggtgcgcctccgcgccaggctccgcgagtacaggcgccagttcctccacctcggcatcccgctccccgagggcgaggacctcctgttcgcccagaccgccgccgaggaggaaaagacctactcctcctcaagggcgaggacgggtacgca

SEQ ID NO: 95073 - protein, 271 aa, Zea mays
  misc_feature: Ceres CLONE 1585143
  misc_feature (137)..(230): Pfam Name: DUF593 Pfam Description: Protein of unknown function, DUF593
PRGGGRSRTSGSPGLQEFVSPLEKNTSNPTPRTNVLPSAFQLAPKCRREKAARLRFDCASAPSESSAPPAAVVNEDHDHDPGASSPAAGERCPCCSSPSSSPAVPWRRSVKRKLGAEKGEEGAEAGPTARVEAEDECAALREAVAAAQSTASALRAEVEEERLAAASAASEAMAMMLRLQRDKAEVQMELRQFRRFADEKMALDAADIDQLRALIAQRARRLVRLRARLREYRRQFLHLGIPLPEGEDLLFAQTAAEEEKTYSSSRARTGT

SEQ ID NO: 95074 - DNA, 986 bp, Zea mays
  misc_feature: Ceres CLONE 1585145
  misc_feature: Encodes the peptide sequence at SEQ ID NO. 95075
  misc_feature (29)..(29): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (59)..(59): n is a, c, t, g, unknown, or other
  misc_feature (92)..(92): n is a, c, t, g, unknown, or other
  misc_feature (469)..(469): n is a, c, t, g, unknown, or other
  misc_feature (886)..(886): n is a, c, t, g, unknown, or other
  misc_feature (957)..(957): n is a, c, t, g, unknown, or other
tttttatgttttttttgtgaaacaatttncanaannaaacgtttacggagggagggggncataatcatctttcccaaagctggagctcaccncggtggcggccgctctagaactagtggatcccccgggctgcaggaattcgtctcacccctagaaaaagcaagaagcacttggaccggggtgggggcggcggcggaggtggcacggagctcttcatctgcttcacctcgcgttcctccgctgcctcagccatttccgtcgccggcggcagcgcgcactcttccctccgcccctccagctcctccaagctcctcagccccggccgcggcagtgccagcgcaagcggagctgaggcagtgccggccccgcctctgcgcccctcactcagccgccgcctccgcaacagcggcagcctcaagggcggccagtccccaatgttcccctccgggtccaccggcggtggccgccncggccggggcggattcgaacctgccgaaccctcgtctcccaaggtcacctgcatcggccaggtccgcgtcaagggcggtaagcgcaagcccaagcacgcctccgccgccgcgctgcgctcccgctccaggcgcggcggaggcgggagcgcagaggccagcttccgccgcgctggcgacgaccgggaaggaccccagggcaagaaccaaggcctggctgcaccagatcccgggtcaacttctgcacagcactcaagacattttggcctcctgcggggggccgcctcctctctgactcattcgtccccgggccctgaccaaagcccaacacaagtgggaatgccgcctgtgaacacccggactgcaaaacccgggggcgttttggaaggccgaggggaccgggcccaccccttccctgncataaaaaaagaatatagctgtggccaaataatgcgggggagaacacaacaatgggtggggggcaaaaaanggtgggcccccttcccggtgggggcgact

SEQ ID NO: 95075 - protein, 184 aa, Zea mays
  misc_feature: Ceres CLONE 1585145
  misc_feature (12)..(12): Xaa is any aa, unknown, or other
  misc_feature (151)..(151): Xaa is any aa, unknown, or other
  misc_feature (175)..(175): Xaa is any aa, unknown, or other
MFPSGSTGGGRXGRGGFEPAEPSSPKVTCIGQVRVKGGKRKPKHASAAALRSRSRRGGGGSAEASFRRAGDDREGPQGKNQGLAAPDPGSTSAQHSRHFGLLRGAASSLTHSSPGPDQSPTQVGMPPVNTRTAKPGGVLEGRGDRAHPFPXIKKEYSCGQIMRGRTQQWVGGKKXWAPFPVGAT

SEQ ID NO: 95076 - DNA, 920 bp, Zea mays
  misc_feature: Ceres CLONE 1585155
  misc_feature: Encodes the peptide sequence at SEQ ID NO. 95077
  misc_feature (14)..(14): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
ggagtttaggtaanattgagcatcacatcagtgggggtggggggggggggtgtgggggggccccccgggnnnnaaaagctgggactcaccgcggtggcggccgctctagaatagtggatcccccgggctgcaggaattcgtctcacccctagaaaaaatcccctcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatggtcagtggggtttattcggatgacaataaccttcagcttgaggccaccacacagtttcgcaagttgctatctatagagaggagccctcccattgaagaagttatcaaatcaggtgtagttccaagatttgtgcagttgctcacaagagaggatttgccccagctgcagttcgaagcagcatgggctctcacaaatattgcttctggcacttcagaaaatacaaaggttgttattgatcatgggggctgttcctatatttgtgaaagcttccatgggtcctggtagtgattgaatgttccgtgaagcaagcctgtggttgggcttttggggcaaatggttgcttgggcaatttcctcccaaaggtggtccgggaacaccttggttccttggccaaatgggggggccatttggatggccctt

SEQ ID NO: 95077 - protein, 168 aa, Zea mays
  misc_feature: Ceres CLONE 1585155
  misc_feature (4)..(92): Pfam Name: IBB Pfam Description: Importin beta binding domain
  misc_feature (101)..(142): Pfam Name: Arm Pfam Description: Armadillo/beta-catenin-like repeat
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKSGVVPRFVQLLTREDLPQLQFEAAWALTNIASGTSENTKVVIDHGGCSYICESFHGSW

SEQ ID NO: 95078 - DNA, 815 bp, Zea mays
  misc_feature: Ceres CLONE 1585156
  misc_feature: Encodes the peptide sequence at SEQ ID NO. 95079
  misc_feature (395)..(395): n is a, c, t, g, unknown, or other
  misc_feature (681)..(681): n is a, c, t, g, unknown, or other
ggccgctctagaactagtggatcccccgggctgcaggaattcgtctcacccctagaaaaaacttatccttttcccgcggcgattattgcggtcactgacctatgttgagtgcagatctacaactggttcgagatgttagcgcgcccggctgtttgatcacggtgatctagctgctgtcacgaagacgagcccgccaactctcgattagttcgtggacggtagcgatggaaaaagatgacgatggagataaccatgatggcgagaggcgcccgcgcgacccttcccgtgattggagctttttctggggctgcccacggatcgctgccacggccacgaccgacctaccggtgggggtagtggtgcgccgccaccaccagtccacgcgacccgcgtcnaggaagaagaagggataggagacggagacggagacggagccggtggtcgcaaggatggccgggggcatgcaggcggcggacgcggcgggccggctgagcgcgctgctctcgctgctcgcgctgcgccggctcctcgccgtgctccagccgctggccctgctcctgctcctgcccttccggtggcgcgcgcggcctgcctgggccgtggccgcggccgtggcgtccgatgccgccacggtcctccgcgccgggggcccatcgggtaggaaggggataggcgtcctcnttcgtctttcgggtggttctgccgggttcccggccggggtccccccaatgggaccccccccctcgtaagggtagggcgttcccgccccgcatgggagataatcgctctattgctccccggggaggcccgggaag

SEQ ID NO: 95079 - protein, 99 aa, Zea mays
  misc_feature: Ceres CLONE 1585156
  misc_feature (78)..(78): Xaa is any aa, unknown, or other
MAGGMQAADAAGRLSALLSLLALRRLLAVLQPLALLLLLPFRWRARPAWAVAAAVASDAATVLRAGGPSGRKGIGVLXRLSGGSAGFPAGVPPMGPPPS

SEQ ID NO: 95080 - DNA, 854 bp, Zea mays
  misc_feature: Ceres CLONE 1585158
  misc_feature (740)..(740): n is a, c, t, g, unknown, or other
  misc_feature (746)..(746): n is a, c, t, g, unknown, or other
  misc_feature (748)..(748): n is a, c, t, g, unknown, or other
  misc_feature (764)..(764): n is a, c, t, g, unknown, or other
  misc_feature (765)..(765): n is a, c, t, g, unknown, or other
  misc_feature (805)..(805): n is a, c, t, g, unknown, or other
  misc_feature (823)..(823): n is a, c, t, g, unknown, or other
  misc_feature (840)..(840): n is a, c, t, g, unknown, or other
  misc_feature (854)..(854): n is a, c, t, g, unknown, or other
tggagctccccgcggtggcggccgctctagaactagtggatcccccgggctgcaggaattcgtctcacccctagaaaaagctccgtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcaattttttttttactgtcaaggataagcaagtgacctctgtgtgcataccaccaccaccatacgtagcatacacaggcacagatggcagagcataaagggaacgttctcttgcacaagtatgagatgggggaaatgcnttggcnangcaccttttgcaaggnnttaccatgctcgtaacacggcgactttcgaaagtgtcgcngatcaagtgattgataangagaaggtaatgaaggntgggtctcattgan

SEQ ID NO: 95081 - DNA, 1074 bp, Zea mays
  misc_feature: Ceres CLONE 1585159
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (23)..(23): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
nnnnnnccccaannncnnnnaanaaaaaaaatttaaaaaagaatgcataatccgttctggcgaggggaggnnnccaagctggagctccccgcggtggcggccgctctataatagtggatcccccgggctgcatgaattcgtctcacccctagaaaaagctccgtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctgcgggctttcgcacaatgggggttcgacggtggacggctcaacccgtctttccttaagatcacccatcttcgagtgggagacaggttgatagtctttgaacaccccttctccaaccctcttttggcctggtcctcaagtttgtttttttattaacctggtccagaagggataagaaccaaggtggaaccctgctagatggtgggcagttagcccagccaagcgaggcatattatcgttgggccagtacggagaaggggtgccaaaaaatgcgccaaaaaacccattaaaaggggggaaaaggtgtcttccttcggcacacaaaaaaatgagagaacaggggggaaaaatgttggcctgtgggcccaaaaggacaccccttttgcacccaaggagttttaacccctgggcttgcgtataaacaggaggccacactttccgtgaatagatgggatgtccggaacagcaaagatgtatatcgatatatcagaggaaaaagggtgtat

SEQ ID NO: 95082 - DNA, 802 bp, Zea mays
  misc_feature: Ceres CLONE 1585163
  misc_feature: Encodes the peptide sequence at SEQ ID NO. 95083
ctcaccgcggtggcggccgctctagaactagtggatcccccgggctgcaggaattcgtctcacccctagaaaaagcggcgctaaataaatatcccactacctcaaacctcgctgcccctctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtcggtttctactctgcctacctcgtcgccgagagggtcgtcgtgaccaccaagcataacgatgacgagcagtacgtgtgggaatcccaggcgggcgggtcgttcactgttactcgtgacacgtctggggagcagcttggcaggggtactaagattacacttttcctcaaggaagatcaggtatgcaggaagctggatcaatcaaagttcgttatta

SEQ ID NO: 95083 - protein, 195 aa, Zea mays
  misc_feature: Ceres CLONE 1585163
  misc_feature (28)..(182): Pfam Name: HATPase_c Pfam Description: Histidine kinase-, DNA gyrase B-, and HSP90-like ATPase
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKITLFLKEDQVCRKLDQSKFVI

SEQ ID NO: 95084 - DNA, 852 bp, Zea mays
  misc_feature: Ceres CLONE 1585165
  misc_feature: Encodes the peptide sequence at SEQ ID NO. 95085
aaactggagctcaccgcggtggcggccgctctagaactagtggatcccccgggctgcaggaattcgtctcacccctagaaaaaaataaaattccccattccaactcacacagatctcgtacccggcagtggcgacgaatctcgcggggcggaggtggtggcgcgactgaggcggtgtcgactccgacgaactcgcagccaccgggggatacgcagcagcagcaccggcgtactccatcgacgttcatatttaaggacttggtttggataattctactcgtcaacaaaagtgattaaaaatggtggttcttgcagcttcaatcgtttcaaagtcgggaaaagcacttgtttcaagacagtttgttgacatgtctcgcataagaattgaaggattatatcttctacttataacaaacaagcagagcaatattcttgaagatctggacacattgaggctcctctccaagcttgtgcctgaatactccccttccttggatgaggacggtatttgtaaaacagcatttgagaatatatttgctttcgatgaagccatctctcttgggaacaaggaaaatgtgacagtgcaacaagttaaacaatattgtgagatggagagccatgaagagaaggcacacaagctgatgatgcaagccaaaatcaacgaaaccaaggatctcatgaagaagagggctaatgaacttgacaaaatgaggatggaaagaggcaagcttggacaagggaggatactcatcaatatctgggtccacgcgttgattgaaaaaaacttttagtggacataagcatcagtgggtttcgggaatttggtagtggtttctgggattaggtgggaccg

SEQ ID NO: 95085 - protein, 163 aa, Zea mays
  misc_feature: Ceres CLONE 1585165
MVVLAASIVSKSGKALVSRQFVDMSRIRIEGLYLLLITNKQSNILEDLDTLRLLSKLVPEYSPSLDEDGICKTAFENIFAFDEAISLGNKENVTVQQVKQYCEMESHEEKAHKLMMQAKINETKDLMKKRANELDKMRMERGKLGQGRILINIWVHALIEKNF

SEQ ID NO: 95086 - DNA, 982 bp, Zea mays
  misc_feature: Ceres CLONE 1585170
  misc_feature (226)..(226): n is a, c, t, g, unknown, or other
  misc_feature (419)..(419): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (463)..(463): n is a, c, t, g, unknown, or other
  misc_feature (464)..(464): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (511)..(511): n is a, c, t, g, unknown, or other
  misc_feature (512)..(512): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (543)..(543): n is a, c, t, g, unknown, or other
  misc_feature (567)..(567): n is a, c, t, g, unknown, or other
  misc_feature (568)..(568): n is a, c, t, g, unknown, or other
  misc_feature (682)..(682): n is a, c, t, g, unknown, or other
  misc_feature (683)..(683): n is a, c, t, g, unknown, or other
  misc_feature (742)..(742): n is a, c, t, g, unknown, or other
  misc_feature (754)..(754): n is a, c, t, g, unknown, or other
  misc_feature (765)..(765): n is a, c, t, g, unknown, or other
  misc_feature (767)..(767): n is a, c, t, g, unknown, or other
  misc_feature (773)..(773): n is a, c, t, g, unknown, or other
  misc_feature (774)..(774): n is a, c, t, g, unknown, or other
  misc_feature (788)..(788): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (885)..(885): n is a, c, t, g, unknown, or other
  misc_feature (931)..(931): n is a, c, t, g, unknown, or other
  misc_feature (967)..(967): n is a, c, t, g, unknown, or other
cggggcggcgctctaactagtggatccccgggctgcagattcgtctccccctagaaaaacagtcgcccttcaacttgccagccgatcccttcgcgtttgtctccgcggttccgacgctccgcactccgctcccctctcccaagcaaacacagccgagtccacgcacgcctcccatcttcctcaccgcctcgccggagcaagggagtacggaggatgagattgaccnagcgtgcgcgggtgcagcgaccgccgcattgcgccccccgaggttaggggaaaccgccccgctttaaaatggtttttttcccagggggggggggtcttttttgggggggctttttttcaccccttttttttggggaaaaagaaaaaaacaccccccccccccccccccccccttttttttaatagaaaaaaanggggggggggggnnnnnnnnnnnnnnnaagagggaacnnnaggnncccccccccccccccccccnnnnnnnnnaaagggaggagggtgtggnnagnnnnnaggnnnaggaaggannnnnntttncggggtgtgttgtcccccaccccnnttttggtttttaaaaaaaaaaccccccgcccccgggctctttttttttttagaaaaaaccccccggggtttttcttctctaaaaaaaaaaaaatcaatcctcttcaaaaaattnntttggggggggcccccccccccacacaggggaaaaaggacggcgtagatatagaggaangaggagggaganccttttttttntncctccnncccagtatgccccncctccttttttttttttaataaaaaaaaaaggaccgaccccgcgccccccnnnnngggggcggagnnnnnccccccccccaaaaaaaaaaaaaacangggggggggggtgggggggaaaaacacaccaccccccccccccccntttttttgggaaaaaaaaaagaaaaaaaaagccttnttttgttttcttttc

SEQ ID NO: 95087 - DNA, 824 bp, Zea mays
  misc_feature: Ceres CLONE 1585183
ctccccgcggtggcggccgctctagaactagtggatcccccgggctgcaggaattcgtctcacccctagaaaaagcaacctttgccgagcggcaggacgacgaagcggaggagttgctgtgcggggtgaaggaagaggagtcggctcaggtacaagaaccggccaagaatccgtcaggccgtcccaccccactaccccaggaaggggtcgaaacagcggccggccccggcctcacttcacctcggcagcactgggttaattccatggagccacgttttctacaagtttcgtgattggtggtgtggggttgatgaacttgaagcatcactcatccggtcagacgtgtttcgtagaccttgacgctgagctatcggagttgggtttccaaaaaaaggtggagctctgagaagttccgcattcttctaaaggaagtaggagatacccaggaagcagcatggcattttcttacagcaatgggaggacattgccctcgaaatgggaggatgcagagaggtggatcttcagtcccaattccagcgacatgcgtggaagaactacggttgctcatggtcggaggccaaagtctaaaagtggcccccctggggcctccaggaagacttggtggacagtattcatctgtttcttcggtgtcattgcttgatagtgggagagttggacctattacatcaaattctcatttttcagcaggagtactaatgcccaggacatgttttgtggaggaaaaaaataacaaagggggcctatttccggtagaaccaatttggtgaccaaaatcaacctttggtagaaaggagtctcgaata

SEQ ID NO: 95088 - DNA, 1268 bp, Zea mays
  misc_feature: Ceres CLONE 1585184
  misc_feature: Encodes the peptide sequence at SEQ ID NO. 95089
  misc_feature (15)..(15): n is a, c, t, g, unknown, or other
  misc_feature (68)..(68): n is a, c, t, g, unknown, or other
  misc_feature (880)..(880): n is a, c, t, g, unknown, or other
  misc_feature (956)..(956): n is a, c, t, g, unknown, or other
  misc_feature (978)..(978): n is a, c, t, g, unknown, or other
  misc_feature (1244)..(1244): n is a, c, t, g, unknown, or other
ggggggggggggggngcccggccccggcgcgccgggcccgggacgccgagcgccgcaatgtgtcttgnggaagggtgggctcctcgcggtggcggccgctctagaactagtggatcccccgggctgcaggaattcgtctcacccctagaaaagtctctctctctctctccactccacacctgagagggaatcctgctccctcttgctccgcgcccgcggcggcggcggcggctttggtatccgtgcgggtgtttctgtccggcgtttacttcccaggccagcgcggcattggaggagggagatcggaggcgtgatcgatggggaactgcatggggagcgggggcgcgacgacggtcacggcggcaggtgctgcaggtgaggaccggaagcgccgggtgaggaggtggaaggttccgcgggaggagcaggtcggggcggtccccggccggagctgtctccttcgactgccttgggcgcacccccgccgtgttcacagctgcacgggccgggaaggggaattccaatacaagaccaccaatggctcggtctgggactgggtttccgggcgggcggacggatagacgccgcctgactttgtgtgggagtagttctcgacatggacatccgagaccccactatatttcccagatctgtattgaagaatcttgccggaatttcaatgacacataacctgaaagtgaccctgctcctattagtagcttgacttctgtatctcattgctagtcggttaagctaccacgattcccctccagcatgcgtgccgaggtctcgctgtgatttgagatctaatctatctctccctagttacctgcgcacacgaggctgggcatccagagtaatgaagaaggttacgggtccnccatttcctactatacttatcacatcattccagccgcctataacacgaataggttcaattcgattttcggggccanccttgagggtgatatattgtanttgcttgagactaagaatatagataagcatctgtaacatccgtgagagaaagtgtgggcgtgtccactgggcggatgcctagcggcgaagcagactgacggagatatcgcctgtaaaaaacttgataagaataaatatggttaactagtcaagaccctgaaatatctctagaagcctatacgtacccaagcccgcccgcggtattagaagtctaacgcgcggatcctatttctgcgttgtgggttacgcgaagagcgactacacanctacacacacggcactattcgttt

SEQ ID NO: 95089 - protein, 87 aa, Zea mays
  misc_feature: Ceres CLONE 1585184
MGNCMGSGGATTVTAAGAAGEDRKRRVRRWKVPREEQVGAVPGRSCLLRLPWAHPRRVHSCTGREGEFQYKTTNGSVWDWVSGRADG

SEQ ID NO: 95090 - DNA, 1092 bp, Zea mays
  misc_feature: Ceres CLONE 1585185
  misc_feature: Encodes the peptide sequence at SEQ ID NO. 95091
  misc_feature (10)..(10): n is a, c, t, g, unknown, or other
  misc_feature (11)..(11): n is a, c, t, g, unknown, or other
  misc_feature (19)..(19): n is a, c, t, g, unknown, or other
  misc_feature (20)..(20): n is a, c, t, g, unknown, or other
  misc_feature (67)..(67): n is a, c, t, g, unknown, or other
  misc_feature (896)..(896): n is a, c, t, g, unknown, or other
gggttggggnnttccccgnnaaaccagacagagaagaacaacaaacgcgccggcagagcgaagaggnatgggtgcaagctggggctcacgtcggtggcggccgctctagaactagtggatcccccgggctgcaggaattcgtctcacccctagaaaaatcagaccgacgcagactctctcacccgactcgtcagacgtcggccagcggttcgaaaactaggatcgatccacgagcttccggaaggcgaggcgcgcgcgcagcgtcgaggtgctggtgccggtgccgcccatggatcgggctcgcggatccgcgttcctgctcggagtcctgctcggaggatgcattgttcgcgctttcacttgccaaagaggagaccaagaagctcgggaccgtgatcggaatcgatctacggtaccaactactcctgtgtcggtgtgtacaagaacggtcatgtctcagatcatcgccaatgtaccagggtaaccgtatcacaacctcatgggttgccttcgccgatagcgagaggctcatctggtgaggctgccatgaaccaggacgccgtcaagcctgcagaggaccagcttatgacgccccacgcgtctcatcggaaagaaagttcccgggactaggctagtccggaggggacatggcatactttgcttcccttactagaatttatttaaacaaagggtattgggtcaaggccgctactatttcagggttcaagaaatgcaaaggcatgggtggaagaaacgaaaggttgctttcaggccccctggcagggagtaatccacgtgtgccaattgaaattcctttggggcaaaccattggaaggggaataccctgccttgtaaggttctttcccccttgggggcggaaggaaatgcactcaaanggaattgtgctgtgcccgtcccaacctgggattcccatgggcggtaaccttgtcaaaatcgcaagggcagttcctgtagaggccgagggcctatacccgaaacaggaaacatgcttggggttgggtccaaatgtgccccccggggccattccatattgcgggtggtccatgggggggaggtccacgccccagaatg

SEQ ID NO: 95091 - protein, 178 aa, Zea mays
  misc_feature: Ceres CLONE 1585185
  misc_feature (3)..(3): Xaa is any aa, unknown, or other
  misc_feature (6)..(6): Xaa is any aa, unknown, or other
  misc_feature (22)..(22): Xaa is any aa, unknown, or other
VGXFPXKPDREEQQTRRQSEEXWVQAGAHVGGGRSRTSGSPGLQEFVSPLEKSDRRRLSHPTRQTSASGSKTRIDPRASGRRGARAASRCWCRCRPWIGLADPRSCSESCSEDALFALSLAKEETKKLGTVIGIDLRYQLLLCRCVQERSCLRSSPMYQGNRITTSWVAFADSERLIW

SEQ ID NO: 95092 - DNA, 853 bp, Zea mays
  misc_feature: Ceres CLONE 1585188
  misc_feature (729)..(729): n is a, c, t, g, unknown, or other
  misc_feature (763)..(763): n is a, c, t, g, unknown, or other
  misc_feature (774)..(774): n is a, c, t, g, unknown, or other
  misc_feature (775)..(775): n is a, c, t, g, unknown, or other
  misc_feature (784)..(784): n is a, c, t, g, unknown, or other
  misc_feature (785)..(785): n is a, c, t, g, unknown, or other
  misc_feature (800)..(800): n is a, c, t, g, unknown, or other
  misc_feature (801)..(801): n is a, c, t, g, unknown, or other
  misc_feature (811)..(811): n is a, c, t, g, unknown, or other
  misc_feature (820)..(820): n is a, c, t, g, unknown, or other
  misc_feature (846)..(846): n is a, c, t, g, unknown, or other
ccgctctagaactagtggatcccccgggctgcaggaattcgtctcacccctagaaaaaataatgcctacctttgggtatgcaccgtatgcttcttcttttctttagtctttcgcgtttctatgtaatgttcatcttgctaaattcacatgtgcacctttctattgtcaccaatacttttgtaccatttttctggattaatctactattaaaaatgctaaaatatataacgatccaaaaacgtggtttttttcgttagctagctttgttagtatgctggaaccaaatatttttaggaaactcactttaaatgatggcgtcaaagatatggttaactgctatacattgctattttgttgttgaacttagaacacctggacctcattctattgaaggcgagcatgtgttctaggatgctaacactatgtttaaggggcaataattagcatgctggaacattctatagttggtgcatgtgacaatgttcactgacaaagaaatataggatgcactagaggccaaatatagagtttcttacgctggtaatgagttatatgtcatcaagtagtttcataactagaggccaaatatcgaatgcttgttttaaatctgtgaatcatgtgagccttgacagtgagataaatatttggcattcacatttatatcatataaattttggttatataacatactttagtgggtattaatgtaatcccaaaaaattatttggntcaaagattcccaagtgccatgtacgaagtgcangtcaagtaccnntcgcgaccnntagatttgtcactgnntagaactaantttgttccngatttgtgccgaaatgaatggaccanttgatga

SEQ ID NO: 95093 - DNA, 925 bp, Zea mays
  misc_feature: Ceres CLONE 1585190
  misc_feature: Encodes the peptide sequence at SEQ ID NO. 95094
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (29)..(29): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
nnnnnttttnnnnnnnnnnnntttggggnggtgggggggggnnnaannnnnntnnnnnnccaannnnnaaaaactggagctccccgcggtggcggccgctctagaactagtggatcccccgggctgcaggaattcgtctcacccctagaaaaagcttcgcctacggcatattcccccgaggccccgaaccaaaccaaactaaaccagcccagatcagcgaaacacactccgctctcccgagaccggacacatggcggcggcggcggtgacgtccaacggcggcgcagtggccgcaaatgggccggcgcccggccggctggcctccgtgtacagcgaggtgcagacgaaccggctcctgcacgcccttcccctcccctccgtcctccgctccaacttctcggtcgtcgacggccccgccagctccgccgcgggcaaccccgatgagatcgccaagctcttccccaacctgttcggccagccctcggcgtcgctggtgccgtcggccgagcccgcggcgaccaggccgctcaagatcggcgttgtgctctccggtggacaggcgccgggcggccacaatgtcatctgcggcatctttgactatctacaggagcgtgcaaaaggcagcaccttgtatggatttaagggaggcccagctgggatcatgaagtgcaagtatgtagaactcacttcagactttgtgtatccctacagaaatcaggttggatttgatatgatctgccagggaagggacaagattgaaacacccggagcagttttaagcaagctgaaagacacggccaacaagcttggaatttggatgggacttggttgtcatttggtgggtggaatgattcaaaacacccaatggcctggcctcccctgggggggaataactttttagggttcaaaggaaaacattgaaaaa

SEQ ID NO: 95094 - protein, 216 aa, Zea mays
  misc_feature: Ceres CLONE 1585190
  misc_feature: SWISSPROT Homolog: EC 2.7.1.90 Diphosphate--fructose-6-phosphate 1-phosphotransferase
MAAAAVTSNGGAVAANGPAPGRLASVYSEVQTNRLLHALPLPSVLRSNFSVVDGPASSAAGNPDEIAKLFPNLFGQPSASLVPSAEPAATRPLKIGVVLSGGQAPGGHNVICGIFDYLQERAKGSTLYGFKGGPAGIMKCKYVELTSDFVYPYRNQVGFDMICQGRDKIETPGAVLSKLKDTANKLGIWMGLGCHLVGGMIQNTQWPGLPWGGITF

SEQ ID NO: 95095 - DNA, 1127 bp, Zea mays
  misc_feature: Ceres CLONE 1585192
  misc_feature: Encodes the peptide sequence at SEQ ID NO. 95096
  misc_feature (1)..(1): n is a, c, t, g, unknown, or other
  misc_feature (53)..(53): n is a, c, t, g, unknown, or other
  misc_feature (54)..(54): n is a, c, t, g, unknown, or other
nttttgttttttttttttttgttggttttcggtggtgttttttgcgtttgtgnngcgggggagcagtggtgtagaatgtgactccccgcggtggcggccgctctagaatagtggatcccccgggctgcaggaattcgtctcacccctagaaaaagtgcttctgcttccccaccgagtctcctcaaccccaggcactcgccctctgtcggtctgtcccctcccttcctcgcctccgatgccgccgccgccgccgcttctcgagccgcgcgactacctcggcgccggcgccacctcgtcgtgctgctcgtcgtcctgctcctccggccgcgagggcgcggggccccacctcgcgctgcggctcgggcttccggggtccgacgactcccccggccgcagcgcggacgcggagcacgccggcgcccacgtcgacgccgcgctcaccctcggccccgcccccgcccccgcgcctcccaggggcagcgccaagcgcgggttcgccgactccctcgaccggtccgcgaagcgggacggcgttgccgcggatgacgctgctgggggcgtcacgcgggtagctggaagctgctgccagaagctccgcccgtctgccaagagcacaaagttgtttgtgattgggccggccttgttttatggaagcttacccgggaaagaaaatacccctaaccttgcacatttggccaacaataagaaccaaaaatgtggggggacaaaatgaaaaaggttaagggatagtttgaaagggcgcggggaattggcttggttttagatggtccaaaagggggctccagcgcaatgggtgaatgggggaaggccccccgccttaacaccttaaatgggtaaaagggttgggcaacccctccaaaggaaaccccttgttttccaaatcccctatgtgaagaagactcctccctacgccctcatggtggtccagtggataaaaaaaaaaagtttcccattgttttgcctttctaattccacaatgggtgtcaataaaaacaagtgttcctcttgctcacagatacaaactcataacaatatagggaactaagggccttttaaccttgaataagagaattattaaagaggaccattacattgccccccctttc

SEQ ID NO: 95096 - protein, 165 aa, Zea mays
  misc_feature: Ceres CLONE 1585192
MPPPPPLLEPRDYLGAGATSSCCSSSCSSGREGAGPHLALRLGLPGSDDSPGRSADAEHAGAHVDAALTLGPAPAPAPPRGSAKRGFADSLDRSAKRDGVAADDAAGGVTRVAGSCCQKLRPSAKSTKLFVIGPALFYGSLPGKENTPNLAHLANNKNQKCGGTK

SEQ ID NO: 95097 - DNA, 857 bp, Zea mays
  misc_feature: Ceres CLONE 1585197
  misc_feature (302)..(302): n is a, c, t, g, unknown, or other
  misc_feature (304)..(304): n is a, c, t, g, unknown, or other
  misc_feature (307)..(307): n is a, c, t, g, unknown, or other
  misc_feature (308)..(308): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (384)..(384): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (436)..(436): n is a, c, t, g, unknown, or other
  misc_feature (437)..(437): n is a, c, t, g, unknown, or other
  misc_feature (440)..(440): n is a, c, t, g, unknown, or other
  misc_feature (475)..(475): n is a, c, t, g, unknown, or other
  misc_feature (477)..(477): n is a, c, t, g, unknown, or other
  misc_feature (505)..(505): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (585)..(585): n is a, c, t, g, unknown, or other
  misc_feature (586)..(586): n is a, c, t, g, unknown, or other
  misc_feature (589)..(589): n is a, c, t, g, unknown, or other
  misc_feature (590)..(590): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (611)..(611): n is a, c, t, g, unknown, or other
  misc_feature (612)..(612): n is a, c, t, g, unknown, or other
  misc_feature (615)..(615): n is a, c, t, g, unknown, or other
  misc_feature (617)..(617): n is a, c, t, g, unknown, or other
  misc_feature (620)..(620): n is a, c, t, g, unknown, or other
  misc_feature (621)..(621): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (634)..(634): n is a, c, t, g, unknown, or other
  misc_feature (635)..(635): n is a, c, t, g, unknown, or other
  misc_feature (638)..(638): n is a, c, t, g, unknown, or other
  misc_feature (639)..(639): n is a, c, t, g, unknown, or other
  misc_feature (652)..(652): n is a, c, t, g, unknown, or other
  misc_feature (669)..(669): n is a, c, t, g, unknown, or other
  misc_feature (678)..(678): n is a, c, t, g, unknown, or other
  misc_feature (688)..(688): n is a, c, t, g, unknown, or other
  misc_feature (758)..(758): n is a, c, t, g, unknown, or other
  misc_feature (763)..(763): n is a, c, t, g, unknown, or other
  misc_feature (781)..(781): n is a, c, t, g, unknown, or other
  misc_feature (793)..(793): n is a, c, t, g, unknown, or other
  misc_feature (824)..(824): n is a, c, t, g, unknown, or other
  misc_feature (832)..(832): n is a, c, t, g, unknown, or other
ctcccgcggtggcggccgctctagaactagtggatcccccgggctgcaggaattcgtctcaacccctagaaaaagcattgcattgtgcattgcattgcataaacctctcgtgggaagtgcaaacaccaaatccgcaatctatctatcatcagccattcagcctgcagctgcagctctctccactgcacactagagcgagctgccacagacaaggacacaatgccacccatacccaagaagaggcgaaagcatcctcctgggtccctccctaaaattggtccgcaatgggcggaaggccaacngnccnncgaagggccaggagagagaacccccttttttttaagnnnagggggaaagaaacccgcccgcccccccccccggttnacataaaagaaaagatnnnntttgnnntccaaaagagagagagaggatgcanntgnggttggtgatgaaggcgtaaagagaaaaaaaatananacgttggaaagcaacaaaacaaacaacnagtctnnnacacaacccaacacaaagccgcgcgtccagcttcttctttgtttttgtttgtagaagagtagcggagaccgnnttnncnnnnnaagagagcgagagcnnagncncgnnannnnnnncgcgnnagnngggggcgacgggncgggggcggaaaacacnccgggacgngagtcgacgncggaccgacgccagtaagcatgctcgcatcggtgaagtgtggtggggggtgaaggagaggagggcggagnggtanagtatagtatgtaccaangaacacacaagnatgcgcggccccgcccgtccgcgccgcgcgncgtgccgnctcccctccgcgcgttgtgggcgga

SEQ ID NO: 95098 - DNA, 801 bp, Zea mays
  misc_feature: Ceres CLONE 1585202
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (536)..(536): n is a, c, t, g, unknown, or other
  misc_feature (577)..(577): n is a, c, t, g, unknown, or other
  misc_feature (702)..(702): n is a, c, t, g, unknown, or other
caagctggagctcaccgcggtggcggccgctctagaactagtggatcccccgggctgcaggaattcgtctcacccctagaaaaacgtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctggctctcaggggtccttggggcnnnttcccccccgttttttttaaaggggggggccccccgggcccctccccggaaaaaaaaaaaaccccttggggggcccccggggggggggaaaaaaaaccccccccccggggggacccctaaaagggacccccccccccccctgtgggggggggggggttttaaagtggccctttaaaaaaccccccccccccccagggggggggggggccccccccccccccgggtttttttttgggngggggggggccccaccaaaaaaaataaaaatataaatgaanaatttttaaatttttttttttcctcccccccccaaaaaaaaaaaaaaaagggggggggggggggggggttttttttttttttttttttttttacggccccccccccccccccccccccccgcccnaagggagggagaggggggggggaggaaaagcccccccccgggagaaaccaaaaagagaaaagaggggaggggtgggttttttctctacatccaccaaaa

SEQ ID NO: 95099 - DNA, 1039 bp, Zea mays
  misc_feature: Ceres CLONE 1585205
ggagctccacgcggtggcggccgctctagaactagtggatcccccgggctgcaggaattcgtctcacccctagaaaaatcagtgaaaatgttctgaagaagtttggggaaatgcctgagaaaattgatcattcctctgcttctagggagcaatcatcttcatttacgaaagaggagaaaatggtgcatcctcaaacatctggtgaaacgtaacctcctgtgagagcttgcaatacaagagagtcagataagactgggaggtccacatgcctaccaggaacagtgagctactacccagaaattggggccacacaagggatgctggaacaactcataaaaaagcaggaggaaatggaaaaggaaacgagggaagaaggggctgcagggatagagaaaagaagggcaaaagacataaggaggagaaagagggaagcagtggtaaaggaagagggataaaaaggcacatatgggcaagcaatgtggggaggaaaaaagatacaagagagagaaaaaaacaaatggagaggaagaggggcggtgtaggagggggagaagtgacagacaaatatagggagaaagcggaggtcgaaaaagggctgaggggaagaaaaaagggagggggacgggggtggcagaatgaaggtgggagggaagaggaaggggtgtaaaggagaggaaggagaggtaatatagtggagacaggtagggaggggggtaagtgggagatgggtgagatagacgcaaaggaaaagaagggatactgaaatgagtgtggggatataaagaaaagaagagggggggaataaacaaacaggggggggtaagaaagagggggtggtgagaaaatgaaaacagatacagtgggtgggggaaaacaaaaaaagaagggggggaaagaaacacggggggttggaggaaaaaaaagtggagaaataaataaaggcgggaaaacaaaaccggtgggagagaatataagtggtggggaaaaatagagggttgaaaacagaacgaggaaaaaagtaggtgggggcgaggaaaat

SEQ ID NO: 95100 - DNA, 909 bp, Zea mays
  misc_feature: Ceres CLONE 1585206
  misc_feature: Encodes the peptide sequence at SEQ ID NO. 95101
  misc_feature (741)..(741): n is a, c, t, g, unknown, or other
  misc_feature (742)..(742): n is a, c, t, g, unknown, or other
gagctccccgcggtggcggccgctctagaactagtggatcccccgggctgcaggaattcgtctcacccctagaaaaaagcagctggctcacttctccaggaaagtgttcgtcctcatggcgccgccgcagccgaagtcgggcctcttcgtgggcatcaacaagggccatgtcgtcaccaagcgcgagctgcctctgcgcccgtcccaccgcaaggggaaagcaacgaagagggtgtccatggtcaggggcctgatcagagaggttgctggctttgctccttatgagaagcgtatcaccgagcttctgaaggttggcaaggacaagcgcgctctgaagcttgccaagagaaagcttggaactcacaagagggcaaagaagaagagagaggagatgatgggcgtcctcaggaagatgagatcggctggtacgcacactgacaagaagaaataaagcatttcaagttcatgaatgtggcagccagagattatcaactgtgttttttccctacctctagaaactagacatggcaaagtatttttgaccgaaacattgtttgttagtaatgtattgaaccaacctcgtggtattttgcccccaaccttccaaggcatggaatgaacccggcggttgagcttgaaccggggccgggatggcgggcggaaacaggggcggggtcgctggggggaaaagccccacctggggcccgggggcaacccgtcacccaccgcctcaagggcggnnggcctggctttccctgttggaagggcttccctttttggggcctttccccaaatagaggtggccgcaaaaaacccaaacggaaagggccatggctctcccccccccttcgaaagaaaatctccccataaagactctaattccttgtttccggaagacaaacctttgcg

SEQ ID NO: 95101 - protein, 111 aa, Zea mays
  misc_feature: Ceres CLONE 1585206
  misc_feature (5)..(103): Pfam Name: Ribosomal_L36e Pfam Description: Ribosomal protein L36e
MAPPQPKSGLFVGINKGHVVTKRELPLRPSHRKGKATKRVSMVRGLIREVAGFAPYEKRITELLKVGKDKRALKLAKRKLGTHKRAKKKREEMMGVLRKMRSAGTHTDKKK

SEQ ID NO: 95102 - DNA, 895 bp, Zea mays
  misc_feature: Ceres CLONE 1585207
  misc_feature: Encodes the peptide sequence at SEQ ID NO. 95103
  misc_feature (382)..(382): n is a, c, t, g, unknown, or other
  misc_feature (429)..(429): n is a, c, t, g, unknown, or other
  misc_feature (470)..(470): n is a, c, t, g, unknown, or other
  misc_feature (492)..(492): n is a, c, t, g, unknown, or other
  misc_feature (585)..(585): n is a, c, t, g, unknown, or other
  misc_feature (618)..(618): n is a, c, t, g, unknown, or other
tggagctcaccgcggtggcggccgctctagaactagtggatcccccgggctgcaggaattcgtctcacccctagaaaaaaaacgagaagatcccatccactaccgcccggtcgccgtcctcccttcccgccgcgcccctcctgttccacccgctccgctttgctcgccgcagatcgccctcaggattttattccgccctccgtctccgggctcgcttggatcgagatgggcgtctgcgcgtccaaggccgcctactcctgctgctgctgctgctgctgccgcgagccgcacaacggggttactaacgagaggaccgatgctgtaacggatgacgaggaggcatacgacctgcctgcgttccaggagtttaccttcgagcagntgcggctagctacatcagggtttgcggtggagaacatcgtgtctgancagggtgagaaggctcccaatgtggtatacaagggggaagntccatgcccaggggccgcatcnccgtcaagcgctttcaaccggccttgcctggcccgaccccgcggccacttccgtgggaaaaagctaagatcaagttggccctgctcccgaagncaaaagggttggcaaaaactggccttgggcggnttgcctgcctaacggtgaatggaaaggggttgctttgcttgcagaaaataaaatgcgccaaaggataaggcttccgcaaaaacatcgtttgtccgcgggagaaggcaacattcatgtggaaggggaaccatgataattgaaggggttgttcccctaggccaggcagagggccttaaaatataatggcggcgatcgggggggcggtggcgcccaaaaaataatactaagggcagatagaagatgggtggaagaagaagaaaatacaaacccataacct

SEQ ID NO: 95103 - protein, 134 aa, Zea mays
  misc_feature: Ceres CLONE 1585207
  misc_feature (53)..(53): Xaa is any aa, unknown, or other
  misc_feature (68)..(68): Xaa is any aa, unknown, or other
  misc_feature (82)..(82): Xaa is any aa, unknown, or other
  misc_feature (120)..(120): Xaa is any aa, unknown, or other
MGVCASKAAYSCCCCCCCREPHNGVTNERTDAVTDDEEAYDLPAFQEFTFEQXRLATSGFAVENIVSXQGEKAPNVVYKGEXPCPGAASPSSAFNRPCLARPRGHFRGKKLRSSWPCSRXQKGWQKLALGGLPA

SEQ ID NO: 95104 - DNA, 832 bp, Zea mays
  misc_feature: Ceres CLONE 1585215
  misc_feature: Encodes the peptide sequence at SEQ ID NO. 95105
ctcaccgcggtggcggccgctctagaactagtggatcccccgggctgcaggaattcgtctcacccctagaaaaaattccctctcttcctcccgaaatttcccacctcagactccgagagaagcaaacacaagaagaagaagaaaaaaaaccgtccgcacaaaaaagaaaacggcagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggccctgctcgcggtcgccgccctcacgtgctgcgccgtcgcggagccgccgccgagcgagcggtccgctctgctggcgttcctcaccgcgaccccgcacgagcgccgcctcgggtggaacgcctccaccccggcgtgcggctgggtcggggtcacgtgcgacaacgccaactccaccgtcgtcgaggtgcgcctcccgggcgtgggcctcgtcggcgccatcccgccgggcacgctcggccggctcaccaacctccgcgtgctctcgctccgctccaaccgcgtcctcgggaccgtccccgacgacgtgctccagcttgccagcctcaaggcgctgtttctgcaacagaacctgctctccggccccatcccgacgggaatccagaagctcggcggcctcgagcgcctcgtgctctcccacaacaacctctcgggctccatcccccttcgcgctcaacaagctcacccgcgctgcaagtgctcaagctcgacgggaaaccccctctccggggagcattcccaa

SEQ ID NO: 95105 - protein, 186 aa, Zea mays
  misc_feature: Ceres CLONE 1585215
  misc_feature (29)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAGPSVPAAALAALLAVAALTCCAVAEPPPSERSALLAFLTATPHERRLGWNASTPACGWVGVTCDNANSTVVEVRLPGVGLVGAIPPGTLGRLTNLRVLSLRSNRVLGTVPDDVLQLASLKALFLQQNLLSGPIPTGIQKLGGLERLVLSHNNLSGSIPLRAQQAHPRCKCSSSTGNPLSGEHSQ

SEQ ID NO: 95106 - DNA, 1114 bp, Zea mays
  misc_feature: Ceres CLONE 1585218
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (540)..(540): n is a, c, t, g, unknown, or other
  misc_feature (541)..(541): n is a, c, t, g, unknown, or other
  misc_feature (584)..(584): n is a, c, t, g, unknown, or other
aaaannnnnnnnnaaaaaaaaagtnnnggnnccngaannnggcccgtgtcgaaatgggactccccggtggcgcgctctaaatagggacccccgggctgcagattcgtctcacccctagaaaaactcttggaattggactcaaaagtttcggcggccttctccatgaacacggtggcttcgctgcctttggcgccgcgcctgctcattaagcctccctcgctgcttctccagaaggacgcggcgctatggcgggatcaagtgtacgccgtgctcggggaaaacggggccgagttcgcccggaaacaccacctgggaaggccccgggttgtttagcttatagcccactaaatattagcgaattcctagtaagggggaggggggggtgccatcccaacggaaagataaccagcggtaacctgatcacgaaggcacgcaccaggggggaccggcgggggctcggcctaaaaagaaaaaaatagggacgagaggttcccaccaagttgttgtggaacaagtgtaaagtatggggtttgccccccnncaaaaggcaggggggctgaactccacaaagccgggccaggccnccacatgacccggccgtcccctatacaacaggagggaggggtggagtggaggtgagggggacatacataccataaccaccactacgtccgcagccacacgaagatgaataatggagatagagggcggtgggtatttgggggatgtacacgttgtggtcgcctgtcccggagtgggaaaacaggaagtaagacaccaccccatgcgcgtaccatccggcgagttcagaggagtgtgcagaatatttatatgaaagaattttcaaaccggtgccggcgaggggatacagaccgcgccgcgctcgtaggagaacaacagcctattatcgatatagggaggtgcatgtagagcactcccactcgggcggaaaggtgatccacactcccaccggcggagccggtaggattattcactgaattaccctataatcgcgcaggatggagcttctcaatcttccccctagtgtcttctgtacatccccacggtgaaaatttccctccgtgcacaatatgtgtaacgcagacgactgaaa

SEQ ID NO: 95107 - DNA, 1333 bp, Zea mays
  misc_feature: Ceres CLONE 1585224
  misc_feature: Encodes the peptide sequence at SEQ ID NO. 95108
  misc_feature (70)..(70): n is a, c, t, g, unknown, or other
gctgtggttttcggtacaaaactcctccccttccccactctatactcccgcgggggggcgcgtgcttccnccctcaaactggagctccccgcggtggcggccgctctagaactagtggatcccccgggctgcaggaattcgtctcacccctagaaaaaaggaaacgagcaaaggtctggcgagctacctaccaataaactaccatctccacaaacaggctagcacgtagctatatgccagaactgacctagtagaggatcgatcgcagatggtgtttcctgccatcctccccaagggggccgcacgatggctcttcacgttctaccgcgccgccagaaagctcaggcgccacgccttccagctctactaccgcaacaccgccggccaagccgtcgtcccgccgtctcggagcatgcagggcggggagcgacgcccactgtacacctgccgcccgccgccttttaaaatcgggagccgcctttcccccgaaacccggccggccggaacccttttgtgtgcttaaatggcaacaggtgtccttgagttgctcttccacccgaagctcccttcccccttacttctcaggctccttgggccccttgcacaagggggcgggaaactcctctttacctaccgtccgaaaggcaaacttgcattttgaggccctgtacgcccacttcttattcctggggggcggcttccgcgaggggagaaagagcttcgaggaacggccccgagatcatgtcgcggaggcagtaatggtggggttttaggggatgaaagcagtatactgagagggggtgtggattgttccgatgtctcgcgtggcggcggcgaatattattgcgaaacactcttcatcacagtggcggttgcagacgatgcccaacattgctgtcttgtgtcccctattatcttgacgcgctatattcatgttgtgtggcgaggcacaactttatatagttccgccgtcccccgttcgaacttgttgctcacggtacgcactcttctgtgtaagtggggcagcctctggagtattatgattgaatagctatgagggtgtcgtggctcgcctgcgttcatttcttgcagatgagtgggaccgcggtgcggggaagaacacgatacagacgataggaggtagctttacgattaccgaaacacctggtaggtaagatgtggcactgctagatgtcaatccctctcgttacttaattgccgcaacgcgctgtctcgagcgactctatactgattgaccacgtgttcgatgattagttgggctcgactcactctgcgggggactacaaatctctgaggtgtgcgtggtctcaca

SEQ ID NO: 95108 - protein, 84 aa, Zea mays
  misc_feature: Ceres CLONE 1585224
MVFPAILPKGAARWLFTFYRAARKLRRHAFQLYYRNTAGQAVVPPSRSMQGGERRPLYTCRPPPFKIGSRLSPETRPAGTLLCA

SEQ ID NO: 95109 - DNA, 894 bp, Zea mays
  misc_feature: Ceres CLONE 1585226
  misc_feature (454)..(454): n is a, c, t, g, unknown, or other
  misc_feature (481)..(481): n is a, c, t, g, unknown, or other
  misc_feature (482)..(482): n is a, c, t, g, unknown, or other
  misc_feature (486)..(486): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (530)..(530): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (538)..(538): n is a, c, t, g, unknown, or other
  misc_feature (540)..(540): n is a, c, t, g, unknown, or other
  misc_feature (551)..(551): n is a, c, t, g, unknown, or other
  misc_feature (552)..(552): n is a, c, t, g, unknown, or other
  misc_feature (563)..(563): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (635)..(635): n is a, c, t, g, unknown, or other
  misc_feature (637)..(637): n is a, c, t, g, unknown, or other
  misc_feature (647)..(647): n is a, c, t, g, unknown, or other
  misc_feature (649)..(649): n is a, c, t, g, unknown, or other
  misc_feature (650)..(650): n is a, c, t, g, unknown, or other
  misc_feature (653)..(653): n is a, c, t, g, unknown, or other
  misc_feature (660)..(660): n is a, c, t, g, unknown, or other
  misc_feature (661)..(661): n is a, c, t, g, unknown, or other
  misc_feature (681)..(681): n is a, c, t, g, unknown, or other
  misc_feature (682)..(682): n is a, c, t, g, unknown, or other
  misc_feature (690)..(690): n is a, c, t, g, unknown, or other
  misc_feature (692)..(692): n is a, c, t, g, unknown, or other
  misc_feature (693)..(693): n is a, c, t, g, unknown, or other
  misc_feature (697)..(697): n is a, c, t, g, unknown, or other
  misc_feature (699)..(699): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (765)..(765): n is a, c, t, g, unknown, or other
  misc_feature (768)..(768): n is a, c, t, g, unknown, or other
  misc_feature (774)..(774): n is a, c, t, g, unknown, or other
  misc_feature (782)..(782): n is a, c, t, g, unknown, or other
  misc_feature (792)..(792): n is a, c, t, g, unknown, or other
  misc_feature (805)..(805): n is a, c, t, g, unknown, or other
  misc_feature (807)..(807): n is a, c, t, g, unknown, or other
  misc_feature (822)..(822): n is a, c, t, g, unknown, or other
  misc_feature (823)..(823): n is a, c, t, g, unknown, or other
  misc_feature (833)..(833): n is a, c, t, g, unknown, or other
  misc_feature (834)..(834): n is a, c, t, g, unknown, or other
  misc_feature (838)..(838): n is a, c, t, g, unknown, or other
  misc_feature (850)..(850): n is a, c, t, g, unknown, or other
  misc_feature (851)..(851): n is a, c, t, g, unknown, or other
  misc_feature (863)..(863): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (879)..(879): n is a, c, t, g, unknown, or other
ctggagctccccgcggtggcggccgctctagaactagtggatcccccgggctgcaggaattcgtctcacccctagaaaaacagtttcccactccccctgggtcttccccatcccccctccactccccccctgggttttccccttcctttaccccccatcagatcttcccccatatctctgtcctgcatcactcgccgccatccactcccgatccaaacccgagagctcccacctccgccgccctgttcgctcgtccgccttttcactccccgtagctagctgctgtcgcggagcaaccccgcgattccaagaaaagcaacttggtcaagaaagagtgcaagaaaggaggacggtgctgacgatgatggcgataagccaccccatgattcgccccatcattccgtcgcctccggggcctgcgcgctagctgctagaaggggctcgccgtccgtcntggtggtggtggtgggtggtgtgcccnnggcnggaaaagggaagnnnannnnnnnnnnnnnnnnnnnnnnnnnngngnnngggngnggggggggggnnggggggggggngggggnnnnggggggggggggggnnngggggggggggggnnngggggggggnnngaggggnnnnnggggggngngggggggggngnnggnggggggnngggggggggggggggggggnngggggggngnngggngnggggggggggggggggggggggggggggggggggggggggggggggggggggggnnnggggggggnggngggggngggggggngggggggggnggggggggggggngnggggggggggggggnngggggggggnngggngggggggggggnngggggggggggnggggggggggnnnggnggggggggggggggt

SEQ ID NO: 95110 - DNA, 882 bp, Zea mays
  misc_feature: Ceres CLONE 1585229
  misc_feature: Encodes the peptide sequence at SEQ ID NO. 95111
  misc_feature (621)..(621): n is a, c, t, g, unknown, or other
  misc_feature (780)..(780): n is a, c, t, g, unknown, or other
tggagctccccgcggtggcggccgctctagaactagtggatcccccgggctgcaggaattcgtctcacccctagaaaaaagcggtccctcaaatcctcctcctccttctcctcctaccgcagcccgcagggaggtggagttgtcaacgtgccgaggactggagcggcccgcgtcctctataaacgagacgcccggccatttcctctgctcctctctgttcccccctgcctgcctgcttccagctgcatctctctcctcggtcctcgctcgctcggcttccctctctccgccgagaccgagaggaggcatccctgacgtacggacggcggccatggggacgcaggcgccggagaactaccccgccgagaaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagctcggctggggccctggcatcgcggtgctggtggtgtcgtgggtgatcacgctgtacacgctgtggcagatggtggagatgcacgagatggtccccggggagcngttcgaccgttaccacgagctggggcagcacgcgttcggggaccggctgggcctgtggatcgtggtgccgcagcagctggtcgtccaagtgggcgtggacatcgtgtacatggtgaccggcgcaagtccctgaagaagttcacgacgtgctggtgtgcngcgaacacggggtgttgcaaggggaaagacaacaatcagacacctacttcatcatgaatcttcgcgtcggtcacttcggtcttctggagcttcccaatttat

SEQ ID NO: 95111 - protein, 140 aa, Zea mays
  misc_feature: Ceres CLONE 1585229
  misc_feature (97)..(97): Xaa is any aa, unknown, or other
MGTQAPENYPAEKDARSAREKAIDDWLPITSSRNAKWWYSAFHNVTAMVGAGVLSLPYAMSELGWGPGIAVLVVSWVITLYTLWQMVEMHEMVPGEXFDRYHELGQHAFGDRLGLWIVVPQQLVVQVGVDIVYMVTGASP

SEQ ID NO: 95112 - DNA, 999 bp, Zea mays
  misc_feature: Ceres CLONE 1585232
  misc_feature: Encodes the peptide sequence at SEQ ID NO. 95113
aagctggagctcaccgcggtggcggccgctctagaactagtggatcccccgggctgcaggaattcgtctcacccctagaaaaaggaccgccagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccgggggaggggatccagccgctgtccaagatcgccgtccacgggcccacgtcgaaatgcagccgtcggcgtacgttgcgggggaaaacgtcgcctcctgggggagaggggaaaaacacccagtgggtgaccgtaaaatttccgttgggaaagacccttccgaaagaccccccccccccggggtttttttccccgttgaattcacaccccccggggaaattgtgccaaaccccgggggccgggagaaaaaaccccttttttttgggcaggccccccctaaggttttcgggtttcccacattttttttggggaaatcattttttttggggggggggggggggataaccgggtttggggtttataaaaagggggggtggtgggattttttgtttggggccctttttttaccgggggggggcctttaaaaccccgggggttggtttctcggggttgggagaccaccccttgtttttataaaaacccccagggggggcccttttttttcccccccctttggggaggggggctcccctccccaccaaaaatataagggggagggtggggtgaaggcgtggtgttctccgctttggggggggggggccccctctttttttggggggggggggctctgttgtgtggcccccgcccgcgggggggggccctttttttttttaagggatgtgtgggtggctctccctcactatcgtagaggagacggcgggcgctcacataatatacatttggagtgtgtcctccgggtgggtgttacaac

SEQ ID NO: 95113 - protein, 139 aa, Zea mays
  misc_feature: Ceres CLONE 1585232
MAVALLAALVASAAMFMLAGTASASPGEGIQPLSKIAVHGPTSKCSRRRTLRGKTSPPGGEGKNTQWVTVKFPLGKTLPKDPPPPGFFSPLNSHPPGKLCQTPGAGRKNPFFLGRPPLRFSGFPHFFWGNHFFWGGGGG

SEQ ID NO: 95114 - DNA, 899 bp, Zea mays
  misc_feature: Ceres CLONE 1585237
  misc_feature: Encodes the peptide sequence at SEQ ID NO. 95115
  misc_feature (370)..(370): n is a, c, t, g, unknown, or other
  misc_feature (393)..(393): n is a, c, t, g, unknown, or other
  misc_feature (571)..(571): n is a, c, t, g, unknown, or other
  misc_feature (572)..(572): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (615)..(615): n is a, c, t, g, unknown, or other
  misc_feature (636)..(636): n is a, c, t, g, unknown, or other
  misc_feature (648)..(648): n is a, c, t, g, unknown, or other
  misc_feature (649)..(649): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (688)..(688): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (867)..(867): n is a, c, t, g, unknown, or other
ctggagctccccgcggtggcggccgctctagaactagtggatcccccgggctgcaggaattcgtctcacccctagaaaaagcgttactgtaccaatggctccccacctcctggccgtggccgtggccgtggcggccatcatcgccaccgtctcgttgctggcgcccggcgccgctgcctacccgtggccagtttgtgggacgagcaacgacttcgagcccaacagcacataccaggccaacctcaacctcctcgccgccatgctgcccaacaacgtgtccgcatccccggtcctctacgccaccgccgtcgtcggcgccgtcccggagcaggtctgggggcatgggactctgccgcggcgacgtcaacgnccagcagctgcctcgcctgcctnacaccaggagggttcaggaccctgcccaacgactgctcctacaaaaaagacggcggccatcttattacgaacccctggaccccttccatttatttccaaagtccacaccccttccccaaaaaagaaaacggggccaaagaaaaaaatttgtttaaaaaaaaattaaaaaaaaaaaagnnccccaggttttccttttgggaagnnnaccgcgcccccgcggtngtgtagagccgcccccccctncccccccccctnncccgaacgcccgcnnnnnnnnnncaaaaaaaacgcccgntaaatttacgggggatttnnnnccccggggggggggggcgaagccgatatttttcccgggggtttcctccccagggggggacaccctttgggcgcgagggcacccccaaaacaaaaaaccgcgcgggcaaaaggccccacaaaggcgctcccccccgccccctctaaattaaaaaaacncggggagggggggtgtcacaaaaacaaaatat

SEQ ID NO: 95115 - protein, 154 aa, Zea mays
  misc_feature: Ceres CLONE 1585237
  misc_feature (100)..(100): Xaa is any aa, unknown, or other
MAPHLLAVAVAVAAIIATVSLLAPGAAAYPWPVCGTSNDFEPNSTYQANLNLLAAMLPNNVSASPVLYATAVVGAVPEQVWGHGTLPRRRQRPAAASPAXHQEGSGPCPTTAPTKKTAAILLRTPGPLPFISKVHTPSPKKKTGPKKKICLKKN

SEQ ID NO: 95116 - DNA, 927 bp, Zea mays
  misc_feature: Ceres CLONE 1585239
  misc_feature: Encodes the peptide sequence at SEQ ID NO. 95117
  misc_feature (927)..(927): n is a, c, t, g, unknown, or other
tggagctccccgcggtggcggccgctctagaactagtggatcccccgggctgcaggaattcgtctcacccctagaaaaatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcacccaccctcactggaaagactatcaccctcgaggtggagtcttctgacaccatcgacaacgtcaaggccaagatccaggacaaggagggcatccctccggaccagcagcggctcatttttgctgggaagcagctcgaggacgggcgcacgcttggccaacttcaacatttcgaaaggagagcccccctccactttgtggttgcgtctcaggggcggcaatgccgaatatttgttgaaaactcttaactgggcaagaactatcaccccttgagggtcgagttcttcctggataccatcgaccaatgttcaaggcccaagaatcccggaacaagggagggggatccccttccggaacagacaaggggttttatttttttgccggcaagcacgctctgagggacggggggcccccctgggccaaatatcaaacatttctgaagggagagggcccccccccccttgggggctgccccctccaggggtggggccttgcaaaactttctcggaagaacacctttcttgggaaagaaaatn

SEQ ID NO: 95117 - protein, 96 aa, Zea mays
  misc_feature: Ceres CLONE 1585239
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQIFVTHPHWKDYHPRGGVF

SEQ ID NO: 95118 - DNA, 822 bp, Zea mays
  misc_feature: Ceres CLONE 1585241
tccccgcggtggcggccgctctagaactagtggatcccccgggctgcaggaattcgtctcacccctagaaaaacccgcggcctgcgcgcgcgttctctccctcacctccgcccctctctccctctctctcgctccgggcgacggctgggcgaccgccgctttatccgtgcggcccttccttttgttctcccgtcacccaaaccccccttcgagctctatctgtctcttctctcgaggcgacgcctgggctaccgcgccgctactgcgcctcccgcgacagtgctagtctcatcagtgccatgtctcttcggctctcacggcgactgcctgcagctctgcatgttacacccagtccttactgggcccgcgccgccctacgtacttcgtagtttagatgtttgttagtttgtattctaggttctggaggaagctagatctcagagggggaaatttgggggtaatttcctgaaatttcaggaaaccagggccttgaaggtttttctggaggggttttggggcccccccccaaaatttagggttggggggaccccgtttacccccaaaggggggaaaagaactgggggtccaaaggaaagggccctttttaacacccggagaatttctctcaaagccccccccttttggaggggggggaaaaagggggaaccttttctaaaaactggggggttgggggagagggggtaatttttttttgcgcacttttctcctccaaggggtttttcccaaaaaatgggtttttttccccccccccggggggaaacctctctttcccccgggttttttttgaagcaggggttcttt

SEQ ID NO: 95119 - DNA, 889 bp, Zea mays
  misc_feature: Ceres CLONE 1585242
  misc_feature: Encodes the peptide sequence at SEQ ID NO. 95120
ggagctccccgcggtggcggccgctctagaactagtggatcccccgggctgcaggaattcgtctcacccctagaaaaatcgcctttgcccgcacacacggctcccattccatttccgctgcttgacgcgcacccacaccaccacagcacgcgacgcgagaccgaatccatccgtccgacgccgcctcgcctccctcagccctccgcagctcggcctctgcttgcgttgcgttgcgttgcgtgtgtatgtagtggccgcaacacaaaatcaagagacgtgatatatgcgacccccaacagccaacgaccggcctccaagcggtgggggtggagcagcagcagctggtgcagcagcaggggacgacgacttcgccttctactactcctacctccaggacgccgacgccgccgccgcctcagcgacgtcgacgctcgccctcgccgtcgacgaccccaaccccagcgccgcagggatgacgaacggccggcgccggaagcagcgcgggggcagaggacgccggagcccccagggaaggtgaggaggcggccaaaaagggacggaagaagcggtccatcgccaagctgctcacctccctggcggggctgggaggcggaggagcacccggaccgcggggggcgccgcggacccgtccaggcgggagctgggggctgctcaaggtccaaggccgaacacccggttcggggggcaccatgggatacctaccccaggaggggagagcagctttcgacgccccccgccgaggtccgagggccgcgcccggggcccaagcgtgccaggctcgccgggggcggcccgccaccggggccctttttggcccgggggaggagggggttagggggggggggttcccccttccgggggggggctt

SEQ ID NO: 95120 - protein, 84 aa, Zea mays
  misc_feature: Ceres CLONE 1585242
MRPPTANDRPPSGGGGAAAAGAAAGDDDFAFYYSYLQDADAAAASATSTLALAVDDPNPSAAGMTNGRRRKQRGGRGRRSPQGR

SEQ ID NO: 95121 - DNA, 941 bp, Zea mays
  misc_feature: Ceres CLONE 1585245
  misc_feature: Encodes the peptide sequence at SEQ ID NO. 95122
acccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcgggcgacccccgacaagtacaagagcttcatcgctttctgttcgtgctggcttggccaccaaagcggggggcaacagcagccggatccccgtgctggtcgacaaagacgacccgctcccgctcggaatcgtttctaaacatcacttctggtgaacaaggcaggggcgctcccttaagcttgaaaaagggatgtttcccgaaccctactttgggggctaaaataaccaggggcagcccctcggggcctccttaaaaaaaatagggcccccaatttttttctgtgggggaattttgttaccaagggggggccccgggggaaaaaaaatttcggtctccttttggtcaaccgaacccggggttcctttccaagggggaaggaaaccttttctttttcccgggaaaagggaaagggaaagaaatcttggggcccccgtttttgcccgggcaaaaatttttaaaaaaggccttctctcgcgggggttcgtgtccccccgggggacccccctcaaaggaaagatttgggggggggcgcccccccctccaaaaagtgggggggggggcgggcgatattctcctttctttgtgggtaagaagacccccgcttttt

SEQ ID NO: 95122 - protein, 89 aa, Zea mays
  misc_feature: Ceres CLONE 1585245
MALPCFLGSSATSASIWKCGCSSSDTESRLHKIELQHRFGRPPTSTRASSLSVRAGLATKAGGNSSRIPVLVDKDDPLPLGIVSKHHFW

SEQ ID NO: 95123 - DNA, 883 bp, Zea mays
  misc_feature: Ceres CLONE 1585246
  misc_feature: Translation starting site: 339
  misc_feature (389)..(389): n is a, c, t, g, unknown, or other
  misc_feature (493)..(493): n is a, c, t, g, unknown, or other
  misc_feature (494)..(494): n is a, c, t, g, unknown, or other
  misc_feature (503)..(503): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
ctccccgcggtggcggccgctctagaactagtggatcccccgggctgcaggaattcgtctcacccctagaaaacactccctcgtccagagtccagacccagaaggagagggagacagaggagaggagcagcgtggcgacgcccaaatcgagagacttgatcgagtcccctcgccgcaactcgctgaatcacaatccgagcccgccaattgggcgccccgcccacgccaaggacagagggaagaaaactgttggcgcgctgacaagtccaactgtgtttttcttggactacagatgaagcgagctcgaaggcgtatgtgcaagagatgactgatgagggatgctagtgacattgatgaacttgttacgggcgtgctggcgaccgtcatcnaaccggcatgcccgaacaggctcagatgttaccggtaggcaggatggacttctatggtacaaggatgccgggcagcatgtcaacggggagtttttccatggctnngtgtcaggncaatnnnactacttgaggaccagtgtcagatggagtcgggcccactgagttttctagattcccggacatatgggcactttttgtggggtttacaatgggacatggtggtcccgagacgggctgctaatatcatgatcctctctttcaggaacctgaaaaaggtttgcttcttaacagaatacaaggtctgctgaagtaccgaagaaaggcgtttgaagcttccgaaaaaggggttctttttcggtggtaacccaacaaggggccggtaaacccccaaatagaactgttcggcttatgctgcccgggggggggggaaaattgggggggggagtctttttggttgcccaagggtggggggaactcccggggggttttttagg

SEQ ID NO: 95124 - DNA, 998 bp, Zea mays
  misc_feature: Ceres CLONE 1585247
  misc_feature (412)..(412): n is a, c, t, g, unknown, or other
  misc_feature (417)..(417): n is a, c, t, g, unknown, or other
  misc_feature (983)..(983): n is a, c, t, g, unknown, or other
ctggagctccccgcggtggcggccgctctagaactagtggatcccccgggctgcaggaattcgtctcacccctagaaaaaggggcatgggattgacccacacacccgccctccgccccgcaagccaaatacgccgtggcacgcgtcgccatgccgccccagttccccaccgcccgcctcctcctccctagtcacaggctgctcccgctcctctcccctctcccctccgcgtccctgtcccctgctcctcgcaccctccgcctcccgccgccgcagcttcttcaccgagtcgcccgccgccgcccgctgctgcgcggcatggcctccgccgccgcccccgggtcacacgccgccgcggaagcgccccccgtcgacgtgggggggaggggggctcttttccccccccggggggntcgtncttggaggagctaccccggggaccatttcgttcgtccccgaggctgcctgggcgacccgccgatgggacactaatcccgaccggagaggcctggcacccccgggtacatccaagggatgtttttccctcctgggcaaagtgggacaaacccccgaacctcgggtagccgtgggccaaatatccggatgggcccggaccaatttctggatctggggattcctacaaagaggtcttggagaggcgccggggaatttccccctcccgttgttttctttcggggaggtgaacgttctccttagatggggggaggattggcccctttgcactccaggggcctaagaggaaggagagccggttgagggttatattagagcctggcctctttatgggggaaaaggaaaaaggaattaactcttttggaagaggggtggaaactctgtcagggggaagagcaatagagaattgcctggagaagggttgttggaataaggctccgatccgagggatcgtttttaagggcattgtttgcccagcctcggggtgatcgggaaagtttgattagacgngagtcgtgttgtttt

SEQ ID NO: 95125 - DNA, 847 bp, Zea mays
  misc_feature: Ceres CLONE 1585248
  misc_feature: Encodes the peptide sequence at SEQ ID NO. 95126
ctccccgcggtggcggccgctctagaactagtggatcccccgggctgcaggaattcgtctcacccctagaaaaagtatcgcctttgcccgcacacacggctcccattccatttccgctgcttgacgcgcacccacaccaccacagcacgcgacgcgagaccgaatccatccgtccgacgccgcctcgcctccctcagccctccgcagctcggcctctgcttgcgttgcgttgcgttgcgtgtgtatgtagtggccgcaacacaaaatcaagagacgtgatatatgcgacccccaacagccaacgaccggcctccaagcggtgggggtggagcagcagcagctggtgcagcagcaggggacgacgacttcgccttctactactcctacctccaggacgccgacgccgccgccgcctcagcgacgtcgacgctcgccctcgccgtcgacgaccccaaccccagcgccgcagggatgacgaacggccggcgccggaagcagcgcggggcagaggacgccggagccgccagggaaggtgaggaggcggccaagaaggacggcaagaagcgggtcatcgccaagctgctcacctcgctggcggcgctggaggcggaggagcacgccgaccgcgcgggcgccgcggacgcgtccaggcgggagctggcgctgctcgagtcaacgccaacaccgctcgcagggcacatggactactacgcccagatggagagcagcttcgacgcccccgtcgagtcggaggccgccgccaggtcaagcgctcagggctcgccgcgtcggccgccacgcgggcgttttgggccgggaggaggcttcacggggggggtcccctcca

SEQ ID NO: 95126 - protein, 188 aa, Zea mays
  misc_feature: Ceres CLONE 1585248
MRPPTANDRPPSGGGGAAAAGAAAGDDDFAFYYSYLQDADAAAASATSTLALAVDDPNPSAAGMTNGRRRKQRGAEDAGAAREGEEAAKKDGKKRVIAKLLTSLAALEAEEHADRAGAADASRRELALLESTPTPLAGHMDYYAQMESSFDAPVESEAAARSSAQGSPRRPPRGRFGPGGGFTGGVPS

SEQ ID NO: 95127 - DNA, 947 bp, Zea mays
  misc_feature: Ceres CLONE 1585249
  misc_feature: Encodes the peptide sequence at SEQ ID NO. 95128
  misc_feature (400)..(400): n is a, c, t, g, unknown, or other
aaagctggagctccccgcggtggcggccgctctagaactagtggatcccccgggctgcaggaattcgtctcacccctagaaaaactcttgcaagcacaactgcacaagggaacaggaggaaaaaagagcgagaactcgcagctgacgcgcacacggcaagccccaatcggagccgcggaccggatcagaactaggtctcgaggcgatggcaagcggaggcgagggcgcagggagcggcgaatcccctcccgccgcctcagtggaggcggcagcggtcgaggcgacgctgcacatccggtgcgcgaacggctccaagttcacggtgcagacggacctgtgcgccacggtgggcgcgttcaaggaggtcttatccggtagctgcggcgtgccagcaccccancagcgcctgatctacaagggccgcatcctcaaggacgagcaaaccctagacagctatggcgttgagaaggatcacacaattcacttgggggcgaggtgtcgccccaccaagctgcatccagtgcaacctgctgctggccacccgccttacttcgtttactccctagaagggggccctggcaggtgggcctggggagggtctattttcccggtggttgaatgcccccaggattttcccgaaaattaggagcaagtttgagccaacattttaaagcccggaattccccaaccttggttgaagggaaagaaaatggaaaattcccgggcaaatggcaaaaattctcatggaaaaaccccctgaattttaataccgcgaaataggattcctgggggcacccccccaagggggcccgaatatcaagggattccgaaatacccgaatctttgccccggggggcttcaaaagagcccaaggggttcttcctgccgaaaacgcctggagagcgggtaagggaaaccctggaatatcttgaggaagaaggtggggg

SEQ ID NO: 95128 - protein, 146 aa, Zea mays
  misc_feature: Ceres CLONE 1585249
  misc_feature (31)..(99): Pfam Name: ubiquitin Pfam Description: Ubiquitin family
  misc_feature (65)..(65): Xaa is any aa, unknown, or other
MASGGEGAGSGESPPAASVEAAAVEATLHIRCANGSKFTVQTDLCATVGAFKEVLSGSCGVPAPXQRLIYKGRILKDEQTLDSYGVEKDHTIHLGARCRPTKLHPVQPAAGHPPYFVYSLEGGPGRWAWGGSIFPVVECPQDFPEN

SEQ ID NO: 95129 - DNA, 864 bp, Zea mays
  misc_feature: Ceres CLONE 1585250
  misc_feature: Encodes the peptide sequence at SEQ ID NO. 95130
  misc_feature (520)..(520): n is a, c, t, g, unknown, or other
  misc_feature (665)..(665): n is a, c, t, g, unknown, or other
gagctccccgcggtggcggccgctctagaactagtggatcccccgggctgcaggaattcgtctcacccctagaaaaaagctcaactctgcagtctagctacacacaatagagcgcagccgcggcgtgatatggttctatgatggttctttgctgttggctagatatatatgctgctagctactaggtgcgtcatccccttgctatgcgcgggttaagtatatatacacagtatataaaaagtatataaagtcttgctgctggcttgagctccttggatacacctatctgcttctgctagctttctttacagagacgacaggatagctagagccgagggagagatcagggtcgacgatagatgggggtgcatggggctgttgccaaacgaccctgcagcaggcagcatctcctcctcctcgtcgtcgctattctcataggtagctacttcgccgccgccgccgccgccgctgcggacgagcagaaaagcaggaatagaggagctggtcgtcgcagccccangaagcgggccgcggcggcagtgacgtcgccgcctgcgcccctcatggtgcctatcaccatcctcgagtccgccgtcgacttgggagccgtgtgcatggacggaacaccggcttgctaccacctgcacccgggctccggagcaggnaacaacagctggatcgtcaacctggaggaaggcggctggtgcaacaacgtgagggcgtgccagttcctcaagggagccggcgcggctcttcggacctgatggaaaaagagatccccttctcgggatatgagcagcacccttgtcgacaccctgatttcacaactggaccggggtgaagatcgctctgggaagggccgtc

SEQ ID NO: 95130 - protein, 134 aa, Zea mays
  misc_feature: Ceres CLONE 1585250
  misc_feature (54)..(54): Xaa is any aa, unknown, or other
MGVHGAVAKRPCSRQHLLLLVVAILIGSYFAAAAAAAADEQKSRNRGAGRRSPXKRAAAAVTSPPAPLMVPITILESAVDLGAVCMDGTPACYHLHPGSGAGNNSWIVNLEEGGWCNNVRACQFLKGAGAALRT

SEQ ID NO: 95131 - DNA, 774 bp, Zea mays
  misc_feature: Ceres CLONE 1585251
  misc_feature: Encodes the peptide sequence at SEQ ID NO. 95132
  misc_feature (251)..(251): n is a, c, t, g, unknown, or other
  misc_feature (402)..(402): n is a, c, t, g, unknown, or other
ctggagctccccgcggtggcggccgctctagaactagtggatcccccgggctgcaggaattcgtctcacccctagaaaaagtacttgcctactggtaaaggtcccgacgacgcggtatcgccgtatacccgcctcaagtacaaagggaaagctgcgactcgctcggaagtgggaaccttcagttgaggttctctaatcgggcccgctaaagtcgagagacaggttttcgcgaacatttgcatctagccatnctctactcaactgaattcttgtgctcttgtggcattcacaaagtccattttcagactgagctagttcagctgtcatttttttttcagcaaaagtcgccgtccttttggacctgctcttgattcggttcgttccgtccggtttgggattganttgattggattggatttccttttaaatttccctttacccacccccctggctccggtaaaggggggcccttggtcttttggccatttgggggaatcccctttttgtccttttttttgggggtttgtggggccctcccgcccccctgggatcccctttcccccggcttttttggaaaaaagaagggttccacttggggaattttttaattttcccccgggggcgttttttgggggggggggggggggggggggggggccctctgggggggggcgcccccccccttcctcgaaagaaaaatcccccccccccccacaaagagagaaaaaccccccccgggagggggggggcggggcccccccctctctttttttc

SEQ ID NO: 95132 - protein, 31 aa, Zea mays
  misc_feature: Ceres CLONE 1585251
GAPRGGGRSRTSGSPGLQEFVSPLEKVLAYW

SEQ ID NO: 95133 - DNA, 1272 bp, Zea mays
  misc_feature: Ceres CLONE 1585252
  misc_feature: Encodes the peptide sequence at SEQ ID NO. 95134
  misc_feature (59)..(59): n is a, c, t, g, unknown, or other
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (785)..(785): n is a, c, t, g, unknown, or other
ccccgttgagctttcgtgttatatatagctatgctaattatttttcgtaaaaaacaaanngnnnnnannnacaaagctggagctccccgcggtggcggccgctctagaatagtggatcccccgggctgcaggaattcgtctcacccctagaaaaccctagctccaaccaccatgaagggcaaggccaacgcctccaagaaggatgaggccaggctcctggccggcggcagcagcgccggaaagcgcaagaaggccgccgcgagcggcaagcccaagcgccctccctccgccttcttcgtcttcatgtctgaattcaggcaggagtaccaggcgcagcaccctgtcaacaagagcgttgcggccctgagcaacgcagcagaggaaaagtggcactctatgatagagcaagagaagaaaccctatgtggaccaacctgggcacaagaagcacgactataacaagactaaggtgccccccccaacaaggagagcacaagctcaaagaaggctaaaactgatgacgacgatgggctccaagtccaaaggtccatgaataaggatggggtgcacgtgaacgaggataaccgacccaccgaccgaataaaataagcattttcccgcctggctgctgaggggaacacaaaataccaaattggttaaggtgtcccccagaaataaactcttccccctggggatattgccctgttccattaaaaaattggtttagaagatatagtgtttcgggaaaaaccaaggggttgtctttatcaaagaaaaaaagcgggnggaatccccttacgctcaagagttttatccccctccaagaaagggggtgatgggatttaatgaaatttataaggggggtggcactttctagggggcgcacaacctggagactcagaaggccgccacgaaaagaggcattaatctctgaggcgcccatactatatataggttcggacacttctattatcccttttattccgagataaaatacgacctctatgggctgggacacacagaacacggttttgctctcggcgggacgcaaggtgattcgcaaatagaaaactttattgtcgtagaatagagagacttgtcttccgcggctcatttggctgagttttaaagaaaaaagaaaacctctaagaccgcgttctagtgtctacccgatagatagcggcatcacctcgtaccgcatctcccatgccaatacactccggagtgcgcgcgacgagagagaacgagactcgcggtctcgccacaaacgaga

SEQ ID NO: 95134 - protein, 126 aa, Zea mays
  misc_feature: Ceres CLONE 1585252
  misc_feature (34)..(99): Pfam Name: HMG_box Pfam Description: HMG (high mobility group) box
MKGKANASKKDEARLLAGGSSAGKRKKAAASGKPKRPPSAFFVFMSEFRQEYQAQHPVNKSVAALSNAAEEKWHSMIEQEKKPYVDQPGHKKHDYNKTKVPPPTRRAQAQRRLKLMTTMGSKSKGP

SEQ ID NO: 95135 - DNA, 1146 bp, Zea mays
  misc_feature: Ceres CLONE 1585254
  misc_feature: Encodes the peptide sequence at SEQ ID NO. 95136
  misc_feature (69)..(69): n is a, c, t, g, unknown, or other
  misc_feature (70)..(70): n is a, c, t, g, unknown, or other
ggtaggcgggtgagatgggtgttttctggggaagtccggagagcggggggggcgtggtaattacggggnnccttcaaagctggagctccccgcggtggcggccgctctagaactagtggatcccccgggctgcaggaattcgtctcacccctagaaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggccaccacagccgaacaggaggccgcccctgtgacgatcgaggacgtggacctcagctctcatcaagccgcggccgacgacggggagctcgccgcgcggtggcgggaggtccacggcaaccaacaactggggaggggtctgctggaaccccattcgacggcggtgcctcctccaaggagcctcatcccgcttaagggcgaagtcccgcccaaggccccacctaacgaacaggtttttcgacgttactgaccgggctttcctcccccgctttaatggcggggacgaacctttccgaaaagttaccgcccgggccgcaaagaaaccctgttcattacccacccgaaccggtccgggaactaccggggtcggagaatccggggtctaaacaaaaggggtcccccccgtcttaataccttcttaatggccacaccctgggtaagaagatagccttccaagatttgtcgcccaaacttttccggggacaccctcaaagaacgggggccgggctgataaagcgcataaataattgagtgggaaggcgtgagaatcccgtggacacaggaatttcttgcactggggtaaacgatttggggccccatttctttctcccacacgaaataataagagaacacacggtgatgtgcggtatttgattacacccttcgggaggtaaat

SEQ ID NO: 95136 - protein, 128 aa, Zea mays
  misc_feature: Ceres CLONE 1585254
MAATVSSCLSLVPTVHHRAGGFPSSVALTNTLQRRRRSRRYLVVASATTAEQEAAPVTIEDVDLSSHQAAADDGELAARWREVHGNQQLGRGLLEPHSTAVPPPRSLIPLKGEVPPKAPPNEQVFRRY

SEQ ID NO: 95137 - DNA, 867 bp, Zea mays
  misc_feature: Ceres CLONE 1585255
  misc_feature: Encodes the peptide sequence at SEQ ID NO. 95138
  misc_feature (802)..(802): n is a, c, t, g, unknown, or other
  misc_feature (836)..(836): n is a, c, t, g, unknown, or other
  misc_feature (855)..(855): n is a, c, t, g, unknown, or other
  misc_feature (863)..(863): n is a, c, t, g, unknown, or other
ctccccgcggtggcggccgctctagaactagtggatcccccgggctgcaggaattcgtctcacccctagaaaaagcccgccaccaagctcgaccgaccgatgatcctcagccgcctgcatgtccgcgtcacccgccgatcccccgcgtccgccgccctccgcgatgcggcaacgcgcgccttggcctccgcgggcctcttccgtggcctccacggcggcgcggcgggggacggcgcttcctccgagcacggccgcgaacccgcaggaagctggtgagccaagggaagctcacgcatgatagttaccaggaaaatgtagcttccgaattagacaacctacttagtaggcttcaacggtacgagatggaaatggaggattatcatgacaagctgtacttctgggagaatagcagggagaaagagcggcgcaggcttcttgtcgaagaagctgaagataagcagcgtggtggtgtatggattgatgagaagaaggggatttcttgacaagttggttgcacggagaagaagaggaagcatagaacctggagttggtaagtgggtctcgtacctgaaccgagagaagaaactagatacattggtaggccatagaccagtcgctcctgttgctcctaagggattgtatctctatggaaatgttggaagtgggaaagacatgttgatggacatgttctatggggccactgaaggtgtcatcaaacacaggaggagggttcactttcatgaggccatgcttgaaatacatgatcatatgcatgatgtatggaagagacgtgatgatgacnaatctatttcactcagtgctttcaggtggatatncagccttccctttgaccgnaaatttanggag

SEQ ID NO: 95138 - protein, 162 aa, Zea mays
  misc_feature: Ceres CLONE 1585255
  misc_feature (141)..(141): Xaa is any aa, unknown, or other
  misc_feature (152)..(152): Xaa is any aa, unknown, or other
  misc_feature (161)..(161): Xaa is any aa, unknown, or other
MTSCTSGRIAGRKSGAGFLSKKLKISSVVVYGLMRRRGFLDKLVARRRRGSIEPGVGKWVSYLNREKKLDTLVGHRPVAPVAPKGLYLYGNVGSGKDMLMDMFYGATEGVIKHRRRVHFHEAMLEIHDHMHDVWKRRDDDXSISLSAFRWIXSLPFDRKFXE

SEQ ID NO: 95139 - DNA, 952 bp, Zea mays
  misc_feature: Ceres CLONE 1585257
  misc_feature: Encodes the peptide sequence at SEQ ID NO. 95140
  misc_feature (399)..(399): n is a, c, t, g, unknown, or other
  misc_feature (952)..(952): n is a, c, t, g, unknown, or other
aaaaagctggagctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcnatccaccaccagtggatatgattattatctatctaccttgtgggggggggttgaaacaaaataaacaagggccgaactggctgccaaacaaaaggaattgtgtgggtgtgtgtcaaaaaaaaaaaaaaaacaaaggtccttgaggttggctatcccccctcctgccgtggttgggcgtcaggtcctttggggccccaggggcgaaccgggggggtccccccgggccgggtgggtgttaaccccaatatgggctctggccttgagaccctaaaataaaaagtggggccccccaacgaaacccattttcgaacccctgataatgcgcccaaaaaaaaaaaaaaaaaaagaattcttcctttatgtggggggggcccgccccccccccccttttgggggaccaaaaaatgggtggaaaaacgggtggtgggggcccccacccccggttggtgggtaggggaagacggagaagagacccccgccttctcccaggccctaagaaaaatggcgcgccgcccccggaggaaagaagagtggattataaacgggcggcgcn

SEQ ID NO: 95140 - protein, 76 aa, Zea mays; identical to SEQ ID NO: 8464
  misc_feature: Ceres CLONE 1585257
  misc_feature (1)..(76): Pfam Name: Metallothio_2 Pfam Description: Metallothionein

SEQ ID NO: 95141 - DNA, 1262 bp, Zea mays
  misc_feature: Ceres CLONE 1585260
  misc_feature: Pfam Name: DUF26 Pfam Description: Domain of unknown function DUF26
  misc_feature (62)..(62): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (781)..(781): n is a, c, t, g, unknown, or other
  misc_feature (786)..(786): n is a, c, t, g, unknown, or other
  misc_feature (948)..(948): n is a, c, t, g, unknown, or other
accttactttaccgctacgatctcgccgctttttgacgttcttcctctgttctatcatactngtgggggnnntccaaagctggactccccgcggtggcggccgctctagaatagtggatcccccgggctgcaggaattcgtctcacccctagaaaaagcgttactgtaccaatggctccccacctcctggacgtggccgtggccgtggcggccatcatcgccaccgtctcgttgctggcgcccggcgccgctgcctacccatggccagtttgtgggacgagcaacgacttctagcccaacagcacataccaggccaacctcaacctcctcgccgccatgctgcccaacaacgtgtccgcatccccggtcctctacgccaccgccgtcgtcggcgccgtcccggagcaggtctggggcatgggactctgccgcggcgacgccaaacgccagcagctgcctcgcctgcctcacccacccgttccaggacctgcccaacgactgctcctacaacaaggacgccgccatctactacgaacccctgcacccctccactaactccgaacgtccacacccttcgcccgacgacgacatccggtccccaacgaaccattgttcttaccaaccattaaacaacaaacccccaaacgttctactcttcggaacccgggccccgggtatttaaagatgcctttcctttggaccggtccccttcgaattaaactcccccacctcagcagaagagcacgccccccggcgggttctcgtaagcctccctcaacgngccgntgtcggaaaatttcaccctcccccccccgagggggggtaaatgggccctctctaataaagataccctcgaaaatcttatctgcgaaacacaggcggcgataagatttttcgccactcgcaacggggagtaggatttaaccccttcgaccgctgagggacgcnctataaataggaagcatcgcttccccgcgttgaatatccagagaaaagacgccacagcggttcgctatcaagggctcctctcaaagaagcggtgctcttttcgaagctcggcgcgctcctattggattctcccctatattatcctcattggagagaccccgggcgttatctcaggataacaacaatctatatcatcagaagagtcaagagggggagcgctttctgaggagatgacagcgcatgtgccctctgctggtgcgcggagagatagagagaacacctcctcccctctattctttccacatgggtgagac

SEQ ID NO: 95142 - DNA, 912 bp, Zea mays
  misc_feature: Ceres CLONE 1585262
  misc_feature: Encodes the peptide sequence at SEQ ID NO. 95143
aaagctggagctccccgcggtggcggccgctctagaactagtggatcccccgggctgcaggaattcgtctcacccctagaaaaatgtttatgctaccatattttttagacgtttttattttctagcttttctttaaacttgcactgtaccatctatttttcagattttgcaatataattatcattgaagattcatgtagttctcttataatgctatataattagcacaatacagtgcactcactttattatttcctgatgaaaagtgagtgatatagccaccttatttggaggtttttacacaagatagcatgtaactgaaatactaagatagtatgaatcaataaatgcacatactgaattggcttcgttgtttaggtttggctacaaatggataactcatcaaatctcctgagacagtacttcagcaacttgcacgatcaactgagtacacgtcctttttccacagtcaggttgcaaagaaatggcttgatttttagaatgagacggcatgggcaatatggtgaagcggatattaactccatggtcgttgcgagttgcatcactaccagggacaacaaaggggtacagaaacaccatgagaatagctacactggaagagatcctgcacaaacttctggggagcatcagtacactccccctaagggcagacaaagtcaatgggaatcgagggtggacaaatgtgccaagccaggttatggcctccccctttgcaccaactgcagcagcgcctacttcgccccccccaccccccatgcctggggagtggccaagcaaaaccaagaactttctggggagttatggcgtcccgtgccttgcctttcaacaatttgggggggggttcccgcctataaattacccgtgaagaaatttgaaaaacatagatctttcg

SEQ ID NO: 95143 - protein, 174 aa, Zea mays
  misc_feature: Ceres CLONE 1585262
MDNSSNLLRQYFSNLHDQLSTRPFSTVRLQRNGLIFRMRRHGQYGEADINSMVVASCITTRDNKGVQKHHENSYTGRDPAQTSGEHQYTPPKGRQSQWESRVDKCAKPGYGLPLCTNCSSAYFAPPTPHAWGVAKQNQELSGELWRPVPCLSTIWGGVPAYKLPVKKFEKHRSF

SEQ ID NO: 95144 - DNA, 874 bp, Zea mays
  misc_feature: Ceres CLONE 1585263
  misc_feature: Encodes the peptide sequence at SEQ ID NO. 95145
  misc_feature (395)..(395): n is a, c, t, g, unknown, or other
  misc_feature (615)..(615): n is a, c, t, g, unknown, or other
  misc_feature (700)..(700): n is a, c, t, g, unknown, or other
  misc_feature (701)..(701): n is a, c, t, g, unknown, or other
  misc_feature (703)..(703): n is a, c, t, g, unknown, or other
  misc_feature (712)..(712): n is a, c, t, g, unknown, or other
ctggagctccccgcggtggcggccgctctagaactagtggatcccccgggctgcaggaattcgtctcacccctagaaaaagtgctcgtgcagctctaggctttttttgaggaagcggtaagcgcggagggaggacgggagagagagataggcgtgccttcgtcgtccgtgccggtgcgtggcgtggtggccgtgccgaccgtccgtccaccccctctcctcttcccggcgccggcgacagcgggagggactccctgggaggaatggccgtggtgagggctccgctcggcgcggtggcggtggccgctctcgtcgtcgccatcttcatgccggccgccgcagcggcgcaggcaccggcgcccgcgcccaccagcgacggcacatcaatcgacctgnggatcgcgtacatccttatgctggtggccctggtgctcacctacctgatccacccgctggacgcgtcctccccctacaagctcttttaatctctgctccttttcgtttggtcatgcggttatgggtgctataggaattttaggtgcgcgagatgtttaggtgaggttgggaggtttagaatggatgatgattgcaatcatttgatcctggtatgtatccnaggctccaaggcgttgggggttctgattggtttgtaattggatcggattccattatccttgtgctccgtccctgatttgctcccnngnaaaaagagnggagcgcagaggggaaagattcttcatttctccgaatctcgattcctggtttacccgattaccccggcggttgcgggccctttctcccgtttccaccttgggggtgcccccttttctttttcctgtgggcgggggttgggccccctgttcccccccgtggag

SEQ ID NO: 95145 - protein, 73 aa, Zea mays
  misc_feature: Ceres CLONE 1585263
  misc_feature (9)..(62): Pfam Name: DUF1070 Pfam Description: Protein of unknown function (DUF1070)
  misc_feature (45)..(45): Xaa is any aa, unknown, or other
MAVVRAPLGAVAVAALVVAIFMPAAAAAQAPAPAPTSDGTSIDLXIAYILMLVALVLTYLIHPLDASSPYKLF

SEQ ID NO: 95146 - DNA, 885 bp, Zea mays
  misc_feature: Ceres CLONE 1585264
  misc_feature: Encodes the peptide sequence at SEQ ID NO. 95147
ctggagctccccgcggtggcggccgctctagaactagtggatcccccgggctgcaggaattcgtctcacccctagaaaaaggtccccaccaggcaatcaagaacaccacctaccgctgacttgtcaattcctgtctgtgcgcgcgcgcgcgtggcgccggccgagcggccgttgacccgatgaccggcgcggcggccgtcgatcccccggtgcctcggccgcggcggctcacggtcctcccgctcatcgcgctcatcttctacgacgtctcgggaggccccttcggcatcgaggactcggtccgcacgggcggcggcgcgctgctcccgatccttggcttcatcgtcctcccagtcctctggtcgctcccggaggcgctggtcacggccgagctcccatcggctttccccaccaacgccgggtacgtggcctgggtgtccgccgccttcggccccgccgtggcgttcctcgtcgggttctccaagtgggcgtcggggacgctcgacaacgcgctctacccggtgctgttcctcgactacctccgctccggcggcgggctggcgctgccgccgccggcccgctcgctggcgggtctcgcgctcacggccgcgcttcactacctcaactaccgggggctccacatcggcggcctctcggcgctggcgctcaccgggttctcgctctccccgttccttggggctcaccgtgctcgcggccccccaagatccgcccgttcccgctgggttcgccatcggacccccggccccgtcgaacctagggggcttcttcacctcccatgttctgggaacctcactttcggggacaagggccagcacgcttccccgggcagaggtccaaggacccccagaaaggaacttccccccg

SEQ ID NO: 95147 - protein, 235 aa, Zea mays
  misc_feature: Ceres CLONE 1585264
MTGAAAVDPPVPRPRRLTVLPLIALIFYDVSGGPFGIEDSVRTGGGALLPILGFIVLPVLWSLPEALVTAELPSAFPTNAGYVAWVSAAFGPAVAFLVGFSKWASGTLDNALYPVLFLDYLRSGGGLALPPPARSLAGLALTAALHYLNYRGLHIGGLSALALTGFSLSPFLGAHRARGPPRSARSRWVRHRTPGPVEPRGLLHLPCSGNLTFGDKGQHASPGRGPRTPRKELPP

SEQ ID NO: 95148 - DNA, 932 bp, Zea mays
  misc_feature: Ceres CLONE 1585265
  misc_feature: Encodes the peptide sequence at SEQ ID NO. 95149
aaagctggagctccccgcggtggcggccgctctagaactagtggatcccccgggctgcaggaattcgtctcacccctagaaaaagacgggcgagagagcggaagcgacgactagctctgcggcctctgccccaagcgccgacgatgggtgccggtgctactgccagggacgaggaggctgctaccggccaccaccatgggaggaagccgcatggcgcagcggcggagtacgcgcaggacgggtccgtggacctgcgcggcaaccccgtgctccgctcccagcgcggcggctggaccgcctgctccttcatcgtcgtgtacgagctgttcgagcggatggcctactacgggatctcgtccaacctcatcatctacctgacggacaagctccaccagggcaccgcccacgcctccaacaacgtcaccaactggtccggcaccgtcttcctcacgccgctgctcggcgcctacgtcgccgacgcctacctcggccgctactggaccttcgtcgtcggctccgccatttacctgctggggatggggctgctggtgctgtccgtctcggggccggcgctgaaacccgccgccttgcggcgccggcggcgtgtgccccccaggcgtccgcgctgcaactcggggcgtacttccggggggctcaacatcggggcccggggcaacgggggcaccaagccccacaatctcccccatcgggggcggaccaattccaccaaagttctaccccgggggaaggggaactcccaaagctgtcccttcttccacctggggggaatgttccaccatccttccctgggggattcctctttttccctccacacgtccggcggaataacctgggagagaaaaccgtggggccgggttcccgggaggcctacggagaatcccctcaccccttggggctcttttgggcctccc

SEQ ID NO: 95149 - protein, 263 aa, Zea mays
  misc_feature: Ceres CLONE 1585265
MGAGATARDEEAATGHHHGRKPHGAAAEYAQDGSVDLRGNPVLRSQRGGWTACSFIVVYELFERMAYYGISSNLIIYLTDKLHQGTAHASNNVTNWSGTVFLTPLLGAYVADAYLGRYWTFVVGSAIYLLGMGLLVLSVSGPALKPAALRRRRRVPPRRPRCNSGRTSGGLNIGARGNGGTKPHNLPHRGRTNSTKVLPRGKGNSQSCPFFHLGGMFHHPSLGDSSFSLHTSGGITWERKPWGRVPGRPTENPLTPWGSFGPP

SEQ ID NO: 95150 - DNA, 991 bp, Zea mays
  misc_feature: Ceres CLONE 1585271
  misc_feature: Encodes the peptide sequence at SEQ ID NO. 95151
ctccccgcggtggcggccgctctagaactagtggatcccccgggctgcaggaattcgtctcacccctagaaaaaaacaaaatcccctcgccgcatctccccttcctgttcccgtgttccgtcccttcccctccctgctcgacctctcggctctcgcgtcccgacgtcgcctcaatctcgaagcctctccggcgcagccgccgcaatctcgactccaaggcctctccgaccaaaattcatctagggttttcgcttcgtccgtcgcgatgggctccaagaagcggtcggcccagcatcccgcgtccccagcgggcggagaggtcggtgctcaggcggcggggaaagccacgccggtgacggcggcgccggaaacgggccccggggcggtggcccccaccccccccgacggggcgcctttcctgaaaaagggtcacaacatggtcttccaaaccgggccccggaggcgggtaatttccctgaaaccccgggggggggcaactttctgtgaatgggggaacccccccttttttttgagggcggaactggttttcccggaaactttttagagaacaaaccccttttcacccgggttttaaatagcgcccagttcttaaaaccccgggggggatttttcaaaaaaagggtttacccccccaaaaacaatggggggaaatgggcccccaaaaaagagggtttgtttttttgaggggggccaaaaaaaagttctttttgagaaaaccctcccccccagaaaaaagaaaaaaacccccccccagggggttctcttcgggggtatctcggggtggggggctcgtgaaaaaaaggccccccgcgggcgtgtagaagttccccggaagaaaaaaaaattgggcggcctctcaaaagggggcggcgaagctcttaggagggggggaggctcctggtaaaggggattgttgtttttatggggggcccgcaccacccctttcggggggggcggaatacgcacccct

SEQ ID NO: 95151 - protein, 99 aa, Zea mays
  misc_feature: Ceres CLONE 1585271
MGSKKRSAQHPASPAGGEVGAQAAGKATPVTAAPETGPGAVAPTPPDGAPFLKKGHNMVFQTGPRRRVISLKPRGGATFCEWGNPPFFLRAELVFPETF

SEQ ID NO: 95152 - DNA, 851 bp, Zea mays
  misc_feature: Ceres CLONE 1585277
  misc_feature: Encodes the peptide sequence at SEQ ID NO. 95153
ctccccgcggtggcggccgctctagactagtggatcccccgggctgcaggaattcgtctcacccctagaaaaatcagaccgccagcagtcgccagcccagcaaggcagagcagcgagcggctatgggaagagaggcgccggcgatggcggtagcgctgctggcggcgctagtcgcttcccggccatgttggcggggaccgcgagcgcgtcccggcggaggggatcagccgctgtccagatcgccgtcacagggccacgtcgaatgcagccgtcggcgtacgtgcgggcgacacgtcgctccttgcgagcagggaaagaccccggtgggtaacgggaaatttcgcttgaaaaacctttccaagaaaattggatcggcctctttcccccttgaaattaaactgggggtaattttccaaccctttggcccgaaaaaaactttttttggggggcccccttagaattaaatttccccaattttttgggagaaaaattttttggggggagggggggaaacgggggggggtttaaaaaaaggggggcccaatttttttttccccccttttgggggggggccaaaaaaaaaagatttttttttgggggggcccccccctcttttttaaaaaaccccgggggggtgtttttttccctcgggggggggggggggccccccccccaaaacaaatggggggggggggtcccccccccccccccccccacaaaaaaagccaccctttttttttgggggggggtgttttcttgggggggggggggggggaaaaaaaaaccggccccggggggggggttttttttttgaaccggggggggggggggggccccccccccggggtgga

SEQ ID NO: 95153 - protein, 48 aa, Zea mays
  misc_feature: Ceres CLONE 1585277
MLAGTASASRRRGSAAVQIAVTGPRRMQPSAYVRATRRSLRAGKDPGG

SEQ ID NO: 95154 - DNA, 894 bp, Zea mays
  misc_feature: Ceres CLONE 1585279
tggagctccccgcggtggcggccgctctagaactagtggatcccccgggctgcaggaattcgtctcacccctagaaaaacttttcccaacctcccatcccataccaccccccttcatgtcgtcgccttcctccccgcgcacttgcccctgcatctctccgctgcccaccactccctcgcattaacgacgaaggctcatcatctctgatggaggtaacagtcggctaacacaccgccccgccccgcccctgttgtctgtcccttcattttctagcttagaagagtattcttgttccggtttcttcgttccgtcgagcgcggcattctgtgggtcgtgtggattttggcccgggggacgaggaggaggctggtcaaagatctgtgctcaaaaattgatggtggggttcatggaatgggtgcatgactggttgctgtgggacgccttcctggagtgcggagggatcatgaggccaccgattagatagcggctggggagcgaggggacacaggaggcggaggccgccggttagaccccccacaacccgcggcgggaggaagcagccatgggggaagacctcgtcaccaccctgtccatggaaaaaggcggcggggggcggcgggggccaacaagggcccctgaacgttccttttccagtggacccgttcgggcaactttttcgggccggaaaaacgcccctctcggggtttatggggcaaacccttatcggaagggggggggtcggcccaggccccccacccccaaccggtggtgcccctttcggggggccttcccccccaaaataaaaaaggggggggggaggacaaacccgtgggaaaggtggggaagtgggggtatcgggcgggagaggataaagcggcgggagaggtttgtttg

SEQ ID NO: 95155 - DNA, 890 bp, Zea mays
  misc_feature: Ceres CLONE 1585280
  misc_feature: Encodes the peptide sequence at SEQ ID NO. 95156
  misc_feature (715)..(715): n is a, c, t, g, unknown, or other
  misc_feature (755)..(755): n is a, c, t, g, unknown, or other
  misc_feature (763)..(763): n is a, c, t, g, unknown, or other
  misc_feature (821)..(821): n is a, c, t, g, unknown, or other
ggagctccccgcggtggcggccgctctagaactagtggatcccccgggctgcaggaattcgtctcacccctagaaaaagggcgctgcagtagcgcagcgcagccacgccgcggcaacagcaacaccgcaccatggcgcttcttcttcatccccgcctcccgtcccatcctttccgcgcggcagcccaccaccaccacgccatctcggacgcctcttgcttccttaccctccacggccccggaaggaagcgccgcatgctgctcgcggcggtcacgtgccgcgcagccagggtcaaggagcccgctccgagcgcaggcgcctcgcctccgccgccgccacaggcgctgacgaaggaggcgcacaagtacttcgaccacgccgtggtcaccgtccgcgcgggcgacggcgggcacggcgccgtgctcgccatgccgccggcgccctccgcggacgccgccaagccccgcggcaggttcaaccggggcgagaagaagagcaagaaggtgtcgtacaagcgcaactacgacgggtccgtggcgctgccgacgggcgggcacggcggcgacgttgtggtgtacgccgacgaggccgaggagacgctgctgcggttccacgagaaggcgcggtactgcgccaaacggggagggaacgtgggcgccgctggcggcacgctcagctcgcggatgcacagcgggttcgccggggagacgctcangatacccgtgcctgtaggaactgttgtgaaacgcaagaanggggctgntctggcggaattggctcatcactgtgatgaagtgctcgttgctagaggtggacagggncgaaatcagcttgatgatgtgcctgagtacaggaggaggaaaagcatggctttatccccaccatcatgc

SEQ ID NO: 95156 - protein, 212 aa, Zea mays
  misc_feature: Ceres CLONE 1585280
  misc_feature (38)..(204): Pfam Name: GTP1_OBG Pfam Description: GTP1/OBG
  misc_feature (154)..(154): Xaa is any aa, unknown, or other
  misc_feature (167)..(167): Xaa is any aa, unknown, or other
  misc_feature (170)..(170): Xaa is any aa, unknown, or other
MLLAAVTCRAARVKEPAPSAGASPPPPPQALTKEAHKYFDHAVVTVRAGDGGHGAVLAMPPAPSADAAKPRGRFNRGEKKSKKVSYKRNYDGSVALPTGGHGGDVVVYADEAEETLLRFHEKARYCAKRGGNVGAAGGTLSSRMHSGFAGETLXIPVPVGTVVKRKXGAXLAELAHHCDEVLVARGGQGRNQLDDVPEYRRRKSMALSPPSC

SEQ ID NO: 95157 - DNA, 900 bp, Zea mays
  misc_feature: Ceres CLONE 1585286
  misc_feature: Encodes the peptide sequence at SEQ ID NO. 95158
  misc_feature (401)..(401): n is a, c, t, g, unknown, or other
aagctggagctccccgcggtggcggccgctctagaactagtggatcccccgggctgcaggaattcgtctcacccctagaaaaagctccctagtggtcctccctcccccaccactgcagctccgtcccggcggccccaagagttgcggcgaggatgaacgtgaagggcggcagccggattccggtaccccctccgggggccagcgcgctggtcaaggtggccgtgttcggcggcgccgccgtgtacgctgccatgaacagcctctacaacgtcgagggtgggcaccgcgccatcgtcttcaaccgcatccaggggatcaaggacaaggtataccccgaagggactcactttatgattccatggtttgaacgaccaatcatttatgatgtccgtgctcgaccnaatcttgttgagagtacttctgggagtcgggatcttcagatggtgaaaattggtctccgtgtcctttacaggcctatgccagagaggctaccacatatctacagaactctgggaagagacttcaatgagagagttttgcctcaatcatccatgaaacactgaaagctgttgttgctcaatataatgctagtcagctgatccccccaagagaactgtgagtaggggaattaggaaatactgatctggaggggtagattcttcaacatggcctttgagaacttcccctcaaaacctgagtttttggaaggggttttctttttcttttaaaccaaacagtttcttccacgaaaactgaacggtctaattcctttttcaaaaacttaaaaaaataaaaaagggcatttttggggctcgggaggggtaaaaggcggggtttttttgttcaccttttaaaaaaccctctcttttttccctggggaaataaaactccccgggaacc

SEQ ID NO: 95158 - protein, 136 aa, Zea mays
  misc_feature: Ceres CLONE 1585286
MNVKGGSRIPVPPPGASALVKVAVFGGAAVYAAMNSLYNVEGGHRAIVFNRIQGIKDKVYPEGTHFMIPWFERPIIYDVRARPNLVESTSGSRDLQMVKIGLRVLYRPMPERLPHIYRTLGRDFNERVLPQSSMKH

SEQ ID NO: 95159 - DNA, 897 bp, Zea mays
  misc_feature: Ceres CLONE 1585289
  misc_feature: Encodes the peptide sequence at SEQ ID NO. 95160
ctccccgcggtggcggccgctctagaactagtggatcccccgggctgcaggaattcgtctcacccctagaaaaagagcgtctgagctcgccaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgcccccgcacggcaacttcgggcgggtgcacgcggcgcgggacctgcgcacgggccgcagcgtcgcggtcaaggtggtggccaaggacaagctggagcgcgcgggcatggcggagcagatcaagcgggagatcgccgtcatgaaagatgggtgtcccaccccaacatcgtggagctgcacgaggtgatggccacccgctccaagatctaccctcgcgctcgagctcgtccgcggcggggagctcttctcccgcatcgcgcgcccggggggggtccgggaggacctgggcgccctgttactttccgcggctcgttccccccggtcaacttctgccacggcccgcggggtggttccaccgagaactgaaagctcgagaaacctggctccttgacgagggtaggcgaccttcaaaggggcgcggactttggggctacaggggcgcctccccggggcaccccccccctccaaacgggcttgttccacatacggcctgggggggcaa

SEQ ID NO: 95160 - protein, 83 aa, Zea mays
  misc_feature: Ceres CLONE 1585289
  misc_feature: SWISSPROT Homolog: EC 2.7.11.1 Non-specific serine/threonine protein kinase
MEDAMAADGKSVLQGRYELGRVPPHGNFGRVHAARDLRTGRSVAVKVVAKDKLERAGMAEQIKREIAVMKDGCPTPTSWSCTR

SEQ ID NO: 95161 - DNA, 1044 bp, Zea mays
  misc_feature: Ceres CLONE 1585291
tggagctccccgcggtggcggccgctctagaactagtggatcccccgggctgcaggaattcgtctcacccctagaaaaagaccgacgacgtggtgagctgttcttccttccttccgcgcgcgcgcacaccctctctctctctgctgtgcccgcggctattaagcccgttctggatgagtccgtgagggaggacgaccaggagagccggggtcatcggatcgctgccgagggttctccgtttgtgcgacacaaaggaggaggtggtggtgacggtgtcagtgcgtgcgtgcgtgcgtgccaatggcgccgtcgtggtgggggcgggacccgagggccaacggcttctttgggggcggcacccccctggtgggcaggatggagaacctcaacccccccatctccaaagtctccccccgcggcctcggaaggtggaggcgccgcccggccgggggggggcaaaggccgggttggcggggcaaagaaacccccccccaaatccacgtgggggtggctgctcctccagggggggactcgcctcccccggggcccgcccttcagggggggggggggcctttcgaccttgcgttttttttcctggggcaggccgtctctctcataaccaaaaggggggggggggcgggggggggccccggggatctgaatatttctcgaacgtgcccagaaggcgcctaaagcgctccgccccccgcggggtgcaaaaaagagagccgggggctctttcttgggggggtgttcttctttcaagaggggggggggacgcgggccctttcttccctctggcccccttctgaatgagggggggtgtctctctcgaggacgaaggggtggcgggacctctcctctccggggggggggggccccccccaaggtgtggggagtgggggcctcccggagatctcccgccttttgagagggcttctcttttgcccgcgccgtctagagggggccgggaaagagcggtccccgcttcgagagaatcgagagcgcgtcgtttgggtttgttacacaaagacgcgggttatt

SEQ ID NO: 95162 - DNA, 1112 bp, Zea mays
  misc_feature: Ceres CLONE 1585303
  misc_feature: Encodes the peptide sequence at SEQ ID NO. 95163
  misc_feature (861)..(861): n is a, c, t, g, unknown, or other
  misc_feature (1036)..(1036): n is a, c, t, g, unknown, or other
  misc_feature (1060)..(1060): n is a, c, t, g, unknown, or other
  misc_feature (1106)..(1106): n is a, c, t, g, unknown, or other
tccccgcggtggcggccgctctagaactagtggatcccccgggctgcaggaattcgtctcaccccctagaaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctcccgccgagcgagcgggagcagatgcggaaggggcactacaagcagacagtggacccggaagagaggccccgcctccccgagggccagaagggggaaattcgcaagggtcaattccatgaaaaccctcggagagaagggccggcgatgtgtttttttttctccccccccttgtgtgccggccgcaggggcccactcacccgcccctacgacagaaaaggtcatagggttgggggggggaaaggtgcaagggccagccccaacaaaaacagcccccctcagtggtttattcaagggcatacagaagggcatttggagagacgcgccctctccttcgttaaacacggtggccccccccgccgccagaaaaacgatggcctcccacccacacagggactgtctgcccctcgcacaccaggtagggagagtgccctatgcgggacgagaaggggagccctctatctcgcaccaacgctacggctttctgggttagggacggcgtgaggggcgcggactgcgcacatgaaaatgttgattcttgcgggggagaggcgccgctgctcggacactcggtgagctccgtggagcgcagcggggcaaagagatgtcctgggtcgcgagcgcggtcatctntgggtgagagaagggacaggacggacgatgtactcgacttcgacggcgccgacggatgtttgatggagaagacggcgcgaggggcgggagcgtgtctgccgtacagtacacacgtatagtgaagtaggaccgaccgctggacgacaggcgacgctgtcgaggtggtggctgtgangtcggatactacagcagcgtgggngtagcacttcgtcgatctttgtagtagatacagtcacccaacgcanacaccg

SEQ ID NO: 95163 - protein, 169 aa, Zea mays
  misc_feature: Ceres CLONE 1585303
MSLPPSEREQMRKGHYKQTVDPEERPRLPEGQKGEIRKGQFHENPRREGPAMCFFFSPPLCAGRRGPLTRPYDRKGHRVGGGKGARASPNKNSPPQWFIQGHTEGHLERRALSFVKHGGPPRRQKNDGLPPTQGLSAPRTPGRESALCGTRRGALYLAPTLRLSGLGTA

SEQ ID NO: 95164 - DNA, 856 bp, Zea mays
  misc_feature: Ceres CLONE 1585307
  misc_feature: Encodes the peptide sequence at SEQ ID NO. 95165
  misc_feature (393)..(393): n is a, c, t, g, unknown, or other
  misc_feature (678)..(678): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (699)..(699): n is a, c, t, g, unknown, or other
  misc_feature (700)..(700): n is a, c, t, g, unknown, or other
  misc_feature (712)..(712): n is a, c, t, g, unknown, or other
ggagctccccgcggtggcggccgctctagaactagtggatcccccgggctgcaggaattcgtctcacccctagaaaaaacccatccattccacctccgttcaccccgtccatttgatttgcgttcactgcgttgcgtttcccttggaggggattgttctctcctctccttttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggctgaaaaaccttggaaagggtatgctgcagccccaccanatcattgccgagtacaacaatgcgatccctgaggctgagcgcgagaagctcaaggatggtgccttttgaggatgtcctgagggcagctcacgaggcgattgtcatccccccctggggttgcacttgccatccgccctaggcctggggtttttgggaagttgtttgtggggggcacacccccctgagactccctgtttatagagactaaaaatttcttcgaataactcgcgttcaagaagaaacctttgttgttggagaaggggccccaccacactatttatttgnctttgnnnnngcggatttagnnagagtagcaggnccttttccccccccttttttttttaaaaactcattgggaaaaggggggggggtttcttcccacaggggcctggggctaaaaaagttttccgaaaagagggaagggaggaaccccttggtaaatatttttttggcccaaataaaa

SEQ ID NO: 95165 - protein, 72 aa, Zea mays
  misc_feature: Ceres CLONE 1585307
  misc_feature: SWISSPROT Homolog: EC 2.4.1.13 Sucrose synthase
  misc_feature (50)..(50): Xaa is any aa, unknown, or other
MGEGAGDRVLSRLHSVRERIGDSLSAHPNELVAVFTRLKNLGKGMLQPHXIIAEYNNAIPEAEREKLKDGAF

SEQ ID NO: 95166 - DNA, 918 bp, Zea mays
  misc_feature: Ceres CLONE 1585308
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (691)..(691): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (789)..(789): n is a, c, t, g, unknown, or other
  misc_feature (810)..(810): n is a, c, t, g, unknown, or other
  misc_feature (843)..(843): n is a, c, t, g, unknown, or other
  misc_feature (870)..(870): n is a, c, t, g, unknown, or other
  misc_feature (890)..(890): n is a, c, t, g, unknown, or other
  misc_feature (891)..(891): n is a, c, t, g, unknown, or other
  misc_feature (897)..(897): n is a, c, t, g, unknown, or other
ctggagctccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggcctttttccctttcccggggtttgggccgggcggtggcgccccgcccgccctgccccgaactttcccctggcaggtccggggtggaaacccttccaaagagttaccgttgggccccccccttccgggggtataccccaacttaaaccccttcaattcaaggggccccaccgggggggggggggggtacccccttggggggcccacacacattttccccccccgggggtttaatatacacgcnnnnnccccctttgggggtgttttttgggcgggggccccccccccaaaaaaattggggggggggggaaaaagcctttctctaaaaaccccccccaaaaaaaaaaaaaaaaaaattttgttgttggggccccccaacaaaaaatttttttttttttggggggggggggggggggggggggnccccccagcacaagaagaagaaagccccccccccccccccccgggggggggggggagggttttggtttttccttcccgggnnnnggggggcgcgcccncccccttctttttttttttanacaaaaaaagaaaagggggcgccctcggttttnttataaaaaaaaaaaaataattatatntggggggggggggggggggnncgccgncccccgcggtggtcggccgcc

SEQ ID NO: 95167 - DNA, 890 bp, Zea mays
  misc_feature: Ceres CLONE 1585311
  misc_feature: Encodes the peptide sequence at SEQ ID NO. 95168
  misc_feature (397)..(397): n is a, c, t, g, unknown, or other
  misc_feature (400)..(400): n is a, c, t, g, unknown, or other
  misc_feature (682)..(682): n is a, c, t, g, unknown, or other
  misc_feature (697)..(697): n is a, c, t, g, unknown, or other
ctggagctccccgcggtggcggccgctctagaactagtggatcccccgggctgcaggaattcgtctcacccctagaaaaaatccagttctcctttcgccggaatctgtccctcctccccctcctccccgcctctgcgggtactggaccaccgtggagcgggcattcatccaggctaggtccattccttcctttgctcgtaagtgaccctgatttttgctctacgagtttgtttcgtgctccattgaatctaaatcccactccgcatttgcggattcatgccctactactattacaacccctttcatccatccattcctcgactaggttctcttctccatcgcggaagctccacccgagttgacgccagaagagaatcggtgccctagggtgcccccncanaattattttccagaagatttgcagatcgagtcgaaccctatgccccacgttaagcctgccgccggcctgcccccttaccaccaccgggcgctccctggccccgggcagggtccagttcccacgggacatgggatgatgcaccgggaggtccgtgatcagtacgggccgctggggccgaggatgcacctaccaccgctggggcacgggcccgctccgttcccctacgacatgctgcctccgctgcccccaccggaggtcctggagcagaagcttgtggcacancacggggagatgcanaagctggttatagagaaacgccggcttgctgcaagccacgcctcgctgaggaaaagcatagcccggccaacaagagctgcatagcctgcagggcccagggggaggccgcccaaaaccccttaagaaggaggaatatgaggggccttccttaacaaggtttgggaaaaatggaaggcccaaactttaaaggcca

SEQ ID NO: 95168 - protein, 113 aa, Zea mays
  misc_feature: Ceres CLONE 1585311
  misc_feature (81)..(81): Xaa is any aa, unknown, or other
  misc_feature (86)..(86): Xaa is any aa, unknown, or other
MPHVKPAAGLPPYHHRALPGPGQGPVPTGHGMMHREVRDQYGPLGPRMHLPPLGHGPAPFPYDMLPPLPPPEVLEQKLVAXHGEMXKLVIEKRRLAASHASLRKSIARPTRAA

SEQ ID NO: 95169 - DNA, 854 bp, Zea mays
  misc_feature: Ceres CLONE 1585313
  misc_feature: Encodes the peptide sequence at SEQ ID NO. 95170
  misc_feature (767)..(767): n is a, c, t, g, unknown, or other
  misc_feature (785)..(785): n is a, c, t, g, unknown, or other
ctccccgcggtggcggccgctctagaactagtggatcccccgggctgcaggaattcgtctcacccctagaaaaaaacctcgtgttcgttcggagcgcacgcacacacaaccagatctcccccaaatgcacccgtcagcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgccaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcaccctcgaggtggagtcttcagacaccatcgacaacgtcaaggccaagatccaggacaaggagggcattcccccagaacagcagcggctcatctttgctggaaagcagcttgaggacggncgcacgctgggcgactancacatccagaaggagagcaccctccacttggggctgcgcctcaggggaggcatgcagatcttcgtgaaa

SEQ ID NO: 95170 - protein, 234 aa, Zea mays
  misc_feature: Ceres CLONE 1585313
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(226): Pfam Name: ubiquitin Pfam Description: Ubiquitin family
  misc_feature (211)..(211): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFAKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPEQQRLIFAGKQLEDGRTLGDXHIQKESTLHLGLRLRGGMQIFVK

SEQ ID NO: 95171 - DNA, 970 bp, Zea mays
  misc_feature: Ceres CLONE 1585314
aaagctggagctccccgcggtggcggccgctctagaactagtggatcccccgggctgcaggaattcgtctcacccctagaaaaaatattgaggctccgacccaccgctgagcgagggttatgatcgaccaggatctctaagttcacatggagtggacatcgccccgcagtgtatggagatattgctggatatgggtatcctccttacgaggtatattctccggttacttccccagttccgacagttgatggtcagatgtttagcgcacagcattaccagtatccattcacgtattcgcgccctcctacgccaattctcttgtacgactaaaggcaacctgcagtcttctaacaatcaagaaaagtcagcacctaaaccacatcctgccaatgcaaccgctaaaagtcttccgaatggtactgggcacgctcacagtaacagtggaactgccccgaacaaacaagatgagcactgacgcctgatggaacttatagcgctccattgctaagtggaattccttctgcctttttacctagacacgaaattgttggggtataacgcccccatgcggacaatttatcatggaaacatgggatctgcttgttgccatttgataccaaaagaacaaaccgcgattgatcgttggtacattcctacgtcaattcaattggtaaccgcttcctccgggcattaatcccctatccttagacttccccggcgtcaaaaaaattgggttttcccaaattttaaaaaccctcccaacctaactggagggggcacctaacctaattcgcagatgggacttcaccctagagcccccctccctagagaagccccttttgggggacaacgatttaataaagcttggttgaacccctataccagaagacaaggttttaaaaaaacggcggccacaaattggggtcgaataatgtgacacctcgcagaaaaattgttgggttataagaaa

SEQ ID NO: 95172 - DNA, 860 bp, Zea mays
  misc_feature: Ceres CLONE 1585319
  misc_feature: Encodes the peptide sequence at SEQ ID NO. 95173
  misc_feature (529)..(529): n is a, c, t, g, unknown, or other
ctggagctccccgcggtggcggccgctctagaactagtggatcccccgggctgcaggaattcgtctcacccctagaaaaaatgcgacggtgaaatcccgcacctacctccttcctctctctccgaggaccctcgcaccaagaactgagcgggaagagaggtagagaggcaagcgcacgagagtttctgctcctctctcgcctcgcctccgtctcctttcctctctggttctctctctgcgattctcgtcgcattggttccgttccctcacgaaaggcggtagctttctgtcttccctgatctatctagataatggcgaccacgacgtcagcgaccaccgccgccgcagcagccgccaccaccgccaagccgcgggggtcgtcgtcggccctctgccacacggtggccggcggcggcaggcggcgctccggggtggtgcggtgcgacgcccccggcgtggaggcccaggcgcaggccgtggcaaaggctgccagcgtcgccgccctcgagcagttcaagatatcggccgnaccggtacatgaaggaaaggagtaccatagctgtgataggcctcagtgtacacccgcaccagtggagatgcctgaaaaacttgctgttgcaaaggaactggggccccgtgctattaaggactccctggcctggaccttttggagagggtggcggtcttagaccccgaaatgaaagggaaatttttgtggggggccctttcaggggaacccgggttttctaaaaaaggttgggcttggggttttaaaaaaaaaagtgatttccccctttccaaaaattggggggagcccctttttttttttgtcgaaaaaattttttcgcccccaccccctt

SEQ ID NO: 95173 - protein, 125 aa, Zea mays
  misc_feature: Ceres CLONE 1585319
  misc_feature: SWISSPROT Homolog: EC 1.2.1.70 Glutamyl-tRNA reductase
  misc_feature (73)..(73): Xaa is any aa, unknown, or other
MATTTSATTAAAAAATTAKPRGSSSALCHTVAGGGRRRSGVVRCDAPGVEAQAQAVAKAASVAALEQFKISAXPVHEGKEYHSCDRPQCTPAPVEMPEKLAVAKELGPRAIKDSLAWTFWRGWRS

SEQ ID NO: 95174 - DNA, 916 bp, Zea mays
  misc_feature: Ceres CLONE 1585321
  misc_feature: Translation starting site: 222
ctggagctccccgcggtggcggccgctctagaactagtggatcccccgggctgcaggaattcgtctcacccctagaaaaactccttcctggacaaaatcatcagctcccgaaatccaaattgaaacagttgcaggcgattctgagctcgggttttgttccggggacggattcctgtgccggcggacgggatgtcaggccctctcgaccgatttgctaggccatgcttaagggtttgtacataacgatgaaaggaaagagagcagatctgatgcagacaactcagaaggagataagaagactaagattgggtctttcaagaaaaaagcaattaatgcggggaaacaattcaggcattccttgagaaggagaagcaaaaaaagacctgaaggggggattccatcaagggacatagggacgttaaagaggcttcagatgttgagacattccgacaatgctttaattgatgaggatttgctggcacaccgccccatgatttatccctggatgtaaagttcctaaagccccggaaattttgagtttgaaaaagcctaaaattttggggcccaaccttgaccaattggaggaaggaatttcgggttccaaaaaaaaagggaatttcctcccccccgtttaatgaaaggccagagttttcccccccttttttccgggggggaaaaataaaggggggacccttttttccataaaattttgggggaaaagttgggggaaaccctttataaagggggccccccctttggggggtgaaaaaacccccgcaaaaattttagaagggtctccccaaaaaaaatttccccccccccccgtggaaaaaaaacaaaaaatctccccccctttttttgggggggcgggggggggggaaaaaattttccaaccgcgggaaaaaatccccccccg

SEQ ID NO: 95175 - DNA, 929 bp, Zea mays
  misc_feature: Ceres CLONE 1585322
  misc_feature (518)..(518): n is a, c, t, g, unknown, or other
  misc_feature (862)..(862): n is a, c, t, g, unknown, or other
ctggagctccccgcggtggcggccgctctagaactagtggatcccccgggctgcaggaattcgtctcacccctagaaaaatccgctcgcaggcaggcacagcgccaagcggcgaccgagagtccgagacccattcccatccacgcgaccacgctgccgttctctccccttcctccccgtcgcttccattcccgtccctcacaatctcacccccgccagccgagccccaaccctaacgaaatttacacctgcttcgttggcgtgagcggtcttaggcgtcgggcgtcgctgctgtccagcggtgtcggatccgggtcccgcgccgttaggtcgaggtttcttcggcgacggtgcagccgctggatgttagtctggcagatcggggccgaggcagtgttggggtgtaacatttgtatcgcatgaatgaactcagagcatctcaatgtaaaaactgttaaggggcagacctggtgccagaggctcccacatggagtggggtctaggggaaggaattatccnaaggcaggcctccccccttgcaaatggagaaaatgggcttttgaaccccgggacctgggggacctcagggggaaacccctttcacccttgtaaaggggggcgtggtctttccttatgggttaaaaagggagcaaatttaatttttttctttttaaccaaatagggggagccaattttttttttttctctcaaaaaggaaggaaaaaaaccctggttttctctcttaaaaaaaattcggcgtataagaaaaggggggggggccccccccctggggaaattttggtggggagacaccccccccctttaagaaagaaagggggggttcttcttcttgtttttccccnaaaaagggggggggagggctctcccttctcctaaaaggaggggtcttttttctccccccaaagggag

SEQ ID NO: 95176 - DNA, 892 bp, Zea mays
  misc_feature: Ceres CLONE 1585323
  misc_feature: Encodes the peptide sequence at SEQ ID NO. 95177
  misc_feature (892)..(892): n is a, c, t, g, unknown, or other
ctccccgcggtggcggccgctctagaactagtggatcccccgggctgcaggaattcgtctcacccctagaaaaatccgctcgcaggcaggcacagcgccaagcggcgaccgagagtccgagacccattcccatccacgcgaccacgctgccgttctctccccttcctccccgtcgcttccattcccgtccctcacaatctcacccccgccagccgagccccaaccctaacgaaatttacacctgcttcgttggcgtgagcggtcttaggcgtcgggcgtcgctgctgtccagcggtgtcggatccgggtcccgcgccgttaggtcgaggtttcttcggcgacggtgcagccgctggatgttagtctggcagatcggggccgaggcagtgccccccctgtaacatttgtatcgcatgaatgaactcagagcatctcaatgttaaaactgttaaggggcagacctggtgccagaggctcccacatgagtgggttctagggaagggataatccgaagcaagccttccccctgcaaatgcagagatgcggctttgaacccgtgacctggtgactatgtgagacacctctcaccactgcaacagggctgtccttcctcatcgttaaaactgaacatattaatttcttccttcttaagcaatatgggagctaattgctgcatttgcctgcaaaggagaggaaacaagccgtgcatcactcctatagaaataatcggccatttaggaatgtgagggggctcgccatcatggaaacatttctatggggaaaatcgcccccgctttgggaagaactttagtgggacatttccctacttctgtttcctccaattataggtaagggggaaacgctttcattccctctatacaaaggggtgggn

SEQ ID NO: 95177 - protein, 29 aa, Zea mays
  misc_feature: Ceres CLONE 1585323
MNSEHLNVKTVKGQTWCQRLPHEWVLGKG

SEQ ID NO: 95178 - DNA, 954 bp, Zea mays
  misc_feature: Ceres CLONE 1585324
  misc_feature: Encodes the peptide sequence at SEQ ID NO. 95179
  misc_feature (842)..(842): n is a, c, t, g, unknown, or other
tggagctccccgcggtggcggccgctctagaactagtggatcccccgggctgcaggaattcgtctcacccctagaaaaaatcgcctttgcccgcacacacggctcccattccatttccgctgcctgcctctgacgcgcacccacaccacctcgcctccctcagccctccgcagctcggcctctgcttgcgttgcgttgcgtgtgtatgtagtggccgcaacacaaaaatcaagagacgtgtatgtatatgcgacccccaacagccaacgaccggcctccaagcggtgggggtggaggagcagcagctggtgcaggtgcagcagcaggggacgacgacttcgccttctactgctcctaccctcaggacgccgacgctgccgccgcctcagcgacgtcgacgctcgccctcggcgtcgacgaccccaaaccccaccccagcgccgcaagaatgaccaacggccggccccggaagcaacgcggggcaaagaccccggaacccccccgggaaaggggaaagagaagcccaaaaaggaccggaaaaaacgggtcaaaacccaggcggcttaccctcctttggggggcctgggaagcgaaaaaaacccccaaaccgccggggggccccggaaaacctttccaggggggagggggggccctttcttagattaaaaccaaaacccccttttgggggcccctggggattttttcccccaagggggaaaaggtttttaacccccccccaaaaattaagggcccccccgggaaaaaaatccttaagtttcccggggggggccccccccgggtttttttgtgggggggagaggggggggtttttgggggggggnccccccccggggggccccacaaaaccccccggcggggggggggggggggcccccccccccggggttgagaaaaaaaacccccccccggggtagagaaaaaaaaaaaaaaaaa

SEQ ID NO: 95179 - protein, 70 aa, Zea mays
  misc_feature: Ceres CLONE 1585324
MTNGRPRKQRGAKTPEPPRERGKRSPKRTGKNGSKPRRLTLLWGAWEAKKTPKPPGGPGKPFQGGGGALS

SEQ ID NO: 95180 - DNA, 901 bp, Zea mays
  misc_feature: Ceres CLONE 1585328
  misc_feature: Encodes the peptide sequence at SEQ ID NO. 95181
aagctggagctccccgcggtggcggccgctctagaactagtggatcccccgggctgcaggaattcgtctcacccctagaaaaaaaacatgcactagctcctcctctcttgcccaccagcgactcccgtagctggaactcgctcgtcaaaaggaaaaggaaacacttcgcttcagctcgttgacagacgacgactcagagcaaaatgggtatactggtgattacggtggacctagactgctgtcgctgcagagccaagatcaccaaggtcctggactgtctcaaagaggagttctgcatcgagaaagtggagttcgatgacaagaaggagaagaaggtggtggtggtgcgtgggaagttcgacgccgagaagctctgcaagaaggtgtggtccaaggccgggaagatcgtgaaggggattgtcatcgctgaggtgtggccaataccagccccgcccaaggagtgctagcctgaggcaccgaaatgttgcgactgtgagaagtgcaagcccaagccccaggctgagccaccgaaaatgtgcgactgtgagaaatgcaagcccaagccccagcctgagcccccgaaatgttgccactggtgagaagtgcaaccccagccctgagcctcccaaacagagaaaatgctgcagtgcctggttgtcactggaaccctaaacctgaatcccaaaaccgctaaaatgttggggccggtggccccctgcaaaccccgaagaaaaaagggaaaaaaagaagggaaaaaaagaaagggccaaaaagaaagaccgggcccccggccaaaaaggggaaaacaaagtttgtgggccctaccccgaaccccgcgggcccaaaaacccggcgaaattgtgcccgaaaatgtggcgcggggaaaaatccccccccctcc

SEQ ID NO: 95181 - protein, 87 aa, Zea mays
  misc_feature: Ceres CLONE 1585328
MGILVITVDLDCCRCRAKITKVLDCLKEEFCIEKVEFDDKKEKKVVVVRGKFDAEKLCKKVWSKAGKIVKGIVIAEVWPIPAPPKEC

SEQ ID NO: 95182 - DNA, 896 bp, Zea mays
  misc_feature: Ceres CLONE 1585330
  misc_feature: Encodes the peptide sequence at SEQ ID NO. 95183
  misc_feature (653)..(653): n is a, c, t, g, unknown, or other
  misc_feature (850)..(850): n is a, c, t, g, unknown, or other
  misc_feature (896)..(896): n is a, c, t, g, unknown, or other
ctccccgcggtggcggccgctctagaactagtggatcccccgggctgcaggaattcgtctcacccctagaaaaagcctagcctagcgccctagccttgcctgctctcctcatgccctggccgccgcctataaaagagcgaggcggagaggcaggcgccggccgttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaccntccaggtgtcgcacccgaacaaggaggcgcccgtcatcgactacaagctcgcgttgctctttcagcccatgcttatgctcggcataaccatcggcgtagagctcagcgtcatcttcccatactgggctatcactgtccctcatataatcctctcggaggcacctcgtcgagatcctctacaggggaatctgatgtgnagggagaagacaggatctgacggagacacgcggcgagaagagcatn

SEQ ID NO: 95183 - protein, 217 aa, Zea mays
  misc_feature: Ceres CLONE 1585330
  misc_feature (137)..(137): Xaa is any aa, unknown, or other
  misc_feature (202)..(202): Xaa is any aa, unknown, or other
MVMEGRTGSLYGRLNKSSTRGFLAYTAAGAACAAVLACFVLSAADSPASAARNDGARLRLSSRSPRVWPDLAFNWRVVVATVVGFLGSAFGTVGGVGGGGIFVPMLNLVVGFDTKSAAALSKCMIMGASASSVWYTXQVSHPNKEAPVIDYKLALLFQPMLMLGITIGVELSVIFPYWAITVPHIILSEAPRRDPLQGNLMXREKTGSDGDTRREEH

SEQ ID NO: 95184 - DNA, 889 bp, Zea mays
  misc_feature: Ceres CLONE 1585331
  misc_feature: Translation starting site: 261
  misc_feature: SWISSPROT Homolog: EC 1.1.1.39 Malate dehydrogenase (decarboxylating)
  misc_feature (725)..(725): n is a, c, t, g, unknown, or other
  misc_feature (843)..(843): n is a, c, t, g, unknown, or other
  misc_feature (849)..(849): n is a, c, t, g, unknown, or other
  misc_feature (853)..(853): n is a, c, t, g, unknown, or other
  misc_feature (861)..(861): n is a, c, t, g, unknown, or other
  misc_feature (866)..(866): n is a, c, t, g, unknown, or other
  misc_feature (886)..(886): n is a, c, t, g, unknown, or other
ctccccgcggtggcggccgctctagaactagtggatcccccgggctgcaggaattcgtctcacccctagaaaaagtctcctatcctcctgccctcaccgcgggtgcccgcaccgcgcggcgacgcctccccttcaaatctcccaggagctaggggcctcggccaccaccaccgcaccgcaccgtctcggacgcggctgcagctccgagcattggattccgaccaactgaccgagcggcgtgtcagatgatctcgccggcgatgtgtcgttcggcgccgcggcgggccgcgcaggtccggcgcctcctgtcgtcggccgcgcccccggcgcacgccggcgctgccgtgcctgggccctgcatcgtgcacaagcgcggcaacgacatcctccacgatccgtggtacaacaaggatacggcgttccccatgacggagcgcgaccgcctcggtctccgcggcttgctcccgccgcgggtcatgtccttcgagcagcagtacgagcgatttataaactctttccggtcgctggagcacaatacccgcggcgagcctgactccatcgtcgcgctggccaaatggaggatcctcaacaggttgcacgaccggaacgagacattgtactacagggtgctaattgacaatatcaaggattttgccccgataatatacactcccactgttggcttggtctgtgaaaattacagcggtctgttcagacgaccccgntgggatgtatttcagtgcaaaggataaggggggagatgatgtcaatgatttacaactggccagcagagaaggttgacatgatagttgtgactgatgggagtcgcattctaggctaggntgaccntggntgtcaggncatangtatacctattggtaaactngat

SEQ ID NO: 95185 - DNA, 934 bp, Zea mays
  misc_feature: Ceres CLONE 1585336
  misc_feature: Encodes the peptide sequence at SEQ ID NO. 95186
  misc_feature (476)..(476): n is a, c, t, g, unknown, or other
  misc_feature (557)..(557): n is a, c, t, g, unknown, or other
  misc_feature (613)..(613): n is a, c, t, g, unknown, or other
  misc_feature (864)..(864): n is a, c, t, g, unknown, or other
ctccccgcggtggcggccgctctagaactagtggatcccccgggctgcaggaattcgtctcacccctagaaaaacaggaaggcaggaagaaccgccgccacgccacacacaaaacagtgactcagtgagaaaggacagcaagccctcccctccctccatctccgccccgtcgccatggtccttctcttcgtggagaagctcctggtcggcctcttggcgtccgtcatggtcgccatcgcggtgtccaagatccgtggccgcaagctccggctgcctcccggccccgtccccgtgcccgtcttcgggaactggctgcaggtcggcgacgacctcaaccaccgcaacctcgccgcgctgtcccgcaagttcggcgacgtcttcctcctccggatggggcagcgcaacctggtggtggtctcgtcgccgccgctggcgcgggaggtgctccacacgcagggcgtggagttcggctcccngcacccgcacgtggtcttcgacatcttcacgggacaagggcaggacatggtgtttcacgtgtacggcgaccactggcgcangatgcgccgcatcatgaccgtgcctttcttccacaaaaggtcgtgcagcagtactnccacggctgggaaggcaaggccctcccctttttttaaaaaagtcgctttgaccccaagggggcccccaaggaattggggtctccccaacccctgggtttttgatgtacaaaaccttattcgggatttttttcacggcgcctttaaaaaatgggagaaccgtttttttttcctcttagggggtttaaagggagaggcaccccctccgcagaatttttaaaaaaaagaggggaaatttcccccccccccgggnttttcccccgggatataaaggggtgcgggagggggagggaaaacacccctctcccttttttggttttttt

SEQ ID NO: 95186 - protein, 218 aa, Zea mays
  misc_feature: Ceres CLONE 1585336
  misc_feature: SWISSPROT Homolog: EC 1.14.13.11 Trans-cinnamate 4-monooxygenase
  misc_feature (101)..(101): Xaa is any aa, unknown, or other
  misc_feature (128)..(128): Xaa is any aa, unknown, or other
  misc_feature (147)..(147): Xaa is any aa, unknown, or other
MVLLFVEKLLVGLLASVMVAIAVSKIRGRKLRLPPGPVPVPVFGNWLQVGDDLNHRNLAALSRKFGDVFLLRMGQRNLVVVSSPPLAREVLHTQGVEFGSXHPHVVFDIFTGQGQDMVFHVYGDHWRXMRRIMTVPFFHKRSCSSTXTAGKARPSPFFKKVALTPRGPPRNWGLPNPWVFDVQNLIRDFFHGAFKKWENRFFFLLGGLKGEAPPPQNF

SEQ ID NO: 95187 - DNA, 864 bp, Zea mays
  misc_feature: Ceres CLONE 1585341
  misc_feature: Encodes the peptide sequence at SEQ ID NO. 95188
ctccccgcggtggcggccgctctagaactagtggatcccccgggctgcaggaattcgtctcacccctagaaaaagtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacgacgcagtggtggtgggggccggcggcgcggggctccgggcggcgatcggcctctccgagcacggcttcaacaccgcgtgcatcaccaagctcttccccacgcgctcgcacaccgtcgcggctcagggaggcataaatgctgcacttggaaacatgagtgaagatgactggaggtggcatatgtatgacactgttaagggaagcgattggctgggtgaccaggattctattcagtatatgtgcagagaggcaccaaaagctgttatagagcttgagaactatggactaccattttcaagaactgaagagggaaagatataccaacgtgcctttggagggcagagcttagattttggcaaaggtggacaagcctaccgttgtgcctgcgctgctgacaaaacagacatgctatgctgcacacactatatgggtcaagcatgaagcacaacacttcattttttggtggaatactttgcttttggaccttctcatggacaatgaaaggaaatgtccggggatcattgccttaaacatgggaggatgggaactctttcacggtttccggggcttctaaaacatttctgggcct

SEQ ID NO: 95188 - protein, 181 aa, Zea mays
  misc_feature: Ceres CLONE 1585341
  misc_feature: SWISSPROT Homolog: EC 1.3.5.1 Succinate dehydrogenase (ubiquinone)
MWRSCVSRGLSRAKASASRLLSTASSSYTVVDHTYDAVVVGAGGAGLRAAIGLSEHGFNTACITKLFPTRSHTVAAQGGINAALGNMSEDDWRWHMYDTVKGSDWLGDQDSIQYMCREAPKAVIELENYGLPFSRTEEGKIYQRAFGGQSLDFGKGGQAYRCACAADKTDMLCCTHYMGQA

SEQ ID NO: 95189 - DNA, 949 bp, Zea mays
  misc_feature: Ceres CLONE 1585342
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (312)..(312): n is a, c, t, g, unknown, or other
  misc_feature (328)..(328): n is a, c, t, g, unknown, or other
  misc_feature (329)..(329): n is a, c, t, g, unknown, or other
  misc_feature (358)..(358): n is a, c, t, g, unknown, or other
  misc_feature (359)..(359): n is a, c, t, g, unknown, or other
  misc_feature (367)..(367): n is a, c, t, g, unknown, or other
  misc_feature (388)..(388): n is a, c, t, g, unknown, or other
  misc_feature (391)..(391): n is a, c, t, g, unknown, or other
  misc_feature (393)..(393): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (440)..(440): n is a, c, t, g, unknown, or other
  misc_feature (745)..(745): n is a, c, t, g, unknown, or other
  misc_feature (949)..(949): n is a, c, t, g, unknown, or other
tggagctccccgcggtggcggccgctctagactagtggatcccccgggctgcaggaattcgtctcacccctagaaaaacccacgccgcctgcctgcccctcgcctcgggggcgaaccacgagaaggggattccggctagggtttcgcggatcgagaagagtcagggaagaagcggggggagagaagagggcggcacctagggtttccgcgggcggctccccccgcatggcctcgccagcggcagcggcggcggnnnnnnnnnnnnnnnnggggnnnnnnnnnnnnnngnnnngnnnngnnnngggnnngggngggggggggggggggnngggggggggggggggggggggggggtggnngggggggnggggggggggggggggggggnggngnggnnnnnngggggccccccccctggggcnnnnnncnnnnnnnnnttntggggggggccgcggcgtgggtccccgggggggcggggctgttcggttgtggggcgggggggggggggcgtgtgcccccgcggcggggggggggggttcggtttggggggtggtgttgtgtggggcggtggcgtgggcctgtcccgctggccgcgtcgggggccgctgctcgggggtggctactttggtgctcggttgggtcggcggggggggccgcgcgggtgttgtcgctcgggggcgcgggcgtggtgggggttgggggtgtggtttttgtggggcgtggcccgcccgggcctctggtgccnatttctcccgcggcgcggctagggtgcggttgtggggagctcgtgcgtggccgctggcttgggggggccgcgcgccggtcgcagatgtggagggcttctgtggggcggcggttggtgtatttaaaccgcgggggttagtggccgcgggtgccgcgcacgcactgagtcatcgtggtcgggctgtcgcgcgtcgctgttaattan

SEQ ID NO: 95190 - DNA, 908 bp, Zea mays
  misc_feature: Ceres CLONE 1585346
  misc_feature: Encodes the peptide sequence at SEQ ID NO. 95191
  misc_feature (396)..(396): n is a, c, t, g, unknown, or other
  misc_feature (530)..(530): n is a, c, t, g, unknown, or other
ctggagctccccgcggtggcggccgctctagaactagtggatcccccgggctgcaggaattcgtctcacccctagaaaaagcgattcatggcccgcaagcgccgcgcgccttcgcctcctccgcctccgcaggaggagtcgtcctctgaggaatctggctccgaagagttggaggagcctcctcgcctccccgagctccgtagtcctccgcaggccgcggccaacaacgccgactcgtcggaggcggacacggactccgacaccgacgctcaagctttccagatgcgccaggtgccccgctccctcactaagcatacgcatccagttccccagccagaatccgatcccgaagaggaggagggcgagtcatcggagtcggagcatgagaaccctgtncctgtggttcagaagaaggctgcggcggcggccgtgttgtccaaggcagagcaggaaaggaagagacccccctcggatcctgctcctaccgggaaggcaaaaaaaatgagggctgtgggctacccctcttgccnaggcgaagaagggcaagcccgagctagaagagccggccccctgagggcccttccagcaggaaattgcaagaggggcaaagcttgacctgaagaacccaacgtttgaatgccctctcacccgggaagggcaaaaaagggcaagggccaaggaggcagctcctggaggcccccccctttaggcaaggggaaaaaaaggatgggggacaaacctaaaaaaaagttccccggccccttgaatccccccccatttcaaaccagcaaggttcttgaaaaagctctgtgggcgcccccacactgtgggggagaaaaatgtttgtggaatttaaaaattttttgtggggggcctcttttgcttggcccaattttcaagagcggtgg

SEQ ID NO: 95191 - protein, 175 aa, Zea mays
  misc_feature: Ceres CLONE 1585346
  misc_feature (148)..(148): Xaa is any aa, unknown, or other
MARKRRAPSPPPPPQEESSSEESGSEELEEPPRLPELRSPPQAAANNADSSEADTDSDTDAQAFQMRQVPRSLTKHTHPVPQPESDPEEEEGESSESEHENPVPVVQKKAAAAAVLSKAEQERKRPPSDPAPTGKAKKMRAVGYPSCXGEEGQARARRAGPLRALPAGNCKRGKA

SEQ ID NO: 95192 - DNA, 1162 bp, Zea mays
  misc_feature: Ceres CLONE 1585347
  misc_feature: Encodes the peptide sequence at SEQ ID NO. 95193
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
accagtgtttcgccgctcaaacaaacaaattaataaccgaacaccaacacccacccccnnnnnntccnnnnnntcaaaactggagctccccgcggtggcggccgctctagaactagtggatcccccgggctgcaggaattcgtctcacccctagaaaaacgattcatggcccgcaagcgccgcgcgccttcgcctcctccgcctccgcaggaggagtcgtcctctgaggaatctggctccgaagagttggaggagcctcctcgcctccccgagctccgtagtcctccgcatgccgcggccaacaacgccgactcgtcggaggcggacactgactccgacaccgacgctcaagctttccagatgcgccaggtgccccgctccctcactaagcatacgcatccagttccccagccagaatccgatcccgaagaggaggagggcgagtcatcggagtcggaggatgaggaggcggcccccccccattcaaaaaaaagttgctgcctgcggcccatgtttgtcaaggcacgaccaggcaagggaagagacccccccctcggatacctgccccctagccgggggaaggcacaaaaaaaaatgaaaggggtgggggcttaccccccttctttcgccaaagggccaaaaaaaaaggtagcaagggcccgcaaccttttaaaaaaaagccggggtcgcccctggaagggccctaccttcccgggcccaggcagaaaatttgcccaaagaaaataaggggcaaaagagcctcttggaattctctgagtagcgaaaacgccccgaaaccgcttttatggagtgtggccccatttctccaccgacctgcggagtaaaaggtccggaaaagaatatagagggccacacgggcgcccaaaagggaaggggcacagtctcttcctctggtaggggccgcaccggaccccctttcaaaggataagtggggggacaaagacataggatatgggggggcaacaatacccttagcgggatagagttcttgtccgcgccgcgatgagaaacccgcccgcacaagctttcaggagaaaaggccagagtttctgatagaaaagcctcggtgcgcggcccccccacatgtggtgggaaataaatagtgtcgcggagttaaaactattcttgtgagaggcccctt

SEQ ID NO: 95193 - protein, 193 aa, Zea mays
  misc_feature: Ceres CLONE 1585347
MARKRRAPSPPPPPQEESSSEESGSEELEEPPRLPELRSPPHAAANNADSSEADTDSDTDAQAFQMRQVPRSLTKHTHPVPQPESDPEEEEGESSESEDEEAAPPHSKKSCCLRPMFVKARPGKGRDPPLGYLPPSRGKAQKKMKGVGAYPPSFAKGPKKKVARARNLLKKSRGRPWKGPTFPGPGRKFAQRK

SEQ ID NO: 95194 - DNA, 925 bp, Zea mays
  misc_feature: Ceres CLONE 1585348
  misc_feature: Translation starting site: 332
  misc_feature: SWISSPROT Homolog: EC 1.14.13.11 Trans-cinnamate 4-monooxygenase
  misc_feature (881)..(881): n is a, c, t, g, unknown, or other
aagctggagctccccgcggtggcggccgctctagaactagtggatcccccgggctgcaggaattcgtctcacccctagaaaaaaactctactcggagaacgatctactgcacgaccaaatctaactaatacccgaactaaataaaaggaagaggtcaaaaaataaaaggtgttgtgcaatcgatcatggtgaccgtggcgcatatcgccatggactggctccaagaccctctgagatgggtgttcactggggacgctggccttggtgatcctgcacctgctacgacgggacaaagcgccgcataccatccgggccaaagccactgccgatcatgggcaacatgatgatgatggaccagctgacccaccgcgggctggaggcactggtcgagaggtacggcacaacaacttcacctccgtctgggccggctgcacgcgttacaagagtctacgccagactacgcacgcgaggtgctgcaagcgcaagacagcgcgttctccaacaggactgacactatctacatcgagtacctgacgtacgaccgcgctcgacctgtcgtatgcgcactacgagttccttctggctccagaagctcaagctctgcatgatgaagctattcatccagtcgcaaaccgaagactctgtgtgacttgcatctacgagtgatctgctctgggtcgcttcagtgcaacacagtatcgacgatgttgccaggacatgaacctggatcaactcttcctaaacctgtaccaagatcctgactttccgcaccttccttggcagccaactactgcttggagcaatgaggagttacttggcattcctgtgggaagttttctagttgttcagcggctttaaacgaattaaacttccttcctggncttaaacgtgaataaacatggagggaaattaacggcggcctcaa

SEQ ID NO: 95195 - DNA, 926 bp, Zea mays
  misc_feature: Ceres CLONE 1585349
  misc_feature: Encodes the peptide sequence at SEQ ID NO. 95196
ctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacagggaggcgcccttgtgacgatcgaggacgtggacctcagctctcatcaggcggcggccgacgacggggagctcgcccccccgtggccgggaagtccccggcagcacaactggggagggtttgctggacccaattaaggggggggtcccccccggaagcctattcccttacgggggagtttcccccgggccccttaaaaaagtttttaaaaaaaaccctttttcccccaattgggggggggtgaaaatccccggggaaaaatttttttcccaaaaattggtcccggggggggtttttaaaaaaggaaaccctttttttttttccccgcggaaaaaaccaaaagttccccaaattttggaaaaaaaggggcccccccccaaaaagagggggagagggggcgggccttttggggggggggggggccccccccacaaaaaaaaaaagagggggtttccccgcggaaaaaataattgggggggggggcccccccccccccccccgggggggggggggaaaaaa

SEQ ID NO: 95196 - protein, 96 aa, Zea mays
  misc_feature: Ceres CLONE 1585349
MAATVSSCLSLVPTVHHRAGGFPSSVALTNTLQRRRRSRRYLVVASATRAEQGGALVTIEDVDLSSHQAAADDGELAPPWPGSPRQHNWGGFAGPN

SEQ ID NO: 95197 - DNA, 913 bp, Zea mays
  misc_feature: Ceres CLONE 1585351
  misc_feature: Encodes the peptide sequence at SEQ ID NO. 95198
aaagctggagctccccgcggtggcggccgctctagaactagtggatcccccgggctgcaggaattcgtctcacccctagaaaaacccgttggcttcggcggcgggcggccatcagcaaccagcatcgtacggaggagaagcgctgtttacacccgtctggcagggatgccgctggggcagcgttcgggggacaagagcgactcccgctactgcggggtggaggttctcgacttccccgccggggagggcctccctgccgtcctcaatcactccctcgcctccgccttcgacttcatcctcgcccctctggttgatcccaactaccggccggcgcccggcgccgttctgccagtgtcagcgtcggacctcgtcctcggcccgtcccagtggagcaaccacctcatcgggaagatcagcgagtggattgatttggacgcggaggacgagcggctccggctggactccgagctcacgctgaagcaggagatcgcttgggcatctcacgtttcgctgcaggcatgtgttattcctgcccccaggagatctttttgcggcaattatgccagagttgtggatcagattttgcaaggcctgaccaatatgaatttgtggcttaagttgcctctggagaagtccgagcctatggatggtgatctttgataaataaagaacagcacccccccgctacagagtgaaatagcagactcttggggattatgggaattcattcaagattgcttttgtgacccttagtgagccaacttatgcgggggcactttggataatttcggggcacccctggccatcaaatgaaactcacttaagggggcccttggtttggggggagccttgtaaagggcgtggcctatttctgccaaaccaaaggtgtgtttttcttaacaaaagtgggaga

SEQ ID NO: 95198 - protein, 164 aa, Zea mays
  misc_feature: Ceres CLONE 1585351
  misc_feature: SWISSPROT Homolog: EC 2.1.1.125 Histone-arginine N-methyltransferase
MPLGQRSGDKSDSRYCGVEVLDFPAGEGLPAVLNHSLASAFDFILAPLVDPNYRPAPGAVLPVSASDLVLGPSQWSNHLIGKISEWIDLDAEDERLRLDSELTLKQEIAWASHVSLQACVIPAPRRSFCGNYARVVDQILQGLTNMNLWLKLPLEKSEPMDGDL

SEQ ID NO: 95199 - DNA, 912 bp, Zea mays
  misc_feature: Ceres CLONE 1585352
  misc_feature: Encodes the peptide sequence at SEQ ID NO. 95200
  misc_feature (396)..(396): n is a, c, t, g, unknown, or other
  misc_feature (472)..(472): n is a, c, t, g, unknown, or other
ctggagctccccgcggtggcggccgctctagaactagtggatcccccgggctgcaggaattcgtctcacccctagaaaaaggtttcatttcttccccccttctcgtcacgtccaaaggggggaaaacttctttctctctcttttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacccgcacttgataataacccctccaagagtgcaaacgccagggaccagattctttctggtacggagaatgtgactacangcaatgcacgcggcggcagctccttgaaatcgcaaaaaggccctgcagagaaggctagctctggtggaaaacctgnagaaacaacctttccctacccgccaaatgtggatgcaccacagccaccaacccttttatctgggaggcttctgaaacccttcgggacaagtggaagaaaatccccctttttgggagtatgggaggggtttcaatttccgtatttccggggaattttaaagggaaaccaatccccctgggtttattccggggaatttgaaaaaccccccccaaggggtgtttgggggaattttccccggtttccccccggggaaagagggcaaaaaaacaccccccaaaggtttttcccctttcaaaggcttataaataaaaccccggcttttttctcagggggggaaataacaccctctccccggggagaaaccggggagaccccttttttgcccgaaaaaaatttctcttcgagggggctcttttattcccccccagggggggtttctc

SEQ ID NO: 95200 - protein, 219 aa, Zea mays
  misc_feature: Ceres CLONE 1585352
  misc_feature (48)..(48): Xaa is any aa, unknown, or other
  misc_feature (73)..(73): Xaa is any aa, unknown, or other
MAAAPHQAQGPADSVIPLQSEPALDNNPSKSANARDQILSGTENVTTXNARGGSSLKSQKGPAEKASSGGKPXETTFPYPPNVDAPQPPTLLSGRLLKPFGTSGRKSPFLGVWEGFQFPYFRGILKGNQSPWVYSGEFEKPPPRGVWGNFPRFPPGERGQKNTPQRFFPFQRLINKTPAFFSGGEITPSPRGETGETPFLPEKNFSSRGLFYSPPGGVS

SEQ ID NO: 95201 - DNA, 876 bp, Zea mays
  misc_feature: Ceres CLONE 1585353
  misc_feature: Encodes the peptide sequence at SEQ ID NO. 95202
ctggagctccccgcggtggcggccgctctagaactagtggatcccccgggctgcaggaattcgtctcacccctagaaaaaccgctagggcgccgagacagcggaacgttctctgagtttgagcacgatctccccgggccccggcgccgccgtacgtcccccttcggcgtcgccagccgcctcctggctccggctccttcatcgcctgctccagcgtgcctgcgtgacataagcgtcgattgattggcgagaaaggggacgaatgcagccgccgttgcaggcgcagggagcaatggctaacgtcgccgctatcctcaccgtcccctgctccgcgggccgccgcccgaagcggagcagccagccccgcggatgcggctccgtctccgtctccccctccgtccgtgcgtcctccggcgcaaacacggtgactctgctggactacggcgcggggaacgtacgcagcgtgcgcaacgcaattcgctacctcggcttcgacatccgcgacgtgcagagcccggaggacatcgtcgccgcggaacggctcgtctttcccggtgtcggcgccttcggctccgccatggacgtccttcacaggacgggcatggccaaagccactccgtgagtacatccaaaagggaccgcccccttcctaaggatttgccctcggtctcccagctgctctttcaattccccccagggagaaacggcccgggggaacgggcctcggggggaaaaaccaggcgggggtagggggaattcacctccctcaaaggggccttcaaagtttccccaatattgggcttgggaagcctcttccgaaattcccaaaggaaccaaccccctttttgcagggggacacttgaatgggcccgcaatg

SEQ ID NO: 95202 - protein, 109 aa, Zea mays
  misc_feature: Ceres CLONE 1585353
MANVAAILTVPCSAGRRPKRSSQPRGCGSVSVSPSVRASSGANTVTLLDYGAGNVRSVRNAIRYLGFDIRDVQSPEDIVAAERLVFPGVGAFGSAMDVLHRTGMAKATP

SEQ ID NO: 95203 - DNA, 918 bp, Zea mays
  misc_feature: Ceres CLONE 1585354
  misc_feature: Encodes the peptide sequence at SEQ ID NO. 95204
  misc_feature (710)..(710): n is a, c, t, g, unknown, or other
  misc_feature (742)..(742): n is a, c, t, g, unknown, or other
  misc_feature (838)..(838): n is a, c, t, g, unknown, or other
  misc_feature (878)..(878): n is a, c, t, g, unknown, or other
ctggagctccccgcggtggcggccgctctagaactagtggatcccccgggctgcaggaattcgtctcacccctagaaaaaaacattgctcaggctgctcccaactcccatcctccccctcccggagtacgaagtactagaaagagagcggctttcctctaagaatggcgggtggcggcgccggcgacgacgacgtggtggtggtgagctgcggcggcagaggcggcggcgaccccggcgcatacgccgcggtgctcaagaggaagctcgacctgtactgcgccgccgtcgccaaatccatggaagctaaatcacaagaacattcgttgggctaccccaactcacaagcttcagatgcttcgcaattgatttctcaagcttcctttgatggtgacatagatggggcaagcctagttacaaactctaatgtcatagaagatgatgattttcaaggcaagccaaccaacagtggcacatcaaaggaactgtcagacgatgatggtgaccttgaagagaatactgaccccgctaacgccaagaagatgaggagaatggtgtcaaaccgggaatcggctaggcgatcaagaaagaggaagcaagcacacttgaccgatcttgaatcacaggtttccaggttaacgtctgagaatgcatctttgctgaagcgactggctgatatgactcagagatacaaggacgcttccgttgacnataaaaatctaacagttgatgttgagactatngaggagaaaggttcgttcgtcttgaatgcatcacagacctttttctttcttttttttgtgtacgagaactctttactgcatcccattatcgatcantacattttactggggctctgtgtatctcaccgtaatcaancgttacatctctctagatgcctgcaaagggcagtgaaagt

SEQ ID NO: 95204 - protein, 251 aa, Zea mays
  misc_feature: Ceres CLONE 1585354
  misc_feature (121)..(181): Pfam Name: bZIP_1 Pfam Description: bZIP transcription factor
  misc_feature (183)..(183): Xaa is any aa, unknown, or other
  misc_feature (193)..(193): Xaa is any aa, unknown, or other
  misc_feature (225)..(225): Xaa is any aa, unknown, or other
  misc_feature (239)..(239): Xaa is any aa, unknown, or other
MAGGGAGDDDVVVVSCGGRGGGDPGAYAAVLKRKLDLYCAAVAKSMEAKSQEHSLGYPNSQASDASQLISQASFDGDIDGASLVTNSNVIEDDDFQGKPTNSGTSKELSDDDGDLEENTDPANAKKMRRMVSNRESARRSRKRKQAHLTDLESQVSRLTSENASLLKRLADMTQRYKDASVDXKNLTVDVETXEEKGSFVLNASQTFFFLFFVYENSLLHPIIDXYILLGLCVSHRNQXLHLSRCLQRAVK

SEQ ID NO: 95205 - DNA, 884 bp, Zea mays
  misc_feature: Ceres CLONE 1585356
  misc_feature: SWISSPROT Homolog: EC 4.1.1.50 Adenosylmethionine decarboxylase
  misc_feature (744)..(744): n is a, c, t, g, unknown, or other
ctggagctccccgcggtggcggccgctctagaactagtggatcccccgggctgcaggaattcgtctcacccctagaaaaagccgagctctgtagcgagagcttgtaacccgagcgggggcattaaggtggtgcggattctttgcgatggctttctgggcccgggctcgctatgtgcctttggccggcctgcccgtcccaagttggtagtggctggcggaggctttagcggaagctttggtctctccagaccgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagagccatcctgatatcccttttggcttcctcattctagtagtttaggatttcttttctgacactttgattctgaccaatctctctggcctgctgcttcctgataatcgaccagtttcccagtcttgctccttgaaactctccctcctccatctncagcaatgtgttcctgatcacctgctccaatggctgttctttctgctgctgaagcttccccggtctcagctttcgggtttgaagcctatgagaaaccccttgagatcaaattctctgagggacctgtccttgtggacccc

SEQ ID NO: 95206 - DNA, 879 bp, Zea mays
  misc_feature: Ceres CLONE 1585357
  misc_feature: Encodes the peptide sequence at SEQ ID NO. 95207
  misc_feature (693)..(693): n is a, c, t, g, unknown, or other
ggagctccccgcggtggcggccgctctagaactagtggatcccccgggctgcaggaattcgtctcacccctagaaaaaaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgagaaccagagctggaagatcctgccgtggggtcccgaggccaactccctcgcggcccacgcgggaagcccgcacngcgtgcgcgtcttctgcaagccggcggcgaagactacagcctcacggtgcgcaacggcacggcgtgccctgcggccaccaacccgcgggacgagtaccagcactggggtcagggacaatgcgccaaagcacccgggttgcgggaacgaggagggctaccccggtcttcgcgcttcgtcaacaaggc

SEQ ID NO: 95207 - protein, 248 aa, Zea mays
  misc_feature: Ceres CLONE 1585357
  misc_feature (187)..(187): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGGVHDGTAVVLWEWCKGENQSWKILPWGPEANSLAAHAGSPHXVRVFCKPAAKTTASRCATARRALRPPTRGTSTSTGVRDNAPKHPGCGNEEGYPGLRASSTR

SEQ ID NO: 95208 - DNA, 1019 bp, Zea mays
  misc_feature: Ceres CLONE 1585358
  misc_feature: Encodes the peptide sequence at SEQ ID NO. 95209
aaagctggagctccccgcggtggcggccgctctagaactagtggatcccccgggctgcaggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaaactcaagtacgtgcgcctcgggtaccactacctcatcagccacggggggtacatgggtcaccacccccctcatcgtgctggttgtgcggcgcccgagctggggagactccaccctcaacgagcttgtggcgcaaggggggggggggggaagccaacctaacaaacctcggccaccgggggttcggcttttcctcgggcggactacggcctttcacacaaaagccgggctaaaaaaaaatggttccagggggcccgcggcccccggtggtaccgttcaatctaaacttttcgcgcagtgctgaataaaaagccggggccggaaccaaagctttccaggggtgggtccccaaagaggggcgaggagtttcatttggaaccccgtggagggtgtgagaagagcccgggggagagaatgtccaaagaaaaggaaaacgtccagggggggatctcacagagtgcaggaaatggccagggcgccagggtgcggggcgtactgtgaaaagagagaggttataaagaacccgtccgcgtggtgggttgtagagccccagcgggccggtcggggctcacccattgagaaggagggtcgcccgccccaaagggactcccggtggatggtttttgggtgacggcgagagagattatttacaaaatgtggcggccctgcgcccagaagaaggggagccg

SEQ ID NO: 95209 - protein, 98 aa, Zea mays
  misc_feature: Ceres CLONE 1585358
  misc_feature: SWISSPROT Homolog: EC 2.3.1.119 Icosanoyl-CoA synthase
MAREEQALLSTEIVNRGVEPSGPDAGSPAFSVRVRRRLPDFLQSVKLKYVRLGYHYLISHGGYMGHHPPHRAGCAAPELGRLHPQRACGARGGGGKPT

SEQ ID NO: 95210 - DNA, 1050 bp, Zea mays
  misc_feature: Ceres CLONE 1585360
  misc_feature: Encodes the peptide sequence at SEQ ID NO. 95211
  misc_feature (1023)..(1023): n is a, c, t, g, unknown, or other
gagctccccgcggtggcggccgctctagaactagtggatcccccgggctgcaggaattcgtctcacccctagaaaaaggccacggcgtccagcaccagctacgcctgtgcgcgcgcttgtgcagtacctacgttggtgggtgggtaggtagctagtgcggcggagcatcgatcgcgcggtactctcagttccatccaaccagagatcgaccggtccgtcgatcgacatggcgggccggggaggagcctcagaggcggcgccgttgctggagaatacatccgcggccgcggactcgggcggcgggtgctgctacgtggacgggtgccccgggtgcgccgtggaccggcataaggcgggcaacccgggaattccgtacggaaatttctctacgggtcgcccccccaccctatgcacgccctaaccgaaatccacgctcttcccccttcttgtttttcatgataagcgaaccgaaatgttcctctaaagaaaaaaagagctccggggatctacccctggtattgggggggggcctcctttccagtttaggggaaaatgcttcgacctcccacggcattgggggcatatcccggcagaaccccgtttttggaaggaaaaaccctgatgggtcgggtttccagcaattttcccccctcgggtttggggggtgtaaaaaaaatttggttttgcggccctagaagggaccaaagtcccggggtggggaggcaataagatgttccccgacgtattagcagtttgaggggcgctcggaagaggggtttctctatggtcacccaaagagggcgccgtatatcacactgtgaagattttgccacccatgagaggcctgttaccccggggaggatgacaacttttttctgactaccttgtgtggagaagcggtcttctgtttggggcgcgtctctcttggcgcacagatctggtaagagtggaggaaaaaaattttccatctttctcttctaccgatacagaccgtgagagaaggggcgcaggtaacatgactcntggcaccgctttctggtgggggggggg

SEQ ID NO: 95211 - protein, 64 aa, Zea mays
  misc_feature: Ceres CLONE 1585360
MAGRGGASEAAPLLENTSAAADSGGGCCYVDGCPGCAVDRHKAGNPGIPYGNFSTGRPPTLCTP

SEQ ID NO: 95212 - DNA, 849 bp, Zea mays
  misc_feature: Ceres CLONE 1585361
  misc_feature: Translation starting site: 393
  misc_feature (585)..(585): n is a, c, t, g, unknown, or other
ctccccgcggtggcggccgctctagaactagtggatcccccgggctgcaggaattcgtctcacccctagaaaaactcttgcccgagtcgctagcctccctgcccctgcccctgccccgcctcctcccgtggaccacttcctccaccttcgcttccatagcaggctagcagctgagcgaggtcaactcttccgccggcggagagagagggagggagcggggaagagacgggagggtctccgcgcacctgccatcagccaccacccgatacccaggtcttgtcccgcgcagatctgctgctgcccttgagatctaaatcaaagcttccgctccggttgttgtcggttggtcggtacctgggcggcggcggcggcggcacgggaggacagcgaacatgtcgtcgagcacgatccggaaggccctgggcgcggtgaaggaccagaccagcatcagcctcgccaaggtcactagcaacatcgcgcccgatctggacgtgctcatcgtcaagggcaccagccacgacgacgagccggccgaggagcgccacatccgcgagatcctccacctacgtcgggatcccgcgcccnacgtgctgctgccgtggcagggtgctcccgcaggctctcccgcacccgcgactatgtggtcgcgctcaagtcggtcatgctcgtgcaccgccttcctggcgatggggaccggtccttccaccgggaagctcttactgggcacacgggggggcacccggctgcctaaacttctctgatttcgggaacaggggccctccgggaatcgggggacccttcggcctttgggcgccccttgtgcgctctaccttgaacacggcccctgag

SEQ ID NO: 95213 - DNA, 912 bp, Zea mays
  misc_feature: Ceres CLONE 1585362
  misc_feature: Encodes the peptide sequence at SEQ ID NO. 95214
acccgcggtggcggccgctctagaactagtggatcccccgggctgcaggaattcgtctcacccctagaaaaaacccatccattccacctccgttcaccccgtccatttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggctgaaaaaccttggaaagggtatgctgcagccccaccagatcattgccgagtacaacaatgcgatccctgaggctgagcgcgagaagctcaaggatggtgcttttgaggatgtcctgagggcagctcaggaggcgattgtcatccccccatgggttgcacttgccatccgccctaggcctggtgtctgggagtatgtgagggtcaacgtcagtgagctcgctgttgaggagctgaaagttcctgagtacctgcagttcagggaacagcttggggaagaaaggccccacaacaactttgttcttgagctggacttttgacccttcaatggcccctttccccgtccttttctggtcaaggtcaattggcaatggcgggcagttccctcaaaggcccctgttcttaaaagtcttttccctgaccaggaagaagcatggacccccttggcctaaattacgtttggcgcccaccatcttccaggggggattgaccctgaattttttaacaaaaaagaattcccccgattctttagggggcctttgcaagggggtcccccttaaaaaaaaag

SEQ ID NO: 95214 - protein, 142 aa, Zea mays
  misc_feature: Ceres CLONE 1585362
  misc_feature: SWISSPROT Homolog: EC 2.4.1.13 Sucrose synthase
MGEGAGDRVLSRLHSVRERIGDSLSAHPNELVAVFTRLKNLGKGMLQPHQIIAEYNNAIPEAEREKLKDGAFEDVLRAAQEAIVIPPWVALAIRPRPGVWEYVRVNVSELAVEELKVPEYLQFREQLGEERPHNNFVLELDF

SEQ ID NO: 95215 - DNA, 880 bp, Zea mays
  misc_feature: Ceres CLONE 1585363
  misc_feature: Encodes the peptide sequence at SEQ ID NO. 95216
gagctccccgcggtggcggccgctctagaactagtggatcccccgggctgcaggaattcgtctcacccctagaaaaagtgaccgccgccgcgggccctagcccgccgttccctctccggcgccccgctcccgcacccgcaccggatcagtccgggccgcgtggtcgcccccacctaccgcctcgggtccactcgctcgcggttgcgtgtcccgcggggtggcccctcgggcctcggcagctcccggtttcgaatggggctctcgtcggccgccactggcgacggggtgcagctctgcgtgttcgacctccagagggggcagcaggagggccaggagctcgacaagatcctctacttctaccccgccgactgccccatcctgctccagctctctgtcatcggcctctgcgaggggatcgtcactttcactagaatattttccccagaagaggattgcgaggttatagaatcagagaaacactcccatgttttttaccaagccgaaacggatatttggatggttctggttgtggaaaaaaacaaggaaaatgaattgacttggcgttgtgtgcactacaggggattcttaaagagctcattctctctttgcaatgtttcatggaccaatcggaactttgcttgacaaacacccaagtgcagagctggctcgtggtcaactcggcaattttctacagattatttgaccgattttaatgttggaaaagagttacatttcccaccctacgggacagccttaagggaaaggggaaagtccaaatgcttaccgtattccgagaaagggggcccttgacgttagggcccctcctaaaataatttgggacacggtttgggaaaagttcctcgccaaacccttggacatt

SEQ ID NO: 95216 - protein, 129 aa, Zea mays
  misc_feature: Ceres CLONE 1585363
MGLSSAATGDGVQLCVFDLQRGQQEGQELDKILYFYPADCPILLQLSVIGLCEGIVTFTRIFSPEEDCEVIESEKHSHVFYQAETDIWMVLVVEKNKENELTWRCVHYRGFLKSSFSLCNVSWTNRNFA

SEQ ID NO: 95217 - DNA, 769 bp, Zea mays
  misc_feature: Ceres CLONE 1585364
  misc_feature: Encodes the peptide sequence at SEQ ID NO. 95218
ctggagctccccgcggtggcggccgctctagaactagtggatcccccgggctgcaggaattcgtctcacccctagaaaaaaggcccacgtctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgctcgcgaatcggggggttccacacataggcttcgtccgttttgaattttgaatgtactaaatggaagtcttagggggtggccagaaagtttaagccaaaaggcctttcccagggaagggaaggaaagttccccctttggggctcccccccttttgggggggagattttccccccttcccggggggggccccaaaaaaaaattcccaattttggggggtttattccccaagggggccaaaaaagccccccccggaaaaccccctttggggccccccccccccaaagagttaaggggttttttttttttgaacccttttttttttttaaaaaacccccccgggggggggggggttttttttgaaaaaaaaagaaaaatcccccccattttttttccccccggagatacccctcccccccctttttttgagggcgggggtgggggtgggacccccccccccccccccaggggggggggtgtttttttttt

SEQ ID NO: 95218 - protein, 52 aa, Zea mays
  misc_feature: Ceres CLONE 1585364
GAPRGGGRSRTSGSPGLQEFVSPLEKRPTSLLTKNSLIAAAAAAAAAHLAER

SEQ ID NO: 95219 - DNA, 853 bp, Zea mays
  misc_feature: Ceres CLONE 1585365
  misc_feature: Encodes the peptide sequence at SEQ ID NO. 95220
  misc_feature (757)..(757): n is a, c, t, g, unknown, or other
ctggagctccccgcggtggcggccgctctagaactagtggatcccccgggctgcaggaattcgtctcacccctagaaaaaaccccagtaccccaccccacccacaacggctgggacgtggcttcacttcacgttgagcatcctctctttccttttttcccccaaactccaaatccaatccaagcaactcctccccatgctcctcccgctcctcctcctcgccgccttcctccatggcttggcggaggcgcagggcggcctcccgtcgctgccgatcggggtgaactacggcgcgaacgcagacaacctaccctcgcccgccgccgtggcggcgttcctggccaagagcacgaccatcgaccgcgtgaagctgttcgacgcgaacccggccttcctcgacgcgttcgccgccaacgcgccctccatcgccctcgccgtctccatccccaactccgccctcccgtccttcgccgacagatccacgggcctggacgcggcgcgcgggtgggtccgcgacaacctgtccccgcacgtgtccgcgggcgccaacatcaccctcctcatggcggggaacgaggtgctgggccccaccgtggtgcccgacctcgtcgtggcgctgctcccggccatgcgccgcctgtaccaggcgctgcagctggagggcctgcccaaggtcgcgtcacacgccgcactacctcggcatcctggcgccctcggacgggatcccctcaacgcgagcttctgccgggggctggagnccaggtgctgccgcccatgctcagggtcaacaacgacaccggctcccccttcatgttgaaggctacccctatttagttacaacgccacaccctgaa

SEQ ID NO: 95220 - protein, 206 aa, Zea mays
  misc_feature: Ceres CLONE 1585365
  misc_feature (27)..(206): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature (188)..(188): Xaa is any aa, unknown, or other
MLLPLLLLAAFLHGLAEAQGGLPSLPIGVNYGANADNLPSPAAVAAFLAKSTTIDRVKLFDANPAFLDAFAANAPSIALAVSIPNSALPSFADRSTGLDAARGWVRDNLSPHVSAGANITLLMAGNEVLGPTVVPDLVVALLPAMRRLYQALQLEGLPKVASHAALPRHPGALGRDPLNASFCRGLEXRCCRPCSGSTTTPAPPSC

SEQ ID NO: 95221 - DNA, 2121 bp, Zea mays
  misc_feature: Ceres CLONE 1585367
  misc_feature: Encodes the peptide sequence at SEQ ID NO. 95222
attttttcttcctctccaaaccgtgtaaataaacgggaaccttctctcctcccccttttgggttcggtcctcctccgcccgtcgccgtcgtcaaacctcaagcgcgacgtgtgtaaaacggcggcgcagcgcgctatagccccgcccaaaccggcgatatatatatatgtaataacggcccgcgccttcggcagacgccaataacagactcagactatactcgcagcagaaaggttagttagctcgccgcgcgcggggggtcgaaccgagactcttcgtcgcgcgcgccgcagggccagcccagcaggcggcggacgcgaaagcttgctccgtgttcaccggcggcacgggccgtcccggcgatggaatccttcggtgtccctcctgcgcccgtggcggcgccggagaagaggaagaagccgctcgacctcaaggaccccgtccccgccgccgctgccaacggcggcggcgccaccaaggcgtccccggcggcgaagtgggcggagaagaagaagctggtgggcggcgacgccggctacgtgctcgaggacgtgccgcacctcacggattacctgccccagctcccgacatacccgaaccccctccaagacaacccggcgtattcagtcgtcaagcagtacttcgtcaacccagacgacaccgtcacgcagaagatcgttgttcacaagaccagcgccaggggcacccacttccggcgcgctgggccacggcagcgggtgtacttccagcccgacgaggtgaacgccgccatcgtcacctgcggcgggctctgccccgggttgaacaccgtcatccgtgagcttgtctgcggcctgtatgacatgtacggcgtcaccagtgtcgttggcattgagggtggatacaagggtttctattctaaaaacacggtcgcgttgacaccgagatcagtgaacggcatccacaagagaggcgggacggtcctgggaacgtcgagaggagggcatgacactgccaagattgttgactgtcttcaggaccgtggtattaaccaggtctatattatcggcggcgacggtactcagaaaggcgcctctgtgatttacgaggaagtccggagacggggcctcaaatgtgctgtggtcggcgtcccaaagaccatcgataatgacatcgcggtgatcgacaagtcgttcggatttgacactgccgtggaggaggcccagagggccatcaacgctgctcatgtcgaggctgagagtgcagagaacggcatcggtgtcgtgaagctgatgggtcgcaacagcggtttcattgccatgtacgctactctagctagccgcgacgtggactgttgcttaatcccggagtcgcccttctaccttgaagggaagggagggctccttgagtttgccgagagacggctcaaggacaacggccatatggtcatcgtggtggccgagggtgctggacaggatctcatcgcgaaaagcatgaattccgtggacacccaggatgcttcgggaaataagctgcttctggatgttggcctctggctatcccagaagataaaggatcatttcaagaagaaaccccgtttcccgataactctcaagtacatcgacccgacttacatgatccgcgccgtcagttcaaacgcttccgacaacgtctactgcactctgctagcccacagcgcgctccatggcgccatggcggggtacaccggcttcaccgtcgctccggtcaatggcagacacgcctacatcccgttctataggatcaccgagaagcagaacaaggtggtgatcacggaccggatgtgggcgagggtgctgtgctcgacgaaccagccctgcttcctgagccacgaggacgtggagaacatgaagcacgacgacgacgagcaccacctgcacaacacgctgctcctggactcgccggagaactcgtccaaatgaaatggggcggcagcggcagtgtgaagggggggcacaagacttgttttgcttttttgggtgctggcgttgtagagattagcgaccactatgatagggttggataatgtgagcatttggtaataatataagctcctgaagtaagctcgttttggctgttcgtgtattaaaaaaaaaaaaaaaa

SEQ ID NO: 95222 - protein, 525 aa, Zea mays
  misc_feature: Ceres CLONE 1585367
  misc_feature (136)..(387): Pfam Name: PFK Pfam Description: Phosphofructokinase
  misc_feature: SWISSPROT Homolog: EC 2.7.1.90 Diphosphate--fructose-6-phosphate 1-phosphotransferase
MESFGVPPAPVAAPEKRKKPLDLKDPVPAAAANGGGATKASPAAKWAEKKKLVGGDAGYVLEDVPHLTDYLPQLPTYPNPLQDNPAYSVVKQYFVNPDDTVTQKIVVHKTSARGTHFRRAGPRQRVYFQPDEVNAAIVTCGGLCPGLNTVIRELVCGLYDMYGVTSVVGIEGGYKGFYSKNTVALTPRSVNGIHKRGGTVLGTSRGGHDTAKIVDCLQDRGINQVYIIGGDGTQKGASVIYEEVRRRGLKCAVVGVPKTIDNDIAVIDKSFGFDTAVEEAQRAINAAHVEAESAENGIGVVKLMGRNSGFIAMYATLASRDVDCCLIPESPFYLEGKGGLLEFAERRLKDNGHMVIVVAEGAGQDLIAKSMNSVDTQDASGNKLLLDVGLWLSQKIKDHFKKKPRFPITLKYIDPTYMIRAVSSNASDNVYCTLLAHSALHGAMAGYTGFTVAPVNGRHAYIPFYRITEKQNKVVITDRMWARVLCSTNQPCFLSHEDVENMKHDDDEHHLHNTLLLDSPENSSK

SEQ ID NO: 95223 - DNA, 868 bp, Zea mays
  misc_feature: Ceres CLONE 1585369
  misc_feature (571)..(571): n is a, c, t, g, unknown, or other
  misc_feature (618)..(618): n is a, c, t, g, unknown, or other
  misc_feature (686)..(686): n is a, c, t, g, unknown, or other
ctggagctccccgcggtggcggccgctctagaactagtggatcccccgggctgcaggaattcgtctcacccctagaaaaaggatgacgccgcacgcacgaggtgcaagtgcaaacgaccgcgtccgagtccggatccgccaccaccgcgccctcgccgcactacaggcacgtggagcccatcggcggtgagccggaggctggagcacgcgcggcggtggcggcagcggctgcgcttgcggcggaaggaacggggtggggattcgaatcgaaggagcagcggcgatctactgttcccttgtattatgcccgcaactttacttctcaaagccaaagtatatgttgaagaatggcttggagctaacagtactgacaccaacttttggttatgatcagaagcgactggagtgcagtaatgaatctctaattgtttgcaatataagaaccagatacctcattcaaatggtttttccatgttacagattggtagccaagaacaaagaggttagctagtggtgatatgcgataaagttttcatatatacaaccataaagctgagaattgtggtctgcnaataatacagttttcctttctcatatgtattgtacttagagcacccnattctagtgataaacatggccagtttaaaccgatttctcaaccccccaaattgggctatttccacaantaacttgatccacaaaacaaacccctttggccggtttaagccaaaccctttttcccctccctttcgggtcccatagtttgggggtttggggaccccttaattgggacccgggggatttccccaaaacccgggagaaaatactaccgggcgggggaaaaaaaaatatttcttgtttttttttt

SEQ ID NO: 95224 - DNA, 855 bp, Zea mays
  misc_feature: Ceres CLONE 1585370
  misc_feature: Encodes the peptide sequence at SEQ ID NO. 95225
  misc_feature (450)..(450): n is a, c, t, g, unknown, or other
gagctccccgcggtggcggccgctctagaactagtggatcccccgggctgcaggaattcgtctcacccctagaaaaaattgcccattccgttcacaaattcacttctctctctctccgtcgagatgcttcgtggctccgccgccctcctccgccgcctcgcccctcatatctcgggcggtggctgcggaaacacgactcaccggcgccttcttcctcccatcgcccccttcctccgcgcccgcttcttgtctgccccgactacctcttcaccgccttcttcgtcttcagctgcctgccacgaggaggatgcggaggacagagacctccccgagatctccaatggtgatgcaggtgcccggctcagcatctccgtcgaccgctccgggctctacaaccccacagagcactcgcacgagccgtcgtcggaatccgagctcgtcaagcacatncagagcatcataaagtttcggagtgggccaatcagcatagctgaatacatggaggaagtgctgacgaacccacagtcaggattctacatcaaccggtgacgtgtttggggaatcaggggatttcatcaccctccacgaagttcaccaaatgtttgggaaagataattggggtatgggcaattggccccctgggaaccaatgggaaaccccgccaaagggaaacttaattgaccttggcccaaaaaaaagaaaccttttggggaatttcctttggggaacccgcccaatttttttaaatttccccggggcctgggggataaactttttggggggggggccccctcttttgcaaaaaaaccccgataaaatctcccaaaaaggtagaaaaaaaaacctttggggggg

SEQ ID NO: 95225 - protein, 141 aa, Zea mays
  misc_feature: Ceres CLONE 1585370
  misc_feature (109)..(109): Xaa is any aa, unknown, or other
MLRGSAALLRRLAPHISGGGCGNTTHRRLLPPIAPFLRARFLSAPTTSSPPSSSSAACHEEDAEDRDLPEISNGDAGARLSISVDRSGLYNPTEHSHEPSSESELVKHXQSIIKFRSGPISIAEYMEEVLTNPQSGFYINR

SEQ ID NO: 95226 - DNA, 908 bp, Zea mays
  misc_feature: Ceres CLONE 1585372
  misc_feature: Encodes the peptide sequence at SEQ ID NO. 95227
  misc_feature (397)..(397): n is a, c, t, g, unknown, or other
ctccccgcggtggcggccgctctagaactagtggatcccccgggctgcaggaattcgtctcacccctagaaaaaagctcacggcctcacccgtccacccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggctgtagcgtcggttggacctcntgagcgtgcagagcaattaagcaaagcagggcttgggtaaatcattattgaaagcatctccccttttacatgtaaccttgcatacaatatctgttaagatgagttcactaaataaagttgtttcaaatagtggagatgcatgttcagtcttagctagtaaagtcacatcattaaatcccaatgcagcggagtttgtaccgtcatttgttaaaccatcttttggaaatggtacagttctagataagtcagatttcagggggttcttctggaaaaacaattctagatgggcctgaggcatcaaagtctaattacttcagaggaggaggccccccggttttggcataagcagcttccgggaagaatttatttccgacttcccttctttttgagaaaattaaacaaggcgccggaaaggtcccttgggggaattatccttgagaggccccccctttttttggggaaaattcccggtcgcttttcagagagaaatccccaaattttctttcccagt

SEQ ID NO: 95227 - protein, 64 aa, Zea mays
  misc_feature: Ceres CLONE 1585372
  misc_feature (20)..(37): Pfam Name: PAM2 Pfam Description: Ataxin-2 C-terminal region
MSSLNKVVSNSGDACSVLASKVTSLNPNAAEFVPSFVKPSFGNGTVLDKSDFRGFFWKNNSRWA

SEQ ID NO: 95228 - DNA, 909 bp, Zea mays
  misc_feature: Ceres CLONE 1585374
  misc_feature: Encodes the peptide sequence at SEQ ID NO. 95229
ctggagctccccgcggtggcggccgctctagaactagtggatcccccgggctgcaggaattcgtctcacccctagaaaaaatacaaccgcgcactccaaacgcgcacgcgctgttcgttcctcggccgctctctccaccccctccttctccgcccccaacagatctccgccggccgtgcggttccttaattcgccttctccgggactgtcggatctccgcggcggctgaggatgggcaactgctgcgtgacgcccaaagcagccgacgacgccggcggcggcaagaagcccaaggagctgaagcagaagaagggtaagaagccgaaccccttctcgatcgagtacaaccgttcggggcaggcgagcgcgccaaagctggtggtgctgcgggatcccacggggcgggacatcgcggcgcggtacgagctcggcgcggagctcgggcgcggcgagttcggggttacctacctctgcacagaccgcgcctcaggggaggcgctggcctgcaagtccatctccaagaagaagctccgcaccgccgtcgacctcgaggacgtgcgccgggaggtggagatcatgcgccaccgtcccaagcaccccaacatcgtcacgctcaggggacacgtacgaggacgagcatgccggtgcacctcgtcatggagctctgcgagggcggtgagctctttcaaccgcctcgtggcgcgggggacacctaccctgaagcggggctgcccgccttggttcttaccccctaatcttttgagggtcctgcccgaattttcccttaaaccttggaagtggatgccacgggggatctcttcaacccagaaaattttttttgggtttgccaaaacagaaaagaattctcgccggcccctttaagggcgcccttcggaattttgggggccg

SEQ ID NO: 95229 - protein, 216 aa, Zea mays
  misc_feature: Ceres CLONE 1585374
  misc_feature: SWISSPROT Homolog: EC 2.7.11.1 Non-specific serine/threonine protein kinase
MGNCCVTPKAADDAGGGKKPKELKQKKGKKPNPFSIEYNRSGQASAPKLVVLRDPTGRDIAARYELGAELGRGEFGVTYLCTDRASGEALACKSISKKKLRTAVDLEDVRREVEIMRHRPKHPNIVTLRGHVRGRACRCTSSWSSARAVSSFNRLVARGTPTLKRGCPPWFLPPNLLRVLPEFSLKPWKWMPRGISSTQKIFFGFAKTEKNSRRPL

SEQ ID NO: 95230 - DNA, 1209 bp, Zea mays
  misc_feature: Ceres CLONE 1585380
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
aataaaaatgaggcggggggagtgagattttttccctaatgcgcgcgagaatttgnnncaaaannnnnnccaaagctggaactccccgcggtggcggccgctctagaactagtggatcccccgggctgcaggaattcgtctcacccctagaaaaacgccccgctccgcgttccccgacgccagcggtcaccccacccaactcctgtgagctgtgacacagatgtcctcctccccccactccaggcgctcacccaccctccacttcccgccacaggaatccgccgccataatctccatccgctccgctccaccccgcattgcaagattgcgccaagcaggagacaccctcctcaccgaagccactttctttgctctggctttcggtggtatggtgggatgatgagcaggggatgctatgctgcagtatctccacagcggcctcgccgggatcggcgagcggcctcagtggacccccccacgggcaaggcggcggagccgatcatgctccctggaacacgcccagggcgggtacacctaggccagcggggctggcggggaagtggtacagttcgcggcaaacacaacctgaaagaaaccagctaggcaaatctttttcttcccaactccgagggggggttttcagccggccacaacagggggatggggcccccttggggggtctttgccgagcttaaagaccggggtgatttctattcgtgcagccggcctccctttctccctgcgattagggcgggggcgacccgaggagggctctccggggcggatcgaattggtgctccgttagaggcgggtgaaccctatcatatacctctcgcagacccaatgcgggcgcaaccaattacccgcgaggggccttgatcgttatgctcctccggcgcgaagaattcgggaacactgtgcgtaccgccctaagaccctcttactggcgtttgagatcctacccatttcagtatttgccaaagtctgtgtttatattctcgaggcctccaatataactggatgcattccttttggggaggccgcccctcatctggcttgttttatagacgaaagttttcgaaccccccatagcaaaaagagacacttatgtccatacggtggtgcgttttctcttccgcaacgttacgtagagtcggaatgcgtcacccggagcggttcagtaagtgttaagaagacacccagccgtga

SEQ ID NO: 95231 - DNA, 1196 bp, Zea mays
  misc_feature: Ceres CLONE 1585382
  misc_feature (60)..(60): n is a, c, t, g, unknown, or other
  misc_feature (61)..(61): n is a, c, t, g, unknown, or other
  misc_feature (64)..(64): n is a, c, t, g, unknown, or other
  misc_feature (66)..(66): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (490)..(490): n is a, c, t, g, unknown, or other
  misc_feature (711)..(711): n is a, c, t, g, unknown, or other
  misc_feature (807)..(807): n is a, c, t, g, unknown, or other
  misc_feature (910)..(910): n is a, c, t, g, unknown, or other
  misc_feature (1151)..(1151): n is a, c, t, g, unknown, or other
gtgggggtggcggagtgtggagaaaaaaaatacgaaggggcccaaccaacaaccgcctanntgntntnnnnnnncaaaaactggagctccccgcggtggcggccgctctagaactagtggatcccccgggctgcaggaattcgtctcacccctagaaaaaatccgaaaccaactgacatcgccccgcagccaagaagctcggctcagctcagctcagttggttcctccattttgagtggaggactgactgtcctcccgtcgcccgtctcgcgatgctgatggggttccccgtggggtactcggagacgcccaagctgctgctgcacctcctcttcctcctcgaccacctgcgccgcctctcctcctggctgctccgcctcgcgggcgccgccgacgccgacgccgacaccgacgccggccaccctcgccacccctgcgccgccgcccagcgcctggaggagcactccccctcgccctccgcttcgactcncctgtcctggcggaaagcggaaggagggggtgaacggcgcccgcgcccccgctggcccgaagggggctgcctgcgttctggccctggggggcgaactttccaacgcccgaccgggccggaagggggcccccccccggccccccggggggctggccggccccaccggtttttttccaaccccggcggcccttggcccattccgaaaccccggcttggtgggncccggcccgaacaaccggggggcccaaacgccggctaagactcttggggccacccggcgcccttcctgtaaccctgaggaaaaaacagccccccgncttattcccattttccccccgggcgcgcggaagttggcccccgctctttggccccgccaccgtgggcccccgcccgtggggccccccctctctcccccgcgtntatggtgcccgcactcacctctatctctataaggcgagatttccgctgaggagaaatataccccctctcccccaaaaaccctgtggtttgggggggcaccttctttgtggtgtgcccaagaaagagagaggaaaaccctgttgtccgacatttcacaacgtggtggggcgctttggcgggggagggttttggcgtaataggagaaattttttcttagagaagagaaataaaccgagagggngcgcgcccccgcggtgtgtagaaaaaagggagcgccccctcccca

SEQ ID NO: 95232 - DNA, 844 bp, Zea mays
  misc_feature: Ceres CLONE 1585387
  misc_feature: Encodes the peptide sequence at SEQ ID NO. 95233
  misc_feature (682)..(682): n is a, c, t, g, unknown, or other
  misc_feature (683)..(683): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (746)..(746): n is a, c, t, g, unknown, or other
ctggagctccccgcggtggcggccgctctcgaactacaggatcccccgggctgcacgaattcttctcacccctagaaaacacggacacgcgtcctggagtatcagccggacgggcgtatatcacatatacagctctcttatgtcacttcgctgggtcatgatatactgatgcatcctcaggtaggcctgcactcccgtgacgccatacatctatcttgcgttgaacggctgtgggaagtctactcctctcacagctataagctgcagagaactttgtatgtgtgaacacatggacatatacgatcgaatgcctcagatcaaaccttctgacgtgcacacactgcttgctgttgttactagcaaccaagaacgccccttcttcgatacgcagctgacaatctagctgcgcattatcatagctcgagtcaagttttgcgagcagagtatgatcatctagctggaatgctgctcgaactgcagaaaaactggctgctcaatatatctgggggcgggggtttagaaaccactttctaaataaggaaactaagaatttctctggaagttcgcctttaaagattttcttttgcaaaagcactttttgtaattcccaacatcccttttgctggaaacccccaaaaacctctgaaattttaagccttttggaattttttgaaagaaaaannccaaaaaatttcnnnccccccccttttttttgtctatttgacccggnnnnnnnnnnnnncccnccaggggtcccacgggggggcaaagtttcctttccccaaaaaaaacccgaaggattcccaccgcggaaatttagactcccctgtttaaaaacctccct

SEQ ID NO: 95233 - protein, 41 aa, Zea mays
  misc_feature: Ceres CLONE 1585387
MCEHMDIYDRMPQIKPSDVHTLLAVVTSNQERPFFDTQLTI

SEQ ID NO: 95234 - DNA, 763 bp, Zea mays
  misc_feature: Ceres CLONE 1585388
  misc_feature: Encodes the peptide sequence at SEQ ID NO. 95235
  misc_feature (386)..(386): n is a, c, t, g, unknown, or other
  misc_feature (462)..(462): n is a, c, t, g, unknown, or other
  misc_feature (499)..(499): n is a, c, t, g, unknown, or other
  misc_feature (598)..(598): n is a, c, t, g, unknown, or other
  misc_feature (646)..(646): n is a, c, t, g, unknown, or other
ctccccgcggtggcggccgctctagaactagtggatcccccgggctgcaggaattcgtctcacccctagaaaaagcctgcctgtggtcgcctgtatcacaagctcccaaaaccgccgcgcacgctgccaccaccggtacccaacgaacatggcggcggcgccgtcctccctcgcctcctcgtcgcatatcccccgccgcgccacagccacggccccagcacagtcgcactcgcctccgttgccgcagcagctccgccccgccaggtccttcaaacgcggggcgctcgcgcagcacgtccggtacagctttgccggcagggaggcatcgaggcggcgcacaccaggtgcttgcttcgtggtctcatccagccagccaggccttgctngccatcgatgtgccggcagcgactattcctgatgccacgacgacaagcgtcactgagcggacttcggtttcatctncttttagaggttgtatcggaggacttgctcagccttnaacacaatctgaaatcgcttggttgtgcagaaaatccagtttttagttcctgcagctgaacaaattttttgggtgctggtggaaaaaagattaagccangcattggtttttccctggggtcaagaagcaactgctgaaattagcttngtttgtcggaaagttaactgccaaaccattcgaccccttggggcaaaaaaaaatccggaatgaattcccccccgggcgaggtttaaaaacacggaaggagggccaaaaaggaaaagg

SEQ ID NO: 95235 - protein, 89 aa, Zea mays
  misc_feature: Ceres CLONE 1585388
  misc_feature (80)..(80): Xaa is any aa, unknown, or other
MAAAPSSLASSSHIPRRATATAPAQSHSPPLPQQLRPARSFKRGALAQHVRYSFAGREASRRRTPGACFVVSSSQPGLAXHRCAGSDYS

SEQ ID NO: 95236 - DNA, 1254 bp, Zea mays
  misc_feature: Ceres CLONE 1585391
  misc_feature (57)..(57): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (67)..(67): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (1117)..(1117): n is a, c, t, g, unknown, or other
  misc_feature (1130)..(1130): n is a, c, t, g, unknown, or other
  misc_feature (1151)..(1151): n is a, c, t, g, unknown, or other
cggattagattttttcgtaattttcatgggaggcgccgctgggcacctccccgcaantttnnngtgnggnnnnccaaagctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgggcaccaccggggccggcgggttccccagcagtgtgggcactgaggaacacgggtagggcgcgtccacgggcccccccctatgtgggcgtgggcctcgggaaagagagccaaccaagaggccgcccctggggacgatcgtaggaattggaccttccgctcttcatagggccatcggctgagcaaagggggagctctcccggcggggtggggtgggagggtccacgggcaggaaaaaacctgggggagggtcctggcgcggaaccccgacctaagggggaggggcccgcgccaaggaggcctcctcgccgctatttcgggggaagatagggggaaccgtgggcgacattacgctaagaaggcgtccgtacgaggtactaaggcgggaaggttcggaccccgcgctcatacggagggggggaaaaagatgcggcgagacggtaggcacctcgcggctcccaaagaaaaacttgatgcttagtaccaaggaaagagggagggaggggcccaggcgaggagaagtgatctatgggagatcggccgcagaggagtgctgacacgccgtcgacaatctatgcgtcacgctaataatcggaggtcccaccgacacgacggggagtcggggacgtgctacggtgaggatatttcggggagaatcggaggagagaagcgggtgcaatgtgaagaggcgccaacgtaagtatatgggtggaggcacattgaatgagcggaggtgaactgggnccggaagtcggcnagataataagagaggcgagcncgtagctacctctcccccgtgtcataatagtgcacagatgggattcgtgtgcacggggcttggtcgcgtcagcggtccatactatgacggcaatgggaaatct

SEQ ID NO: 95237 - DNA, 866 bp, Zea mays
  misc_feature: Ceres CLONE 1585394
  misc_feature: Encodes the peptide sequence at SEQ ID NO. 95238
ctccccgcggtggcggccgctctagaactagtggatcccccgggctgcaggaattcgtctcacccctagaaaaaccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcccccgcgccatcggccaggtgtgccaggtgatcggcgccgtcgtcgacgtgcgctacgatgagggcctcccgcccatcctcacggcgctcgaggcgctcgacaacgacatccgcctcgtgctcgaggtggcgcagcaccttggcgagaacatggtgcgcaccatcgctatggacggcacggaggggctcgtccgcggacagcgcgtcctcaacactggagcccccatcaccgtgcctgatggcagggctacccttggacgtatcattaatgttatcggtgagccgatggatgagaaggtgatataacgacaaaccacttcttcctattcatcgtgaagcccctgctttcgttgagcagggcactgagcagcaaattcttgttactggaatcaaggtcgtggaatctcttgcacccctacaaagaagtggaaaaattggtctattcggtgggtgcagaagggggtaaaattgtgctcattag

SEQ ID NO: 95238 - protein, 179 aa, Zea mays
  misc_feature: Ceres CLONE 1585394
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGPRAIGQVCQVIGAVVDVRYDEGLPPILTALEALDNDIRLVLEVAQHLGENMVRTIAMDGTEGLVRGQRVLNTGAPITVPDGRATLGRIINVIGEPMDEKVI

SEQ ID NO: 95239 - DNA, 901 bp, Zea mays
  misc_feature: Ceres CLONE 1585398
  misc_feature: Encodes the peptide sequence at SEQ ID NO. 95240
ctggagctccccgcggtggcggccgctctagaactagtggatcccccgggctgcaggaattcgtctcacccctagaaaaagaaccctcgcgccgccaccgccgccgtctagcattttcctacacccaatctgatctgaccaagccctctgaacaccaccgcccatcctcctcctcctccgccgccgccgcccaagatgggcttcgacgtgggcctcgtcccctacaaccccgacgggtggggtccacctgaagttgccgccgcgccgccttccctcggtggtggctcctcgtctgtccccttcgctcccttctcccgctccgacaagctgggccgcatcgccgactggacgcgcaacccgccgggccccggggctttcgccgcagctcgcgacgccgtcttcgatttcgcggggctcgaggactccatcgggctcgcgtccgcggacgactcgtccttccgcctcgtcgatggcaaaccgccgccgcggcacccgcggtttggacctcgctggcgcttccagcagcggccccaactcccgcagcgccgcgacgaagaggtcgaggctcggcgtcgcgaggccgagaaggagcgcgcccgccgcgaccgccactggcagcagaaccgccgcacgcaccaccagttcaaccgcggcgggccctcctcgtcgtctgcccaaacgtcccgtgacatccagccccgagtggtcggtgaaaggagcagatccctttctcatcctttctcaagctctccttcgccgtcgccgaacagcccgaggattctctcgttctgtggcgcagtcgagtactacgaccggacctacgatcggcgtcacccccaggcccgagcgttcgcttcgagccgcttaagtcgcggaaactctttcaggtcccacctaccga

SEQ ID NO: 95240 - protein, 235 aa, Zea mays
  misc_feature: Ceres CLONE 1585398
MGFDVGLVPYNPDGWGPPEVAAAPPSLGGGSSSVPFAPFSRSDKLGRIADWTRNPPGPGAFAAARDAVFDFAGLEDSIGLASADDSSFRLVDGKPPPRHPRFGPRWRFQQRPQLPQRRDEEVEARRREAEKERARRDRHWQQNRRTHHQFNRGGPSSSSAQTSRDIQPRVVGERSRSLSHPFSSSPSPSPNSPRILSFCGAVEYYDRTYDRRHPQARAFASSRLSRGNSFRSHLP

SEQ ID NO: 95241 - DNA, 891 bp, Zea mays
  misc_feature: Ceres CLONE 1585399
  misc_feature: Encodes the peptide sequence at SEQ ID NO. 95242
  misc_feature (622)..(622): n is a, c, t, g, unknown, or other
ctggagctccccgcggtggcggccgctctagaactagtggatcccccgggctgcaggaattcgtctcacccctagaaaaagcgcaatcaaactgcggtggccaaccccggaagcggcggcgggcaaagcgcgcgacgcagagaagcgtaacttcaggccgccggtcgctctacgcatcctgctccccgttctcgtcggagatccaccggggcagcctttctttccccttcctcaatcaagtcgatccaatttcgcgcgcgggtcgggctcgccttctcctccagtctccacctccaccagcgctcgaggtcgacggacgctactcgcagcagttcttctttgcggtgcggccgagaagaagctaaggctcaggcatgagcttccgggaccaggagagtggcggggaggatgggggcaggacgtcctccgcctccgacctgcggaagccgctcatcaacaccgggagctggtaccgcatgccgccggcgggtggcgtgatgggctcgcggcaatccagcctcatggagcgcttgggctcctctgcgttctctctccgcgacgtcgctatctcggccacgctctgcacgcttattgtcgcgctaggtcccatcccagtcggttncacatgcggctactcctcggcccacgcagacgcccatcatgctgatctcgggctcttcctctccggagtcctccttctcgggtcattatctaatgaaggggccaatgtaggcccccatttccggggggcaacttgcaaataaatcgcccgaagggggtctttatggatgctggcaatccaaacaaaatgggggggtccgagatctttccaaaagattcccttttttggttatggggcggctgcaaaaggtttgggatccgggataaact

SEQ ID NO: 95242 - protein, 129 aa, Zea mays
  misc_feature: Ceres CLONE 1585399
  misc_feature (83)..(83): Xaa is any aa, unknown, or other
MSFRDQESGGEDGGRTSSASDLRKPLINTGSWYRMPPAGGVMGSRQSSLMERLGSSAFSLRDVAISATLCTLIVALGPIPVGXTCGYSSAHADAHHADLGLFLSGVLLLGSLSNEGANVGPHFRGATCK

SEQ ID NO: 95243 - DNA, 879 bp, Zea mays
  misc_feature: Ceres CLONE 1585400
  misc_feature: Encodes the peptide sequence at SEQ ID NO. 95244
ctggagctccccgcggtggcggccgctctagaactagtggatcccccgggctgcaggaattcgtctcacccctagaaaaaaccacccgccacgcccccgactcccacgaactcctccgcctacccacccctaccctacttctctcgcccgccggacgcatctcggggctctgctccccggttctcggggccggtggatgcgaccgcgtccccgcccccgaaatcagctgcccggcgtcctcatagcgttcccgggatctaggccctgagcaatggcagcggcggtggcgccgccgctctgcacctggctcgtcgccgcctgtctctccgcggcctgcggcgatggcgagaaggagaatgaacgcaggcaccgcggtggcggcgtagggggtttcttcggctcgcgccgccgcctcggctcaaggcgccgcggcgtggggcgctctggaatggccatgtctgttgccttgcatcctgaaaggacagctgtggaaaataagaaacctgatatgaaacagaggagagtggttgtcactggcatgggtgtagtgacgccactagggcatgatcctgatgaattctacaataaccttttaaggtgtatcagtggaataagcgagatagaggcatttgattgttctcactatcccacgagaatcgcgggagaaatcaaatcattttcgacagatggtttgggttgcaccaaagctagctaagcgaatgggacagtttatgcaatatttgaatacagctggaaagaaagcattggagaatgctggaatccctgaagaagtcttgaatgagttggaaaaatccagatgttggagtccttcattgggtctgctatgggttggcatgaagggttttcagtggaggcatt

SEQ ID NO: 95244 - protein, 147 aa, Zea mays
  misc_feature: Ceres CLONE 1585400
  misc_feature: SWISSPROT Homolog: EC 2.3.1.41 Beta-ketoacyl-acyl-carrier-protein synthase I
MAAAVAPPLCTWLVAACLSAACGDGEKENERRHRGGGVGGFFGSRRRLGSRRRGVGRSGMAMSVALHPERTAVENKKPDMKQRRVVVTGMGVVTPLGHDPDEFYNNLLRCISGISEIEAFDCSHYPTRIAGEIKSFSTDGLGCTKAS

SEQ ID NO: 95245 - DNA, 943 bp, Zea mays
  misc_feature: Ceres CLONE 1585402
  misc_feature: Encodes the peptide sequence at SEQ ID NO. 95246
ctccccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatcccccctgcaggcggcatcaagaagttctccgctgcttactcgaactgcgcgaggaagccatcctgatatctctgtcgtcatcccccatcctagtagcgtagaaaccacctgcattttcattttgatctcccctaatcccctccggctagctggctttcccagtgaccaaaagatattcaaggaacccctttcccggtcttccctccccggggggctgtctggtcattcgggctcttaaaaccaatgggcagttccctgcaaagttgcttgctgctggccccttcccccctggtttctgtggaattgggggtttcaagggaatttgaaaaagcccccctttggaatacagctttccttgaagggcccctgtttttcggggtgaccccccccgggaaaggggaattgccgtgtccccttttccgggggccccaaaaaaaacacttgtttttttggaacctttgcctgggggcccccattgggtgggcgaaactttttaaaagagaggagctctggccacccttagggcccgtttgcggggggtgagccg

SEQ ID NO: 95246 - protein, 51 aa, Zea mays; identical to SEQ ID NO: 81362
  misc_feature: Ceres CLONE 1585402
  misc_feature (1)..(51): Pfam Name: AdoMetDC_leader Pfam Description: S-adenosyl-l-methionine decarboxylase leader peptide

SEQ ID NO: 95247 - DNA, 2034 bp, Zea mays
  misc_feature: Ceres CLONE 1585404
  misc_feature: Encodes the peptide sequence at SEQ ID NO. 95248
aagacccgtcccactccaactccaggccatctccctacgcctcagacctcggtgcaaacctgccgcgaaaatagcagccgcccgttcgctctcccactcctcccgcgatgagcgacccgcggggccacgccgccggtcccgaccgtgacggggacgacccgctcgccgaggacgccaacagcgaggaagcgtggcagacgcccgagaaagagccggttgccgtgtcgaaagaggcggctgcgcggggtggggacacgaccccggacgccgaaccggagagcgatgacggagagggaggagtgggctccccggatcagatggagcccaatgcggacggggagcgcgcaccgcccgtggccgcggctgaggacccggaggggattgttggcagcgcaaaggtggagacgaacggcgaggacgccatcagccttgacgccgacggggaggaggaggacgacgatgatgacggagacgaggaggaggaggaggacgacgacgaagacgactccacccctgatgcgtctccgagggccgaggtgaaggtggagggcgagagctccacggggatgacccagagtggcgccggccaccgcgtggaggtggaaccggaccccttcctcgacggtgatgactctgggacggaggaggagcaaggtgcgttcatggcggagctggagcgcttccatagggagcacagtctcgagttcaagccgcccaagttctacggcaagggcctcaactgcctcaagttatggaggcaggtcgcccacctgggaggccacgagcaggtaacggtttgtaaactatggcgtcaagttggagagactttcaggccaccaaagacctgcacgactgtttcttggtcatttcgaattttctatgagaaggcacttcttgaatacgaaaaacacaaggtccggactggtcagcttcagataccaccgcctggtttaccacagcctagtggtgctgaccgtgaggtggttgtaaatcaatcatcttctgccagagttagaagggatgctgcagcacgtgctatgcagggttggcatgctcaccgccttctcacaaatggcacttatggggataacattttgaaggacaaagatacaatgccacttccaaatcgtgataaaaacctaagctttggggtgctcaagagaaagaaagcatctagtccagagtatgctctcaagtcgtcccgctcaaaaacaaataagtcacaggaagattctatggtcgttgacgttggagaaccagccgactgggtgaagatcaatgtgcggcagactaaagattgctttgaagtttatgcactagttccgggacttctacgagaggaggtgcatgttcaatcagatcctgctggacgtctggttatcacaggggatccagagcagcctgataatccttgggggatcactccgttcaagaaggtggtcaacttgccatcaagaatcgatcctcaccaaacatccgctgttgtcacgcttcatggtcagctattcgtgcgtgcaccatttggtcatcctgatatgtagatatgaaatcctgtttacttcagttttgttgactggcgatgcctcgtcatcagtgatattccttgatattactagggtttatgtcaattctgttgaggaaataggattttgtttgagcagatacatgatgtcatgctgacttagctgaaccgttctgtggttggatgctgattgctgttgttgccatctgttatcaccttgtttattactccctccgttcttttttatttgttgtggtttagttcaaaattgaactagaggacgataaatatttgagaacggaggtagtattacagtagtggccataaagttagctgattcatgcatgtattccagtttcatggtgagattttatagagaaaggagatgttgttcgtagtagggctaatttgacattatgattacctattgtttattatttttcttctgtattataaatggctctctgggtcactcccaggcgccttaatgttgtaaaaaaaaaaaaaaaaaa

SEQ ID NO: 95248 - protein, 477 aa, Zea mays
  misc_feature: Ceres CLONE 1585404
  misc_feature (176)..(284): Pfam Name: ARID Pfam Description: ARID/BRIGHT DNA binding domain
MSDPRGHAAGPDRDGDDPLAEDANSEEAWQTPEKEPVAVSKEAAARGGDTTPDAEPESDDGEGGVGSPDQMEPNADGERAPPVAAAEDPEGIVGSAKVETNGEDAISLDADGEEEDDDDDGDEEEEEDDDEDDSTPDASPRAEVKVEGESSTGMTQSGAGHRVEVEPDPFLDGDDSGTEEEQGAFMAELERFHREHSLEFKPPKFYGKGLNCLKLWRQVAHLGGHEQVTVCKLWRQVGETFRPPKTCTTVSWSFRIFYEKALLEYEKHKVRTGQLQIPPPGLPQPSGADREVVVNQSSSARVRRDAAARAMQGWHAHRLLTNGTYGDNILKDKDTMPLPNRDKNLSFGVLKRKKASSPEYALKSSRSKTNKSQEDSMVVDVGEPADWVKINVRQTKDCFEVYALVPGLLREEVHVQSDPAGRLVITGDPEQPDNPWGITPFKKVVNLPSRIDPHQTSAVVTLHGQLFVRAPFGHPDM

SEQ ID NO: 95249 - DNA, 1025 bp, Zea mays
  misc_feature: Ceres CLONE 1585406
  misc_feature: Encodes the peptide sequence at SEQ ID NO. 95250
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (442)..(442): n is a, c, t, g, unknown, or other
ctccccgcggtggcggccgctctagaactagtggatcccccgggctgcaggaattcgtctcacccctagaaaaattggagactgccgggggggggcctggtccgttccttcccgcaccccagatcctccgtcccaaaacggcagcttccggaggtctcccgtctccctgctccttccggcgcgacgggtggcccggctcgcggatccggcggtcttcggtcgacggcgaggcggcgctcgtcttggatcgggagtggttgctgaggcgcggagatggtggccgaggcggaagtcatgcatcaggcccccgtgccggtgctggaggtgcagtaccaccggcgcgcgacgaccaagggggttgacgacgtcgtcgggatgtccgcgcgcgcccccgcggaggttggggttggggttggggggttgagggcnnngnnnngtttgntgctggttttgtgggtggtgtggtttggttgttgggggtgggggggggttgggtggtggtgggggtggtggggtggtgtttgtgggggtgttttgtgaggggtgtgggagcgaggggacgattgaaaatgtatgttgagtggatagtgggtgatgattatagaggttagagtgagtggatatggaggagatttttgtgtatttgtgcacgcgtaaccgctagggtacttttttcctagcggttctcctctttcactccgtccgccgattggcgtctagtgtattcttgttcctcacccgttataagttgcatcctgggtggcagctcgacatctaatatctgcccgtaggggtggctggtgcgggtatggaccatagattctcacatcaaagacagagctgtgtcccccgtgttgactactcgctgtatgtatggcccatggcagacgagtggggcggtcgcttaggccctcgggcgcctatctcgcgcggtatgtgcgcagtcactacgctgtgtatggtgaggacgacggtagctacatggacattggtgtataaaggggttgtcacatagcatcagcttg

SEQ ID NO: 95250 - protein, 88 aa, Zea mays
  misc_feature: Ceres CLONE 1585406
  misc_feature (53)..(53): Xaa is any aa, unknown, or other
  misc_feature (54)..(54): Xaa is any aa, unknown, or other
  misc_feature (55)..(55): Xaa is any aa, unknown, or other
  misc_feature (57)..(57): Xaa is any aa, unknown, or other
MVAEAEVMHQAPVPVLEVQYHRRATTKGVDDVVGMSARAPAEVGVGVGGLRAXXXLXLVLWVVWFGCWGWGGVGWWWGWWGGVCGGVL

SEQ ID NO: 95251 - DNA, 903 bp, Zea mays
  misc_feature: Ceres CLONE 1585407
  misc_feature: Encodes the peptide sequence at SEQ ID NO. 95252
  misc_feature (903)..(903): n is a, c, t, g, unknown, or other
ctccccgcggtggcggccgctctagaactagtggatcccccgggctgcaggaattcgtctcacccctagaaaaagcgggcgagaccgatcagatccacctcagccgtctcggatggcgtcagcatcgacggcggtgcggatgctccccgacggcggcgctgacgacgaggagcggtggctcgccgagggcatcgccggcgtccagcaaaacgccttctacatgcaccgcgccctcgattccaacaacctcaaggacgcactcaagtactcggcgcagatgctctccgaactgcgcacctcgcgactatcgccgcacaagtactacgagctgtacatgagggcgtttgatgagatgaagaagctggagatgttcttcagggaggagtctcccccccccaactgctctgtggttgatatgtacgagcttgtgcagcatgctgggaatgtcttaccgagactctatctcctgtgcacggtgggatctgtgtacatcaaatcgaaagaggctcctgcttaagatgttctttaagatctcgttgaaatgtgccgaggcattcagcatcccccttcgtgggctttttctgagaagttatcttttctctaataagcagagacaaattgcctgatattggttcccagtatgaaggggggagcttaaactatttaccgacccaggtgaatttggttcctcagaaatttcctagaaatgaaccaactctggggttcggatgcaacctttgggggcctgcccaaaaaaaggaaaaacctggggaaaggaaaaaaatgaaactgccgggaatttggtgggcaaaaaccttttatgttcctaaagccacaattgaggggggttgtaccctgggatttgtcacaagaaaactgttctttcccgggatatttagaggn

SEQ ID NO: 95252 - protein, 134 aa, Zea mays
  misc_feature: Ceres CLONE 1585407
MASASTAVRMLPDGGADDEERWLAEGIAGVQQNAFYMHRALDSNNLKDALKYSAQMLSELRTSRLSPHKYYELYMRAFDEMKKLEMFFREESPPPNCSVVDMYELVQHAGNVLPRLYLLCTVGSVYIKSKEAPA

SEQ ID NO: 95253 - DNA, 1049 bp, Zea mays
  misc_feature: Ceres CLONE 1585408
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (49)..(49): n is a, c, t, g, unknown, or other
  misc_feature (52)..(52): n is a, c, t, g, unknown, or other
  misc_feature (53)..(53): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (305)..(305): n is a, c, t, g, unknown, or other
  misc_feature (318)..(318): n is a, c, t, g, unknown, or other
  misc_feature (790)..(790): n is a, c, t, g, unknown, or other
  misc_feature (816)..(816): n is a, c, t, g, unknown, or other
aaaannngggggcccccnnnnnnnnnnnnnnnnnnnaaaannnnnaaanaannccccnnnnnnnnnnnnnnnnnnnnnnnnnnnnnnnnccagactggagctccccgcggtggcggccgctctagaatagtggatcccccgggctgcaggaattcgtctcacccctagaaaaaccacagtcccactcctctctctctcgcgctctctctctttcatcgccaccaccgccgtgaaatccgcacgcgtgcttcctgtcgatttttgagctgtgactgtgagcgccatggccgtggaagctgtgtccngaaatggcaccgnagcagtggcccgcgcgcccgcgaaaggagtgagcacaagccaggcgtctttccggaaggaaagcaactttcttggaccatctcagggaaaccgaacgttaaggcccttgcccaaacttcccgaaaaaggtcaagggcgccccctcggggaagggaaaactttttccccaaacgggaaacccccaaaggttaagggggaaaaggaaaaagggaaaaggggggggcccccaaaaaaaaaagggggggggaaaaaaaaaaaaaaaaaaacccccccccaccccccccaaaaaaaaggggggggggggggtttacccacgggggggggcccccccccccccccgggggggaaaaaaaaaaaagaggcccttcctttttaaaaaaggggagaaaaaaaaaaaaaagggcccccccccccaaaaagagggggggaaaaaaaaaaaggggggcgcccccccccgaagaaaaaaaaggtntagggaaaaccccccccccccccttnttggcgcgcccggtggggggggagaaacaccccgccccccccccagccaaagggggggggaattaaagaaaaagacccccggaaaccggccgcccctcttttgtttttttctctaaaaaaagaaaaaacaaccaccccctcgggggggggggggggggttttttttctttttctcctcccccggggcgggaggaaggagaacgcccccccccccccccgtggtgtgttccttt

SEQ ID NO: 95254 - DNA, 908 bp, Zea mays
  misc_feature: Ceres CLONE 1585410
  misc_feature: Encodes the peptide sequence at SEQ ID NO. 95255
  misc_feature (773)..(773): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
aaagctggagctccccgcggtggcggccgctctagaactagtggatcccccgggctgcaggaattcgtctcacccctagaaaaagcagccagactactagactcggcatctccgccgctcctctctccacccggcgcgcgcgcacacacagcacagacacctacagtcaccacacgcgccatggccacgcactcggtcgccgccgcgcacgccaccatcgccgcgcgcgcgggcgccgccggggcgccggccccggccgagcgcctgggcttccgccgcctgggctcgcccgccggcggcctgcgctccgcccgccgcgcgcagctcgcggccgcctcccgccgccatcgcgtcgtgcgcgccgccgccgtcgagacgctccagggcaaggccgccaccggtgagctgctcgagaagtcggtcaacacgatccggttcctggccatcgacgccgtcgagaaggccaactccggccacccgggcctccccatgggctgcgcgcccatgggccacgtcctctacgacgaggtcatgcgctacaaccccaagaacccctactggttcaaccgcgaccgcttcgtcctctccgccggccacggctgcatgctccagtacgccctcctccacctcgccggttacgacagcgttaaggaggaggacttgaagcagttcaggcaatggggaagcagaacaccgggccaccctgagaactttgagactccaggagttgaagttacaccggggcctctgggtcagggtatcgccaatgccgntggggtggcacttgctgagaagcacctggctgcccgctcaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 95255 - protein, 212 aa, Zea mays
  misc_feature: Ceres CLONE 1585410
  misc_feature (76)..(235): Pfam Name: Transketolase_N Pfam Description: Transketolase, thiamine diphosphate binding domain
  misc_feature: SWISSPROT Homolog: EC 2.2.1.1 Transketolase
  misc_feature (198)..(198): Xaa is any aa, unknown, or other
MATHSVAAAHATIAARAGAAGAPAPAERLGFRRLGSPAGGLRSARRAQLAAASRRHRVVRAAAVETLQGKAATGELLEKSVNTIRFLAIDAVEKANSGHPGLPMGCAPMGHVLYDEVMRYNPKNPYWFNRDRFVLSAGHGCMLQYALLHLAGYDSVKEEDLKQFRQWGSRTPGHPENFETPGVEVTPGPLGQGIANAXGVALAEKHLAARST

SEQ ID NO: 95256 - DNA, 890 bp, Zea mays
  misc_feature: Ceres CLONE 1585411
ctccccgcggtggcggccgctctagaactagtggatcccccgggctgcaggaattcgtctcacccctagaaaaatagaaaaatatcacaaacaactcagcagcatctgatgtaactgggccaactaataatctacgcttctgccaaaatttagcttgcagggctattctcagggacaatttttgcagacgctgttcatgctgcatttgttttagttacgatgataacaaggacccaagcctctggttgtcatgtagttcagaccaacacttacaaaaggatacctgtggtttctcatgccatcttgaatgtgctctaaaggatgaaagaacgggtattctgcagagtggacaaggcaagaaacttgatggtggctattattgcattcgctgttggaaacagaatgatttgcttgggtgctggaagaaacagctggtgatagcaaaagatgctcgacgattggatgtattgtgtcatcggatttatctcagtcataggatccttgtctccacagagaagtacttggtattgcatgatattgttgatacggcattgaagacactggaggctgaggtcggtcctttatctggagctcaaatatgggtcgtggaattgtcagtcgacttactgttggtgccgaagttcagaaactttgtgctcaagcagtagatgctgtagaaatactgttctcgggtgtatctactgctagatcaaaaatcagcaggcatgcatgatgcgaccaaactttgtaaagtctgaagctataccccaacatccgtcatgaaattcttggattggcgtgattgtcctatgcatggccaaaaggcaacattcttttaatatctggcaccgaggggctggttacttgaatcgaaccgatcaaatcggatg

SEQ ID NO: 95257 - DNA, 884 bp, Zea mays
  misc_feature: Ceres CLONE 1585412
  misc_feature: Encodes the peptide sequence at SEQ ID NO. 95258
gagctccccgcggtggcggccgctctagaactagtggatcccccgggctgcaggaattcgtctcacccctagaaaaaaccggcagccattacttactggtcctcactcccacaccaaccaaccaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatccacacgctgttgccaggtgtccttcagaggttcagcactgcagcagcagtagaggagcccatcacgccgtcagtccatgtgaactacacaaagctcctcattaatggcaactttgttgattccgcatccggcaagaccttcccaactctggaccctcgtacaggggaggtgattgctcatgtggctgagggtgacgcagaggacataaaccgtgcagtagctgcggctcgcaaggcttttgatgaagggccatggccgaagatgactgcctatgagaagtcccgtatcctactgcgggttggctgatttgatagaaaaagccaatgacgaagcttgctgcttttggaaactgggacaacgggaaagcatatgagccagccgccccagattgaaagtcccccatgggggccccgccttaatgcctaacaaggctggttgggggcggaaaaaaatccatggggctccattgtccccggctgaggggcccaaaacca

SEQ ID NO: 95258 - protein, 140 aa, Zea mays
  misc_feature: Ceres CLONE 1585412
  misc_feature: SWISSPROT Homolog: EC 1.2.1.3 Aldehyde dehydrogenase (NAD(+))
MARRAASSLVSRCLLARAPAGAPPAAPSALRRTVPADGIHTLLPGVLQRFSTAAAVEEPITPSVHVNYTKLLINGNFVDSASGKTFPTLDPRTGEVIAHVAEGDAEDINRAVAAARKAFDEGPWPKMTAYEKSRILLRVG

SEQ ID NO: 95259 - DNA, 1184 bp, Zea mays
  misc_feature: Ceres CLONE 1585413
  misc_feature: Encodes the peptide sequence at SEQ ID NO. 95260
  misc_feature (53)..(53): n is a, c, t, g, unknown, or other
  misc_feature (55)..(55): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
ccataggtaggagggggtaaaaaaacaaaaaaataattctaaccaaaaccaananaaannnnnnnnnnccaaactggagctccccgcggtggcggccgctctagaactagtggatcccccgggctgcaggaattcgtctcacccctagaaaaaattagcaccttcacggatccccagtctctacgcaggccgctctgttctgtcatcagttggcacaagctccttgtgcgcaaaagaacaactgcgatctaagcaaaggagaatggcccccaccgttgctccggccgcgggctaccgagaggaccgagtgtacaagttcgcaaccggccaatccctcaccttcgccgcctttcgctccgacgtcctcaccacggccgtcgtcctcttctctcgtgcggaggtccggtgcggggacgtcgtcctcttcttcgtctccaatggcttcgactacgccgggctgattgtacaccaacattgcccccggcggcgttttctaacattggcaacccccctctacactcatcgagaaggttcgctaaatatggcacctgatgtccctgggaccaaagcttccccaattcagggggctactgaaagttcttccccaaaaatccgggggaggcctccttccctaacccccaaggagacccttgggttaaaaggggggaaggggggaaaatagagttaaatatgttgggcttcaaaagggctctggcacgccctcctaccgaaaagcgctctaatgcggggtagggccaagaggagctgtggaccgcgcttattttacaccatcagggaaaactctttgcttatgtttaccagggagggcgacccgcggggccataagaagagagggaagtttgtgcggcgctccgttgcccaaagcgctgcaccttaaaagggttataaattttgatccgccgcctcctccgccgtctctttttgtgaaatagtgcgttagccccgaaacaacgcaaccgggagtgcctccgatatcattgggtgcgctaaaataatctgtggacaagcacgcggagaaacttgttatttcttgtaacgggcgtgcctcaagttataaaaagatagtcgcacgggagggtgccctttttttaaaaggagggtcccacacctctgttttctctcctttatattccgcccaatggttccccacggtcggggggtgg

SEQ ID NO: 95260 - protein, 139 aa, Zea mays
  misc_feature: Ceres CLONE 1585413
MAPTVAPAAGYREDRVYKFATGQSLTFAAFRSDVLTTAVVLFSRAEVRCGDVVLFFVSNGFDYAGLIVHQHCPRRRFLTLATPLYTHREGSLNMAPDVPGTKASPIQGATESSSPKIRGRPPSLTPKETLGLKGGKGGK

SEQ ID NO: 95261 - DNA, 872 bp, Zea mays
  misc_feature: Ceres CLONE 1585414
  misc_feature: Encodes the peptide sequence at SEQ ID NO. 95262
  misc_feature (247)..(247): n is a, c, t, g, unknown, or other
  misc_feature (390)..(390): n is a, c, t, g, unknown, or other
ctggagctccccgcggtggcggccgctctagaactagtggatcccccgggctgcaggaattcgtctcacccctagaaaaaacatttccacggctcccaccagcgtgagtgcgtgaccagccccaatgccctccaaaccctagtccacagctcctgtaccctggcggccatgccggatctgagcaccagctacctccctcccttccctgaactgtccctcgatgcgggggccctcgccgtcgaccacngcggggaatgctgcagccgccgcctcggccgatgcggcgtcgcgtacgcgtctcgtctgctctgtggcagcgcgtagacgacctcgttattccagcggaatgcccggtgaaagggccatgttccgcacccttccaaaatgggnggggggcccgggcccctgtcacccactttgccccccccccccggcttgggcgccggaaaaaaactttcccggaattcccgccactcaaacccggccaggaaaccagggttttaaaaaatggggtttcaaaacttttaaggaaacccctttaaacaaaagggggccggctaaaaaaaagggaaaccggccccggggttttcccaaaacaacaaaaagggggggggggcggccttttttccaccccgggggggggcgccaaagggggggggcaaaaaaatccttttttttggcccccgaaaaaaattttttttttgtggggagaaaaaaaaaaaaaaaagtttctcttttaaaaaaaagggtcccccacaaatggtccccctcccccaaagggggggggtggggcgaaaaaaatcctctccacctttttcccccttaaaaaaaaatttttgggggggccccccaaaaggggggggggtgggggg

SEQ ID NO: 95262 - protein, 51 aa, Zea mays
  misc_feature: Ceres CLONE 1585414
  misc_feature (27)..(27): Xaa is any aa, unknown, or other
MPDLSTSYLPPFPELSLDAGALAVDHXGECCSRRLGRCGVAYASRLLCGSA

SEQ ID NO: 95263 - DNA, 864 bp, Zea mays
  misc_feature: Ceres CLONE 1585417
  misc_feature: Encodes the peptide sequence at SEQ ID NO. 95264
  misc_feature (739)..(739): n is a, c, t, g, unknown, or other
ctggagctccccgcggtggcggccgctctagaactagtggatcccccgggctgcaggaattcgtctcacccctagaaaaaattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggaatatgactgaacgcctctaagtcagaatccaagctagcaaccggcgcctctgctcgccgcccgccccgaaccacgttagggcgttcgcgccccaagggccctgtgcattggctcagccccgccgggcgacgcgcccgcggcgggctgctcnaagctccttcccaacgggcggcgtgctgaatcctttgcagacgacttaaaacgcgacggggcattgttaggtggcagagtgcctttgctgccacaatccactgagaatcagccccgcgtcgcaga

SEQ ID NO: 95264 - protein, 39 aa, Zea mays; identical to SEQ ID NO: 74949
  misc_feature: Ceres CLONE 1585417

SEQ ID NO: 95265 - DNA, 1056 bp, Zea mays
  misc_feature: Ceres CLONE 1585420
tcaccgcggtggcggccgctctagaactagtggatcccccgggctgcaggaattcgtctcacccctagaaaaactctcgattcgctctcacccatccggcctatcctgggagtagtgttaacagcgccgcaacacctcgtgccgtgggaggtcgagctcctcgatgcgacgctcctcggagaggagcgcctcctcctgcgcggacttcttatggcgcgagggccggcgggaccgagggcgccgaggaggaggcagcggcggaggagctagggtaagggttcgccgccgccgtctgacctgctgcgtcgaggttgctggggtcggaaccggtagctgctgcggctgaatgcgcggagaccgccgacgtgccggccttggagaggacgtgcgcctgctcttcccggcgcttctggagatgcttctgctccggctccgaccgactcacgaagctcttggcccccaaagtcgaggcgtcgcccgccttccggcttcttctgcagtttccgggttttggcagaatccatttacgggcgggccgatccagtcgggctttccgtttctcctaagagggcggggaaacccggggcccagtggcttgtcggataaaccgggtccgttgtaaccctgtttcccccccaaaaaaggagggagggaactccgacccccaaaggttagggatttggtgtttggggtgggccaaaaactatatataacaatcgggggccaaattcttgggttaacccggaacaatgttttaggaatctgatccgggggggacacgggtgcccggcccttttggttggccgggtattttggccctggtggagggggaggaggcgaaccccctctcacgaggccgcggggagggtttctctcgtggttgtagggggttctcctcgcactggggggaggtggtctctttctcggaggggcattatctcttgtaaggagaacgagagaggcggtgggtcgtccctcggcctcctccggatacggagaaaactctctgcttgtggcgcaggttggctcgtaaagttgttttgcaaggtgtgcccg

SEQ ID NO: 95266 - DNA, 1038 bp, Zea mays
  misc_feature: Ceres CLONE 1585421
  misc_feature: Encodes the peptide sequence at SEQ ID NO. 95267
ctcaccgcggtggcggccgctctagaactagtggatcccccgggctgcaggaattcgtctcacccctagaaaaactcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtctcaggtacaagcgccgcaaggtcgccatccttctcgggtactgcggcgcggggtatcagggcatgcagaagaatccgggcgcgcgcaccctcgaaggggacctccaggaggggttttgggggcccccccccagccccaaggccgaccggtcccgcgccgcgccggtacgattgggcacagtgtttggagccaccgacaaggggcgctcaacgcccccggctccggggggggggccggggcgctttctagtttgaaacccgcgggggctttcattcgattgcgttttgaaggggcccagcttggagggcccggaaaattcctggcggcctatacggataatcgcgggggcccgtgtttcgccatacttttattttcttgccgcgaaaaaaaaggagtttctgggtgccaccgcccccgcgaggaggtgccccctgggatattcgctccctcccgcgcgcggattttttgtgctctttggggtatcccgcgcggtgcgaaacctcgggggaaagcgcgtgagggcgcgttttttgggtcagacccttgggggcggggtgttgagactaatatcttatccaaaggttgcctgtgggggccccccccaagagaaggggggggtaaattcttgtgtgttttatggggcacggcaggggagtaaagtcctcctcccccgccgcagaagagagggtatagtccccccgcgggggggaggacctcccggtgaatttttagagactggggggggagaatattatctccgatgtttt

SEQ ID NO: 95267 - protein, 130 aa, Zea mays
  misc_feature: Ceres CLONE 1585421
  misc_feature: SWISSPROT Homolog: EC 5.4.99.12 tRNA-pseudouridine synthase I
MAAASPPPSPPHAKRPKMSSSSDPEADAEPTSASAAVEGADPAQRRLRYKRRKVAILLGYCGAGYQGMQKNPGARTLEGDLQEGFWGPPPSPKADRSRAAPVRLGTVFGATDKGRSTPPAPGGGPGRFLV

SEQ ID NO: 95268 - DNA, 905 bp, Zea mays
  misc_feature: Ceres CLONE 1585423
  misc_feature: Encodes the peptide sequence at SEQ ID NO. 95269
  misc_feature (820)..(820): n is a, c, t, g, unknown, or other
caaaagctggagctccccgcggtggcggccgctctagaactagtggatcccccgggctgcaggaattcgtctcacccctagaaaaaaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcaccacgacgagaacgtgcagaaggtcgtgaagcggctcaagcagaggaacccgaagaaggacggtcttgtttgcacggccaggaagccctggatcgctgttggcatgcgcaacgtggactacaagcgtgcgaggcatttcgaggtcgacctttcttccttcaggaacatccttgagatcgacaaagagaggatggttgccaaggtcgagccccttgtcaacatgggtcagataaccagagctacctgcccaatgaaccttgcccttgcggtcgtcgccaagcttcacaacctcactgtgggtgggctgatcaacggtttacgggatccaggggagcttttcacctctatgggctttttcctccaacccggttgtccccggatggaagtttgttctctcaaaaaggagccgggtccttcatnaaccccccagggaacaacgaggtacctcctgaacctttttctatagggattttcccttgggccccgagggaaacaattggggtgt

SEQ ID NO: 95269 - protein, 216 aa, Zea mays
  misc_feature: Ceres CLONE 1585423
  misc_feature (202)..(202): Xaa is any aa, unknown, or other
MADVHEPLVRRKRKKVLVDYLVKFRWILVIFVVLPISTLIYFNIFLGDMWSAMKSEKKRQKHHDENVQKVVKRLKQRNPKKDGLVCTARKPWIAVGMRNVDYKRARHFEVDLSSFRNILEIDKERMVAKVEPLVNMGQITRATCPMNLALAVVAKLHNLTVGGLINGLRDPGELFTSMGFFLQPGCPRMEVCSLKKEPGPSXTPQGTTRYLLNLFL

SEQ ID NO: 95270 - DNA, 891 bp, Zea mays
  misc_feature: Ceres CLONE 1585425
  misc_feature: Translation starting site: 253
  misc_feature: SWISSPROT Homolog: EC 3.5.2.2 Dihydropyrimidinase
tccccgcggtggcggccgctctagaactagtggatcccccgggctgcaggaattcgtctcacccctagaaaaagagcagattgggtgggacggcggagggagccctttgcgccgtcacaaatcgcaaccaatcgccgagttgcttgtgttaaatagctcttcgcgtacgacacggcaagcgggctgcgacggcgactttctcatctgctcactgctctgcttctccactccgctccgctggcagcgcaggccatggcgacacaggcgctggcgccctccctccgcctcctcctgctgctaccgctgctcgccgccgccgccgccgccgccgcgttgtctcacccagcgcacgagttctgcgcggtcgggggtgacgcctccggctgcggcggcggaggagacggcacgaggatcctgatcaagggcgggacggtggtcaacgcgcacctcgcggaggaggccgacgtctacatcgaggacggcgtcgtcgtcgccgtccgcccagacatcccggttgatgttgataatgtcagggtaatcgacgcaacaggaaaatatgtcatgccaggtggaattgaccctcacacgcacctgggagatggagttcatggggcacgtggacatagatgacttctttcgcgggcatgctgcggcactggccggtggggaccacaatgcatattgactttgtcaatcccgtgggacggcaactttgatgcccgggttggaagtcctacaacacaaaggcgccaaaaactgccatgggatatgggttttccctgggccattacaaaaggggaatgaataagttttcaggggaaaattgaaagttatggttaaaaaaactggggaaaaaatttcttttaagtttttcctgggcgtataaaaggg

SEQ ID NO: 95271 - DNA, 1155 bp, Zea mays
  misc_feature: Ceres CLONE 1585426
  misc_feature (1155)..(1155): n is a, c, t, g, unknown, or other
ggagctccccgcggtggcggccgctctagaactagtggatcccccgggctgcaggaattcgtctcaccccctagaaaaaagtcgtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatcgtcaccccccccaatgggaggggcggcgtccacacaaaccggagggaaggggggcaatggccgcccggggcacggcccactctggacactggggtcggccgccgcgtgtcttgttctgccggcctgctaactcctgaatgatccccaatacgaaaagcacttttttgcccccgggccggaaacccgcctgctgggtgggcgcgggttttatgctttcgggcgaatgcggcccacccggcctatggtgtgttgacggggggaacctcggggcatttggggaggtgcattctggggagaatggaacctaattgggcgttggtgttggcctgcaagcggggggctgtgtataaaagtagacgcgcgccacctctgacaacgcgacaagagagaggctccgcggggtgtttcaacaaatatacacagtagagggcggggattatgtgttccattccgggttatgaggggagttggggatgtggaacaccacgcggtcgggtgatactaatggattacgcctcggacctgctcggctgaagtaaaacaatattcacctcttacaatctaagggtggttgcgtatataagaatactgggcagaagtgagcagcggggaatggtgactctatatggtattagtagtacctccgatcagagcacgatctggcggtgggtagaggtaagactgctgcttctctgtccgggatcgaagtgcgggtcggctctctctttaataattgagagcgagctagtacgtgaaagaagagtn

SEQ ID NO: 95272 - DNA, 876 bp, Zea mays
  misc_feature: Ceres CLONE 1585431
  misc_feature: Encodes the peptide sequence at SEQ ID NO. 95273
  misc_feature (803)..(803): n is a, c, t, g, unknown, or other
  misc_feature (804)..(804): n is a, c, t, g, unknown, or other
ctggagctccccgcggtggcggccgctctagaactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtacctccaccccaaggacggcgtctacccggagaaggtcaaccccggcagggagggcgtcggccagaactccgcagcatcggcaagacgtcaccccatcgacgtcaagtcacgggcagcccacttcgactatcaacactcacgtacgcgcaccccccagccggatcaaaataaagaaactctcctccanntatacaggaaatgtaattagctgctgggacggtggtgcatgattgagatgggcatgaggaacttggggtatt

SEQ ID NO: 95273 - protein, 223 aa, Zea mays
  misc_feature: Ceres CLONE 1585431
  misc_feature (62)..(197): Pfam Name: PsaD Pfam Description: PsaD
  misc_feature (217)..(217): Xaa is any aa, unknown, or other
  misc_feature (218)..(218): Xaa is any aa, unknown, or other
MAMATQASAATRHLLAAAWAPAAKPRQLSSQLALPSSSSRGPAPLRASTEEAVEAPKGFVAPQLDPSTPSPIFGGSTGGLLRKAQVEEFYVITWTSPKEQVFEMPTGGAAIMREGPNLLKLARKEQCLALGTRLRSKYKITYQFYRVFPNGEVQYLHPKDGVYPEKVNPGREGVGQNSAASARRHPIDVKSRAAHFDYQHSRTRTPQPDQNKETLLXXYRKCN

SEQ ID NO: 95274 - DNA, 898 bp, Zea mays
  misc_feature: Ceres CLONE 1585437
  misc_feature: Encodes the peptide sequence at SEQ ID NO. 95275
  misc_feature (653)..(653): n is a, c, t, g, unknown, or other
  misc_feature (697)..(697): n is a, c, t, g, unknown, or other
  misc_feature (705)..(705): n is a, c, t, g, unknown, or other
  misc_feature (763)..(763): n is a, c, t, g, unknown, or other
  misc_feature (792)..(792): n is a, c, t, g, unknown, or other
  misc_feature (827)..(827): n is a, c, t, g, unknown, or other
  misc_feature (865)..(865): n is a, c, t, g, unknown, or other
tggagctccccgcggtggcggccgctctagaactagtggatcccccgggctgcaggaattcgtctcacccctagaaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggttgatcgcggtgtcggagcccatatcgttcaagaaccccanggcgcccgtgtttccgcgcctggcgcagggcacgtcccacgacnagatgacngtgacgtggacccagcgctacgccatcgatgaggcgtacccgttcgtggagtggggcngccctggtcggccggcggcggggcccggnaacacgcggcgcgcgcccgccgggacgctcacttncacccgcggcagcatgtgcggcgagccgccccccaccntcggttggagggacccccgggtccatccacccc

SEQ ID NO: 95275 - protein, 249 aa, Zea mays
  misc_feature: Ceres CLONE 1585437
  misc_feature (168)..(168): Xaa is any aa, unknown, or other
  misc_feature (183)..(183): Xaa is any aa, unknown, or other
  misc_feature (205)..(205): Xaa is any aa, unknown, or other
  misc_feature (226)..(226): Xaa is any aa, unknown, or other
  misc_feature (239)..(239): Xaa is any aa, unknown, or other
MAVALLAALVASAAMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYQFANYSANYIYWGKGSIRLQLINQRSDFSFALFTGGLSNPRLIAVSEPISFKNPXAPVFPRLAQGTSHDXMTVTWTQRYAIDEAYPFVEWGXPGRPAAGPGNTRRAPAGTLTXTRGSMCGEPPPTXGWRDPRVHPP

SEQ ID NO: 95276 - DNA, 1333 bp, Zea mays
  misc_feature: Ceres CLONE 1585444
  misc_feature: Encodes the peptide sequence at SEQ ID NO. 95277
  misc_feature (57)..(57): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (466)..(466): n is a, c, t, g, unknown, or other
gttttgtgttcacgaaggggaatataaaaaatccaaaaaaaatttgcccaccccccncnnnnnnaaaaactggaactccccgcggtggcggccgctctagaatagtggatcccccgggctgcaggaatgcgtctcacccctagaaaaatcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggggtatcagggcatgcagaagaatctgggcgcgcgcaccatcgaggggggacctcgaggaggggctctacanacaacccccccgtgcccgaagcccaacgggtccgcgcccccgccgttacaaattggggcacgttgctggcccgcacccgacaaggggcttcaaccgcccccgggcgccaagggggaggtcccggggggcttttaaacgttcaaaccccacccggggctttcaattcgaatccgctttgaaacggcggactgtttacggggcacggcgggaattccggcggcccaaagcggggaagagggggtgtgcggtgtatacccaaaatctttaatattcgaactggctcggaagaaaaagaatttcggtggggggaaccgcgtcagcggaaaagggggtatccctgtgaacgagtttatatgggatttaacgcccccaagaagagatttaggcggcctccccttctggagaaacactcccacatgggtgtgataagacaagtatcttatggagaaaaccctctctcgaataggagacccaccctctccacagatgtgcgcggaggggactctcctaggctagacctgaatgtgctgggggagcacatcgcgaactctgtaattatacacacaactggtgaccgctggtggtggaacgcgcctctctcaaagtcaggacatgtgtgcagcggtataagatattttcctcctgtgcttgtatacatcgtgcggccgcgcccggattgtcgaagtatacaaaattatatgtcacgcgggcgcccagacgagtttacagcagaggatgtcgtatctaactccgactcacccctgcgtgtggcaggagcatatgggacgcgcgtacaaattattacctgtcaagcaacgtccacgatgggtgattagacatgagtggcgcgcaccaggttacggagtt

SEQ ID NO: 95277 - protein, 131 aa, Zea mays
  misc_feature: Ceres CLONE 1585444
  misc_feature: SWISSPROT Homolog: EC 5.4.99.12 tRNA-pseudouridine synthase I
  misc_feature (87)..(87): Xaa is any aa, unknown, or other
MAAASPPPSPPHAKRPKMSSSSDPEADAEPTSASAAVEGADPAQRRPRYKRRKVAILLGYCGAGYQGMQKNLGARTIEGGPRGGALXTTPPCPKPNGSAPPPLQIGARCWPAPDKGLQPPPGAKGEVPGGF

SEQ ID NO: 95278 - DNA, 887 bp, Zea mays
  misc_feature: Ceres CLONE 1585445
  misc_feature: Encodes the peptide sequence at SEQ ID NO. 95279
  misc_feature (440)..(440): n is a, c, t, g, unknown, or other
  misc_feature (442)..(442): n is a, c, t, g, unknown, or other
  misc_feature (443)..(443): n is a, c, t, g, unknown, or other
gagctccccgcggtggcggccgctctagaactagtggatcccccgggctgcaggaattcgtctcacccctagaaaaaacccctccctccattccatcgtcttcgcttccactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgccatggcggtggagaagacgctgcccggcgcgagtgcggggaggaccgtgctggtcacgggcggggcgggctacatcggtagccacgccgtgctgcagctcctcctcgcgggcttccgcgccgtcgtcatcgacaccntnncacactcctccgagctgggccgtcgccgcgtcgccgcgctcgcgggggaccactccccgcacctctctttcccacagattgatcttcgtggacagggaccctggaaatggtttttgcttctacagatttgaagctgtctttccctccctgggatgaaagctggggttaaaacgtccaaaaccctttccttttttttgcaacacgctctttggcccaataaattttcaaaaattatttttgttcacggtccaaaaaatggggttccccccccccgcggcccgttttgggccccccaaaaccccccccggacaaaaaatttttctttttctccaaaaattttttgggggaaaaaaacctccgttttgaaaaatatttccgggggaattcccccccccccaccccgggggagaaaaatttttttgggggcgctccacaccggggggg

SEQ ID NO: 95279 - protein, 89 aa, Zea mays
  misc_feature: Ceres CLONE 1585445
  misc_feature: SWISSPROT Homolog: EC 5.1.3.2 UDP-glucose 4-epimerase
  misc_feature (46)..(46): Xaa is any aa, unknown, or other
  misc_feature (47)..(47): Xaa is any aa, unknown, or other
MAVEKTLPGASAGRTVLVTGGAGYIGSHAVLQLLLAGFRAVVIDTXXHSSELGRRRVAALAGDHSPHLSFPQIDLRGQGPWKWFLLLQI

SEQ ID NO: 95280 - DNA, 868 bp, Zea mays
  misc_feature: Ceres CLONE 1585446
  misc_feature: Encodes the peptide sequence at SEQ ID NO. 95281
  misc_feature (670)..(670): n is a, c, t, g, unknown, or other
ctccccgcggtggcggccgctctagaactagtggatcccccgggctgcaggaattcgtctcacccctagaaaagcgtccgccccgcgtcccgaaaattccccctctttttcctacttcccgtcccacggctcctacgccccgcgggcccaaaaccctagccggctaatccaatcctgcttcccgcccatggcctccgcggacgctgccaagcccgcgtccccgcccgccgcggatccgcccgtcgacgaccccatggacgccgaccccgcgccccacgcgggggaggaggagcaggccacgccgcagaagcagcagccggagaagaagcggggcggccggaggaagaagggcgaggcggcggagaagacgccgccgtcgtccaagaagtcggcgggccccacggtggagcgcccgtccagggagaggaagacggtcgagaggtacgcggagcttgcgccgcgcgccacacccgccaaaaagtcccccgctattctccaggggtctggaacgaagctcaaggacatacccaatgtttcatttaaactatcaaagagaaaggtggatgagaatctccagaagctccatactgtattgtatggggagaaaatcaaataacccatttctgaagaagaacatatctcaattttctgggttttgtttggacggatnattcagaaaaaccgagggaccggaataaaagaaaagcttgagaaatttaaacagggagaaattgcctgaattttggggaaattactggacgttattggtaaaagtacttttaaagaaagggaaaagttttctggccaggcccttgggaatttttggggaccctccttggggttacccgcgggaaggttgttccccccg

SEQ ID NO: 95281 - protein, 142 aa, Zea mays
  misc_feature: Ceres CLONE 1585446
MASADAAKPASPPAADPPVDDPMDADPAPHAGEEEQATPQKQQPEKKRGGRRKKGEAAEKTPPSSKKSAGPTVERPSRERKTVERYAELAPRATPAKKSPAILQGSGTKLKDIPNVSFKLSKRKVDENLQKLHTVLYGEKIK

SEQ ID NO: 95282 - DNA, 966 bp, Zea mays
  misc_feature: Ceres CLONE 1585447
  misc_feature: Encodes the peptide sequence at SEQ ID NO. 95283
  misc_feature (404)..(404): n is a, c, t, g, unknown, or other
  misc_feature (966)..(966): n is a, c, t, g, unknown, or other
aaagctggagctccccgcggtggcggccgctctagaactagtggatcccccgggctgcaggaattcgtctcacccctagaaaagcgtccgccccgcgtcccgaaaattccccctctttttcctacttcccgtcccacggctcctacgccccgcgggcccaaaaccctagccggctaatccaatcctgcttcccgcccatggcctccgcggacgctgccaagcccgcgtccccgcccgccgcggatccacccgtcgacgaccccatggacgccgaccccgcgccccacgcgggggaggaggagcaggccacgccgcagaagcagcagccggagaagaagcggggcggccggaggaagaagggcgaggcggcggagaagacgccgccgtcgtccaagacacccccnggccccacggttggagcgcccgtccagggagaggaagacgggtcgagaggtacgcggagcttgcgccgcgcgccacacccgtcaaaaagtcccccgctattctcccaggttctggaacgaaggctcaaggacataccccaatgtttcattttaaactatcaaagaaaaaagttggaataagaatctccaagagccttccatactggtatttgtattgggggagaaaaatcaaaataacccttttttctgaaaaaaaaaacaaaattctcaaatattttcttggggtttggttttgggaccggattaattcccagaaaaaaccgtagggaaccgcaattaaaaagaaaaagctttgagaaaatttttaacaaggggagaaggtttgcctagaattttttgtgaaaaaaaccggaacgtgtatttggtaaaaatgtaccttttaaaaaagagaaaagaagatttctttgtccaagcttccttggaaaatttttggggaattctcccttggggttacctcgcggaagggttgttttctccacgggaaaaaaaagaaaaggggagn

SEQ ID NO: 95283 - protein, 128 aa, Zea mays
  misc_feature: Ceres CLONE 1585447
MASADAAKPASPPAADPPVDDPMDADPAPHAGEEEQATPQKQQPEKKRGGRRKKGEAAEKTPPSSKTPPGPTVGAPVQGEEDGSRGTRSLRRAPHPSKSPPLFSQVLERRLKDIPQCFILNYQRKKLE

SEQ ID NO: 95284 - DNA, 955 bp, Zea mays
  misc_feature: Ceres CLONE 1585448
  misc_feature: Encodes the peptide sequence at SEQ ID NO. 95285
  misc_feature (955)..(955): n is a, c, t, g, unknown, or other
aaagctggagctccccgcggtggcggccgctctagaactagtggatcccccgggctgcaggaattcgtctcacccctagaaaaaagcagattgggtgggacggacgagggagccctttgcgccgtcacaaatcgcaaccaatcgcggagttgcttgtgttaaatagatcttcgcgtacgacacggcaagcgggctgcgacggcgactttctcatctgctcactgctctgctgctccactccgctccgctggcagcgcacgccatggcgacacacgggctggtgccctccctccgcctcctcctgctgctaccgatgctcgccgccgccgccgccgccgccgcgttgtctcacccagcgcacgaattctgcgcagtcgggagtgacgcctccggctccccccgtggaggacacggcacgaggatcctgatcaaaggcgggagggtgggcaacgctcacctcgcggaggagggcgacgcctacatggaggacggagtcatcgttgtcttccagccagaacgtccgggaggatggtgataaatgtggtggaaatcggaggcaacggggaaaatatgaacatgcccagggtggaaattgaaccctacccacgcacgtaggaagagtggagattttaagggccgccccgagaccgcattggattaacttgttttagcgctggctatgcctaagggcaatcgggtgggttggtagccctctaagtcaatgtttgacttgggtcaagtgcacggggtccgggcaaaccataacatgcgcgggataaggtatatctcccaagaagcgaaaatcctccaaaagattgtctgcagaagattttggcgttgtgcacgtgggacattccatatggagtagagagaggaggtatcttatcgagaaaaggagctaaagggcttaaaaatagcttaggataaatattcataagcggccttcgtatgctan

SEQ ID NO: 95285 - protein, 90 aa, Zea mays
  misc_feature: Ceres CLONE 1585448
MATHGLVPSLRLLLLLPMLAAAAAAAALSHPAHEFCAVGSDASGSPRGGHGTRILIKGGRVGNAHLAEEGDAYMEDGVIVVFQPERPGGW

SEQ ID NO: 95286 - DNA, 894 bp, Zea mays
  misc_feature: Ceres CLONE 1585450
  misc_feature (276)..(276): n is a, c, t, g, unknown, or other
  misc_feature (281)..(281): n is a, c, t, g, unknown, or other
  misc_feature (285)..(285): n is a, c, t, g, unknown, or other
  misc_feature (286)..(286): n is a, c, t, g, unknown, or other
  misc_feature (721)..(721): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (762)..(762): n is a, c, t, g, unknown, or other
  misc_feature (767)..(767): n is a, c, t, g, unknown, or other
  misc_feature (831)..(831): n is a, c, t, g, unknown, or other
  misc_feature (847)..(847): n is a, c, t, g, unknown, or other
  misc_feature (850)..(850): n is a, c, t, g, unknown, or other
  misc_feature (851)..(851): n is a, c, t, g, unknown, or other
  misc_feature (853)..(853): n is a, c, t, g, unknown, or other
gagctccccgcggtggcggccgctctagaactagtggatcccccgggctgcaggaattcgtctcacccctagaaaaaattccccttgcccatgcggtggttcccgcatccacttcgcccgcccgcccgctgcctgactgccattattgcctcccggtcttcgctgtccatccgaccgtccgtggtttctccctccggtccccgctacccgccccgccccgccgagaagcttcggactagctagcaagctagctagctacctacccgtgcttttggntcggntggnntgggcgccatagcccattgcccccaaggaaccccaggggggaaaccaccccggggggggggggaaaatcaaggaaggaggggggggaaaaaaaaaaaaacacattcttttgggggaaaacaacaccccccccccccgggggggggaaaaaaaaaaaagagaccgttgttttttttttcccccccccccccccccaaaaaaaaaaaaaaatgggggggggggggccccccccaaacaaaaaaaaaaaaaaagagcgcccccccccccccccccgccttttttttttttttttttttaaaaaaaaaaaaaaaaaaaaaaaaaaaaaaaaggccccgccctcctttttttaaaaaaacggcccgccccccccccccccaccgcaaaaaaaaaaaaaaaaaaaaagtgagtttttttgttgggggaggagggagaaggnggtnnnccccccccccccccccccccccccccccccccgcnggggnggggggggggggtgggaagtttgtttttttttttgttgtgtttaaaacggcggcggagaaaaanaacaagaacaaaaagnatnntntggtggggggggggtgggcgggggtggcggtgctcgaaaac

SEQ ID NO: 95287 - DNA, 869 bp, Zea mays
  misc_feature: Ceres CLONE 1585451
  misc_feature: Encodes the peptide sequence at SEQ ID NO. 95288
ggagctccccgcggtggcggccgctctagaactagtggatcccccgggctgcaggaattcgtctcacccctagaaaaattccccttgcccatgcggtggttcccgcatccacttcgcccgcccgcccgctgcctgactgccattattgcctcccggtcttcgctgtccatccgaccgtccgtggtttctccctccggtccccgctacccgccccgccccgccgagaagcttcggactagctagcaagctagctagctacctacccgtgctttggttcggttggttggcgccatagccattgccgaggagcgagggagcagccgggcgggcagtcaggaggcggcgagtaagcatgctgggagcgagccccaggggcaggaaggccgccgcgccgcccgccaagctggggtcggcgaaggaggcgccggcggccggtggaggagggagcggctgcaaggtgccggcggaggaggtgtgggaggtgcggcccggcgggatgctggtgcagaagaggggcggcggcgacgacgagccgtcgcccaacgtgaagcccgtgcccaccatccgggtcaaggtcaagcacgccggcgtcacgcacgagatgtacatcagttccgaggcctccttcgggaagctgaagaagctggtggccgccaagacggggctgcaccccgacgaacaagaaggtgctgtacaaggacagggagcgtgactccaatgcgttcctggacacggctggcgtcagagaccgctccaaggtggtggtgctggaaggcccccaaggcctgcgcgcgccgaatcatcgggggaagggccccaacggcacccttcagaagggctgccaggggccctttctccccggatcaccg

SEQ ID NO: 95288 - protein, 119 aa, Zea mays
  misc_feature: Ceres CLONE 1585451
MLGASPRGRKAAAPPAKLGSAKEAPAAGGGGSGCKVPAEEVWEVRPGGMLVQKRGGGDDEPSPNVKPVPTIRVKVKHAGVTHEMYISSEASFGKLKKLVAAKTGLHPDEQEGAVQGQGA

SEQ ID NO: 95289 - DNA, 1040 bp, Zea mays
  misc_feature: Ceres CLONE 1585454
  misc_feature: Encodes the peptide sequence at SEQ ID NO. 95290
caaagctggagctccccgcggtggcggccgctctagaactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaatgggttcgtggccccgcagctggaccccagcacgccgtccccgatcttcggcggcagcacggggcgggcccccccccgggggcgcaggtgggaggagttctacggtcatcacgtgggacctccccccaaagaagcagggggttccaagattgctcacccgggggggggccccccaattatggcggggaggggcccccaaacctcttttgaaacctgagccgcccccaagggagaacaagtgcccctgggcggcctccggggaacccaggggtttgcccccctcccaagggtacaaaagaaattccccctaacccagagttttgttacccgggggtgttttattccccccacaaagggcggaaagagggggcccaaaactcccctcccctcccccacaagggagaaggggggggttttacccccgcggagaaaagagggataaccttcccggcgagaggaggaaggagagtttcttgggacaaaaaaaattctcccgagatatattggggagaaaaaaagagtcacaacccccctttagaagggttaaggttttcccggggggaagggggccccccttgcgaaaataaaaacattcttaagcgtaacccccgaggccccccccgggggggggacaaaataaagaaaaacctccctcctctctattaaatccgcgggaatggtgagaatttccgcgcggggagacggggagggag

SEQ ID NO: 95290 - protein, 128 aa, Zea mays
  misc_feature: Ceres CLONE 1585454
MAMATQASAATRHLLAAAWAPAAKPRQLSSQLALPSSSSRGPAPLRASTEEAVEAPNGFVAPQLDPSTPSPIFGGSTGRAPPRGRRWEEFYGHHVGPPPKEAGGSKIAHPGGGPPIMAGRGPQTSFET

SEQ ID NO: 95291 - DNA, 881 bp, Zea mays
  misc_feature: Ceres CLONE 1585457
  misc_feature: Encodes the peptide sequence at SEQ ID NO. 95292
  misc_feature (534)..(534): n is a, c, t, g, unknown, or other
tggagctccccgcggtggcggccgctctagaactagtggatcccccgggctgcaggaattcgtctcacccctagaaaaaaaaaaactataggtctgggctagctatggccggtagcaacggcactctgctgctcgcactccgcatcgtcctcttctgcgccctcgcctccgtggccaccaccttgttcccgctcgtcacaaggccatgcgcctactccctgccaagaaccatcctcgccgccagcggcctcgaccctcacctcatctcctgcgccgacgacggctccgccaaggcccagctgtcggatggcgatggaggccacaacaaggccggtagcggcggcaggcccatagtcaccgacctgctgtcgtgcggcgagccccgcctcccatcccacgcgctcccgcccttccgctgctgcccgccgacgccggcgtccgacgctgccgtcgccaacttcacgttccccgacccaggcgagccgctccggacgcggcggccagcgcacggggccgccggcgcggacagcgtcnccaggtacgcgcgcgcggtggcgctgatgaaggcgctttcggagtcggacccgcgcagcttctaccagcaggccaacatccactgcgcctactgcacagcggcgtaccggcaggcggggcggccggaactgcacttgaaaatccacttcctcggggctcttcttcccgttcaccgggcctaactttattttttcaagcgcgtccgggcgagggtcctgggcgaccccggggttccccgtgccctttttggagctgggacattcccgaaagggaacccgggtgccccccgagaattccccaaacccgggtttcccccgtttttaaaacaccaaaaaggaaaccccgga

SEQ ID NO: 95292 - protein, 203 aa, Zea mays
  misc_feature: Ceres CLONE 1585457
  misc_feature: SWISSPROT Homolog: EC 1.10.3.1 Catechol oxidase
  misc_feature (144)..(144): Xaa is any aa, unknown, or other
MAGSNGTLLLALRIVLFCALASVATTLFPLVTRPCAYSLPRTILAASGLDPHLISCADDGSAKAQLSDGDGGHNKAGSGGRPIVTDLLSCGEPRLPSHALPPFRCCPPTPASDAAVANFTFPDPGEPLRTRRPAHGAAGADSVXRYARAVALMKALSESDPRSFYQQANIHCAYCTAAYRQAGRPELHLKIHFLGALLPVHRA

SEQ ID NO: 95293 - DNA, 867 bp, Zea mays
  misc_feature: Ceres CLONE 1585458
  misc_feature: Encodes the peptide sequence at SEQ ID NO. 95294
  misc_feature (610)..(610): n is a, c, t, g, unknown, or other
  misc_feature (633)..(633): n is a, c, t, g, unknown, or other
  misc_feature (689)..(689): n is a, c, t, g, unknown, or other
  misc_feature (690)..(690): n is a, c, t, g, unknown, or other
  misc_feature (715)..(715): n is a, c, t, g, unknown, or other
  misc_feature (769)..(769): n is a, c, t, g, unknown, or other
ctccccgcggtggcggccgctctagaactagtggatcccccgggctgcaggaattcgtctcacccctagaaaaaacccatccattccacctccgttcaccccgtccatttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggctgaaaaaccttggaaagggtatgctgcagccccaccagatcattgccgagtacaacaatgcgatccctgaggctgagcgcgagaagctcaaggatggtgcttttgaggatgtcctgagggcagctcaggaggcgattgtcatccccccatgggttgcacttgccatccgccctaggcctggtgtctgggagtatgtgagggtcaacgtcagtgagctcgctgttgaggagctgagagttcctgagtacctgcagttcaggnaacagcttgtggaaagaagcccntcacacaactttgttcttgagctggactttgagccccatcatggcctccttccccnngtcttctctgtcaaagtccattggncatggcgtgcagttccctcacaggcacctgtcatcaaagctcttcatgacaggnagagcatgtacccgctgctcaactcccttcgcgcccacaatacaaggggatgaccatgatgttgaacgaccgaatcgcagtctcagggcttctgcagg

SEQ ID NO: 95294 - protein, 194 aa, Zea mays
  misc_feature: Ceres CLONE 1585458
  misc_feature: SWISSPROT Homolog: EC 2.4.1.13 Sucrose synthase
  misc_feature (125)..(125): Xaa is any aa, unknown, or other
  misc_feature (151)..(151): Xaa is any aa, unknown, or other
  misc_feature (160)..(160): Xaa is any aa, unknown, or other
  misc_feature (178)..(178): Xaa is any aa, unknown, or other
MGEGAGDRVLSRLHSVRERIGDSLSAHPNELVAVFTRLKNLGKGMLQPHQIIAEYNNAIPEAEREKLKDGAFEDVLRAAQEAIVIPPWVALAIRPRPGVWEYVRVNVSELAVEELRVPEYLQFRXQLVERSPSHNFVLELDFEPHHGLLPXVFSVKVHWXWRAVPSQAPVIKALHDRXSMYPLLNSLRAHNTRG

SEQ ID NO: 95295 - DNA, 861 bp, Zea mays
  misc_feature: Ceres CLONE 1585459
  misc_feature: Encodes the peptide sequence at SEQ ID NO. 95296
  misc_feature (484)..(484): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (571)..(571): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (589)..(589): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (615)..(615): n is a, c, t, g, unknown, or other
  misc_feature (616)..(616): n is a, c, t, g, unknown, or other
ctccccgcggtggcggccgctctagaactagtggatcccccgggctgcaggaattcgtctcacccctagaaaaagtttgggtgtcgccgtcagaacgatacgccattgtccctgacgagaacgtccgtaaagcaggcggaggcacggcacgaggcaacggcgccgacgcgaacgtgccggagaacgacgtgaagaggatgcgcgtgcagtcgtcgtagtaggtcttctactaccgtccactccaccccacccccgttaaccctactactagtagtaagtactacgaagaaccggtgccccatctagcggcgcccgatttttgtgcgttacgttctgcctaaaagtgctttccgtcgacggacggacctcctggtgttgagatggtagcggtagcactgcctcgcggcgatggtgtgtgtgtgttgtgacctgattcacctcttagagtagagaggtggctagcccagtcgacctgtgtgtgttngtaagatgtgtcctggatcttttgtgacattgcatggaggggtacataagcgcttcgtttctcgtttcttccaaaaaaaannnnnanannnaaaaannnaaaaanaaaannnaaaaaaannnaaaaaaaannaaaaatcgccgtttggcttttgggcctcattttgggctttgtcccttggaagttcattctccccccaaccaggggaaaagagaatccccctcaaccttgtggttttgggccggttgacctcggcaaggccacccccccgggccccttttttacaagcttgggggcttgaccacgcgttgaatcaaaaggttcaaaaagggggctcctaaaatgaaaagggttccttcaaaaacccggggggtgca

SEQ ID NO: 95296 - protein, 71 aa, Zea mays
  misc_feature: Ceres CLONE 1585459
PRGGGRSRTSGSPGLQEFVSPLEKVWVSPSERYAIVPDENVRKAGGGTARGNGADANVPENDVKRMRVQSS

SEQ ID NO: 95297 - DNA, 958 bp, Zea mays
  misc_feature: Ceres CLONE 1585461
  misc_feature: Encodes the peptide sequence at SEQ ID NO. 95298
  misc_feature (340)..(340): n is a, c, t, g, unknown, or other
  misc_feature (372)..(372): n is a, c, t, g, unknown, or other
  misc_feature (397)..(397): n is a, c, t, g, unknown, or other
ctggagctccccgcggtggcggccgctctagaactagtggatcccccgggctgcaggaattcgtctcacccctagaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactancacatccagaaggagagcaccctccaccttgntctccgcctcaggggaggcatgcanatcttcgtcaagaccctcactggaaagactatcaccctcgaggtggagtcttctgacaccatcgacaacgttcagggccaagattcagggacaaggaggggcattccctccgggacgagcaggggtttattttttgctggcaagcaaccttgagggacggggccaccccttgggccaattacaaattccagaaaggggaaagccccccctcccccttggggggttgcgtcccaaggggggggcttggcaaaatttttggaaaaaccttggctgggaaaagattaccccccttggggggggagctcctcgaaaccctttgaaaagggcaggggccaaatcccggagaaaagggggggcccccctggggaacgggggggggttttttttgggcgggaaaaatttggggggggggggccccctttggcccaaaaaaaatttttgggaggggcgcctctcccctttggggccctcccggggggggggggggaaatatttttggagaaaaacttgtggagagaaaacccctcgggggggggcgcccccccacacacaaaaaaaaag

SEQ ID NO: 95298 - protein, 128 aa, Zea mays
  misc_feature: Ceres CLONE 1585461
  misc_feature (6)..(74): Pfam Name: ubiquitin Pfam Description: Ubiquitin family
  misc_feature (59)..(59): Xaa is any aa, unknown, or other
  misc_feature (70)..(70): Xaa is any aa, unknown, or other
  misc_feature (78)..(78): Xaa is any aa, unknown, or other
MQIFVKTLTGKTITLEVESSDTIDNVKAKIQDKEGIPPDQQRLIFAGKQLEDGRTLADXHIQKESTLHLXLRLRGGMXIFVKTLTGKTITLEVESSDTIDNVQGQDSGTRRGIPSGTSRGLFFAGKQP

SEQ ID NO: 95299 - DNA, 926 bp, Zea mays
  misc_feature: Ceres CLONE 1585462
aagctggagctccccgcggtggcggccgctctagaactagtggatcccccgggctgcaggaattcgtctcacccctagaaaaagaaccgcgaacagcagcatcctattcctcctacctcactggctcactctgtctcgtctcggtttacaaagcctccgccgccgcaagtccactccacccgttgtccaggttagttggttggtttcaatttcgagttcgccgagcgacagcttgcgcctgccatttctcggctccgcgtgccggagctcgttcatctccagcttctccggccgttagtcgctctgaaccgacgacagtaccgataaagccccgaactcgccaatcctccggggcgacgaatgccttcccgatcgggattcccgactccctgctggtgcggcgccaccgcatgcgcgaagcggggctggaataccaagggcgcccccgccaaacgcggggcccaccggggggtggaaggtcggcgcttcttcattaaaagggggggggaaatttcggaaacggtttaacttttttaaggggggtgtcggggaaaccttaaacaaaaatccctaaatggggccccccccgggggaggggagcacacggggggggggggggggggggggctaataaaaaccccttggaaaagggggggggggggacacttttttgtccctctttattggggggggggggcccctaccgaaaaaaaagggggttgttcccccctcccccccccaccatgagagaacgccctccccccctccaaaaaaaataataggtttggggggagaatttgggccttttttataaaaccggtggtccccgggggagggcgccgcccactgatggtccccgcgcgcgcgggggggggaaaaatatttgccccgccctctggggcctaaaagggagacacttttttttc

SEQ ID NO: 95300 - DNA, 940 bp, Zea mays
  misc_feature: Ceres CLONE 1585463
  misc_feature: Translation starting site: 167
  misc_feature: SWISSPROT Homolog: EC 1.4.1.2 Glutamate dehydrogenase
  misc_feature (386)..(386): n is a, c, t, g, unknown, or other
ctggagctccccgcggtggcggccgctctagaactagtggatcccccgggctgcaggaattcgtctcacccctagaaaaactctctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagtgtaaccgcaccacgccctcgtacgtcgccttcaccgactacgagcgcctcatcggagatgcggccaagaaccaggtcgccatgaactccagtcacaccgtctatgatgccnagcgtctcatcggcaggaggttcagtgatgcgtctgtccagagtgatatcaagttggtggcccttcaaggtcatttctgggcctggggagaagcccagggatggtgtcccagccaaggggggaaggaaaaccactttgcacctaaaaaaatccccccattgggttcttatcaaaaacccgggaaaatggttaaaccttcctttggtggccccatataaaaaagtttggggggcagggcccccggcccctcttcaaaaaacccacaaagggccggcccaccaaaaaacccggggggggaatgcgggccctaaaagggccccggtttccccaaaagaccaaaaaggggggggtttttccctttttttttttaaaaaaagagcacaaacgggccgggggagaagaggcgcccccccttttctttttggggggggggggccgggtttcctccccccccccccccccgggggggggtattttgttggggggggggcgccgcgtgggcgccccccttctttggggggggggggtgtttccccagggggggggcccctccc

SEQ ID NO: 95301 - DNA, 895 bp, Zea mays
  misc_feature: Ceres CLONE 1585468
  misc_feature: Encodes the peptide sequence at SEQ ID NO. 95302
  misc_feature (801)..(801): n is a, c, t, g, unknown, or other
  misc_feature (844)..(844): n is a, c, t, g, unknown, or other
gagctccccgcggtggcggccgctctagaactagtggatcccccgggctgcaggaattcgtctcacccctagaaaaaagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgcctaccctagtccaccacctgccgcagctctcgcctccgtcaagatccgaacccctcgcacgcggcacgaccaaatcctagacacctgatcccaatgcgcagggccctcggcagagagacgttactgcgccggcaccgtggatcggcactgctgtggctagctgtaacggcactggtcacaggcaccatctgcctctggtcgtccttctccgttggcctcctcagcacctacagggtccagggatgtgttgcaaatgagttgtggagaaccgtagattcaaatggttggagagcatcttctgcaccacgcatctggtggcctcccccacagctgaatctgagagcaatgggtacttgcgtgtctggtgcaacggcgggctgaccccacacgcagtgaatatgtaatgctngtgtcgtagcccgatcatgaatgctacctagtgctgcagaagntagacacaattcttttggcaccatgaaaggggtttgagaaaataaatgatg

SEQ ID NO: 95302 - protein, 95 aa, Zea mays
  misc_feature: Ceres CLONE 1585468
MRRALGRETLLRRHRGSALLWLAVTALVTGTICLWSSFSVGLLSTYRVQGCVANELWRTVDSNGWRASSAPRIWWPPPQLNLRAMGTCVSGATAG

SEQ ID NO: 95303 - DNA, 934 bp, Zea mays
  misc_feature: Ceres CLONE 1585470
  misc_feature: Encodes the peptide sequence at SEQ ID NO. 95304
ctggagctccccgcggtggcggccgctctagaactagtggatcccccgggctgcaggaattcgtctcacccctagaaaaagtaaaagaaaaaccgtccgtccgtccggggaaggagcggtagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacgaggaccacatcaccctcaaggactacgaggtccacgacggcatgtgcctcgagctctactacgactgagccgccgcccctctctccctctcgtcaggttggtctgaattctccagtcatgggtgcaattcgcttcgcggtgatctcttaagctcatcacatattataaagcaacttccgtgggctatggtagaacatgccgggccaaactatcggtgacaactgacggcttttcaaaaaattgtttgatgggtcaacctccaaacctgggggactggccccccgaccttaaacaaacaaggggtttaaaccttggtttgggtaaaaaaaagggttcccaattaaaccgccgttttaaattgggctctgggagcccccccctcccaatggtgggagggggggggagggggccccaaaaaaaaaaaatttttggggccttcgggtttggggaaaaaccctcccccccaactttgaaaaaagggggccccccctcttttggagaagaggaccccccccgggtgggaaaacaccggggggggggttgaaaagagaaaaacctccccaaaaagatatataacaacccccgcctattgagagacattaaaaaacaaccggggggtggttattttcttggggggcggcgcaccaa

SEQ ID NO: 95304 - protein, 73 aa, Zea mays
  misc_feature: Ceres CLONE 1585470
MIEVVLNDRLGKKVRVKCNEDDTIGDLKKLVAAQTGTRPEKIRIQKWYNIYEDHITLKDYEVHDGMCLELYYD

SEQ ID NO: 95305 - DNA, 913 bp, Zea mays
  misc_feature: Ceres CLONE 1585472
  misc_feature: Encodes the peptide sequence at SEQ ID NO. 95306
gagctccccgcggtggcggccgctctagaactagtggatcccccgggctgcaggaattcgtctcacccctagaaaaacctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacagcgtgtacctggccaccatcccccccaccgtgctggtgtgcggcgccgagctgggcagcctcagccgccacgagctgtggcgcaaggtgtggggggaggccacctacgacctcgccacggtgcacgccttcctcgccgtcctcgccttcaccatctgcatctacatgatgtacagggccaggcccgtgtacctcatcgacttcgcatgctaaaagccggccgacgagctcaaagggctcaaggggggagttcattgaacctggcgcgccaggtccgggaaggtccaccaggaacgcctgggggatccagtcgcgtcctgctgcccaagtcgggcatcggggacgagtcctacatggcccggtggcgggttccaaacccaaggcccggtggcgccaccttgaaagaagggcccccgcccaagggttccaagggacatgtttttccgggcctggagacaagcttgtttcacaagtgcccgggttcgggcccccaggaactgggggtttgccttgggggccaaattggcaacctcttttaaacccgaag

SEQ ID NO: 95306 - protein, 130 aa, Zea mays
  misc_feature: Ceres CLONE 1585472
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHSVYLATIPPTVLVCGAELGSLSRHELWRKVWGEATYDLATVHAFLAVLAFTICIYMMYRARPVYLIDFAC

SEQ ID NO: 95307 - DNA, 1333 bp, Zea mays
  misc_feature: Ceres CLONE 1585474
  misc_feature (57)..(57): n is a, c, t, g, unknown, or other
  misc_feature (66)..(66): n is a, c, t, g, unknown, or other
  misc_feature (419)..(419): n is a, c, t, g, unknown, or other
  misc_feature (770)..(770): n is a, c, t, g, unknown, or other
  misc_feature (914)..(914): n is a, c, t, g, unknown, or other
  misc_feature (1053)..(1053): n is a, c, t, g, unknown, or other
gtatattatgggtggtctgttgtttgccgtacacccccgcatcccttcctcttactnttttgcttnttttcaaactggagctcaccgcggtggcggccgctctagaactagtggatcccccgggctgcaggaattcgtctcacccctagaaaaacaagcgaatccctacctgctcgggaactacccgtcgggctcctcccgcccccctcgccgcatctgcatgcggcggggatctgcgggctcgctccgtcaccggaggcccaatcaccgccacctcatccaagcccccgaatcccccgggcgcgcagcacaaccttgccgcgatcgcgcgcgggaaccgccgctgattgggtcgcgaaagctcgattttgagcaattttagattcggagaacccaccgtcattcaatttgggcgcganatttgagagccgcgatggggtttcacaaacctaagaggaactgctgtaccatgaggtccccccccggtatcaatcgacgggaattcgcaacgctccgtggggcaaggccgctggtcctccgaggagggaattggacaggcaaaaggccaccaccccccccatataggtttgcccttgtaagggcgccccgtgcttctgaatctgacgaggggccccagggccgttgtgaatgcggattttggcgcaaactccagtggtgaatgaagaaacgtaccaagggaccctgggaggagaacacatctggcaaggggagcacacggacttatgttgttaccaagtcgggtgggtcgnacatgagaaaagtagatgtggtcttcattatctgactactctgaagtctcaccattcgatagacaagactgctcccccccgcgctgactcatggggctagtccgctcccattctcgacgcgcggcctctgcgaagagactacgngcgtaaaaagccccctattgtggcgaacgtgtgtcgagaagctactcggttgggggtacccccccacacggagagatatttggtggtcccgcggagagaagagcgagaaaagaggtgtgtctccacacattgattctgnagcgtcggtgttacattctactactacgtctgcgctcactctaaatactccggggggacacccccggctctataaaatgaatttaagaacttgttcggggggaggcaagatgggagagcttgtgctagcgatagaaagataaaatgtctgctctgcctataatgcttctctctgctcggagcctcaacattttgttctctctcccgacgagacgatcatatccgcacacggacacacatagaattgtgagtgggagttggtggtgcacatatccacgccc

SEQ ID NO: 95308 - DNA, 955 bp, Zea mays
  misc_feature: Ceres CLONE 1585476
  misc_feature (379)..(379): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
ctggagctccccgcggtggcggccgctctagaactagtggatcccccgggctgcaggaattcgtctcacccctagaaaaagccacctctcggcgcatcatcagctgtgcctgtgagctctctcattcaccggcaccgctgctcttgctcttgtgttcccgccggtccccaatgcccaggcaggcagcccagcacggtgtggtggtctgatccgcggcggcgcgcccgtcgctccctccgcgaatggctcctccagcagggacaggggcagggacggaggggaggccggcgcggcggcgcggcaccggcaccagccccggacgcaccaaggtgtgggtcgagccgccgggcaagaagcacggccaccaccaccaccaggntccgccgccccccgtccccgcccaagagggtggccgtggtctactacctctgccgcaacccggcactcgagcacccgcacttcatcgaaggtggcgctcgccgtaccggaagaaaggcctctacttccaaaatgggatgaacccccctcaacttgctgcgggggaaagggaaaggcccccctgaatttcttgggccccgcgaaagagaaccaaaaaaaacggtttttgtggtgaaaaaacctttcaaaaaaaaaattggggttccccccgcccggggggagcgagaaaatctctcaaaggggtctaaaaatctttaaaaagttttccgcccccccccccaaaaaaaggaaaaaatatagggggccccttcccccccaaagtgggggaaaaaaccctccccccccccggaaaaaaaaaaacccccccatttttggggtttaagaagaaggggggtcttnnnnnnttttctttttccccccccccggggggggaaagaaaatcctcctccccccccactctccgggagaaaaaaaaaggggggagtttgcccccttctcccccccacctattttttgt

SEQ ID NO: 95309 - DNA, 894 bp, Zea mays
  misc_feature: Ceres CLONE 1585478
  misc_feature: Encodes the peptide sequence at SEQ ID NO. 95310
  misc_feature (734)..(734): n is a, c, t, g, unknown, or other
  misc_feature (774)..(774): n is a, c, t, g, unknown, or other
  misc_feature (775)..(775): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
ggagctccccgcggtggcggccgctctagaactagtggatcccccgggctgcaggaattcgtctcacccctagaaaaagtatccagtcagatcttcctcctcccaaatccatcgctagccagcctgctgctagcacgcacagtaccacacagtacgtgctcaaataatgctcgctcctggcctcctgctaccaaggaccaagaaaaggagggccggcgaggacgtctggccgtctgggtccctatatatgagacagcgaggaggtgggtgtgaaggctgtgcccagtgagctcagctcgatccatcgatcggagagcttttgcactgcaccagctctgaagccatggctgctgcttcttcctccatggacaggatcgcccagtgggtgtcgtcccaggaggtcccgaccgacctcaccgtccgcatcgccgactccgtcttctctctccacaaggcggtgatggtgcccaagtgcggctacatccgccgggccgtggcggcgagccagacgcagggcccggggggcggcgccgtcgagctggacctctccgcgctgccgggcggcgctgacgccttccagaaggcggcgcgctgctgctacggcgacagcctcgagatcacggcgcgcgacgcggcggcactccgctgcgccgcggaagtcctcgacgcgccggacctggcccgccgcgccgacgacttcctcgcgcaggccgcgctgcgcgcgctccccgggngccgcggcgtcctgcggtcctgcgaagcgctgctccgggnncgcgacgaagctcgcgtcgcgcgccgcgcccgcgaacgcgtcgcgctcggggtctgcaacgaggcgctgtctcgacgcgcggggnnnnnnnggggggtgggggggggggnnnnnnttgg

SEQ ID NO: 95310 - protein, 180 aa, Zea mays
  misc_feature: Ceres CLONE 1585478
  misc_feature (131)..(131): Xaa is any aa, unknown, or other
  misc_feature (144)..(144): Xaa is any aa, unknown, or other
  misc_feature (173)..(173): Xaa is any aa, unknown, or other
  misc_feature (174)..(174): Xaa is any aa, unknown, or other
  misc_feature (175)..(175): Xaa is any aa, unknown, or other
MAAASSSMDRIAQWVSSQEVPTDLTVRIADSVFSLHKAVMVPKCGYIRRAVAASQTQGPGGGAVELDLSALPGGADAFQKAARCCYGDSLEITARDAAALRCAAEVLDAPDLARRADDFLAQAALRALPGXRGVLRSCEALLRXRDEARVARRARERVALGVCNEALSRRAGXXXGVGGG

SEQ ID NO: 95311 - DNA, 869 bp, Zea mays
  misc_feature: Ceres CLONE 1585481
  misc_feature: Encodes the peptide sequence at SEQ ID NO. 95312
  misc_feature (650)..(650): n is a, c, t, g, unknown, or other
  misc_feature (753)..(753): n is a, c, t, g, unknown, or other
  misc_feature (754)..(754): n is a, c, t, g, unknown, or other
  misc_feature (783)..(783): n is a, c, t, g, unknown, or other
  misc_feature (784)..(784): n is a, c, t, g, unknown, or other
  misc_feature (788)..(788): n is a, c, t, g, unknown, or other
  misc_feature (824)..(824): n is a, c, t, g, unknown, or other
ctggagctccccgcggtggcggccgctctagaactagtggatcccccgggctgcaggaattcgtctcacccctagaaaaaaaggggcgaggcagccaaacgaatcccagcacctgcctctcctttgcttgcgcagatctagcgatggcggcgggcggtgagttggcgtggggggaggagcccgtggcgcggcgccggcctaagaccaagatcgtctgcacgctcggcccggcgtcgcgatccgtcgagatgatctcgcgcctgctgcgcgccgggatgtgcgtcgcgcgcttcaacttctcccatggctcccacgagtaccaccaggagacgctcgacaacctgcacgccgccatggagctcaccgggatcctctgcgccgttatgctcgacaccaagggtccagagattagaactggatttttgaaagatgggaagcctattcaattgataaaaggccaagaaatcacaatttctacagactatagcattcagggtgatgagaaaatgatatcaatgagctacaagaagcttgctgttgatctgaagccaggcagtgtcatattgtgtgctgatggtaccatcactcttactgttcttcactgtgataaagaacaaggcttggttcgctgccgctgtgagaacactttncagcttggcgagaggaagaatgttaatcttccaggagttattgttgatctccccacactcacagacaaggacaaggaggacatccttaaatgggggtgtccannacagatgacatgattgccttgtcatttgnntcgnaagggtcggatcctgtggaggtagggaagtactggntgagcatgccagtccatatgctgatgtcaaaggtgagaatcagag

SEQ ID NO: 95312 - protein, 207 aa, Zea mays
  misc_feature: Ceres CLONE 1585481
  misc_feature (18)..(208): Pfam Name: PK Pfam Description: Pyruvate kinase, barrel domain
  misc_feature: SWISSPROT Homolog: EC 2.7.1.40 Pyruvate kinase
  misc_feature (169)..(169): Xaa is any aa, unknown, or other
  misc_feature (204)..(204): Xaa is any aa, unknown, or other
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTXQLGERKNVNLPGVIVDLPTLTDKDKEDILKWGCPXQMT

SEQ ID NO: 95313 - DNA, 929 bp, Zea mays
  misc_feature: Ceres CLONE 1585488
  misc_feature: Translation starting site: 140
  misc_feature: Pfam Name: DUF382 Pfam Description: Domain of unknown function (DUF382)
  misc_feature (929)..(929): n is a, c, t, g, unknown, or other
caaagctggagctccccgcggtggcggccgctctagaactagtggatcccccgggctgcaggaattcgtctcacccctagaaaaaacacacgccaaccggcctaccgccttcttctcttgtctcgtcctcctcgcgactatggccgccgccgccgaggtagaccccagccccaacccgccgccaactacagcctccggcctctccaagaccaagacgcgggaggccgaccgccgccgacgccgccgcagcaaggccaagaagaacaagtccgtcactgaggctgatgcccaggacgctgacgggggagcttccagctccgacgccaaggagaacgccgatcccaaccccgagccacaggttgaggtggagatagagtacgtgccggagaaggccgagcttgaccaccctctcctgggatgatttcaaggccatcttcgagaagttcaccttcaaggacgctgctgcagcggcggccgaggatgataagaaagacgagggtgccgctgatgccacaaagaaggggtcactggatgatgatgacgacgacaaagatgatgagccggagggaaacaagaagaaggacggagggctatccaataagaagaagaacctggaacgcagggatgaaaattgcagacctccaaacgattatgcaacagaacctgacgttcggggaaggtctgggatgcaactgctggagatcccaaaattgcttgtatttctcagggggtaccgaaataaaggaacctgtcccctaggcccggggtctcagaagggcaagtttctgtgcgggggaaaaagagggttattgaaaaaaacgccttttccaggctttcttaactttattgtctgccactggggaataaaaaaaataaaacaggggtcttatttttgagaaagggtaagccaggaatttgaaaacaaaaan

SEQ ID NO: 95314 - DNA, 1077 bp, Zea mays
  misc_feature: Ceres CLONE 1585492
  misc_feature: Encodes the peptide sequence at SEQ ID NO. 95315
ccgcggtggcggccgctctagaactagtggatcccccgggctgcaggaattcgtctcacccctagaaaaagtccccgcgtttcccagaaagacgatggctcccccgcctcagccggagctccccgcggcagcgctcgagctcctcgtcctcctcctcgccgccgcggtgccggcgcgcgcgcagcaggagtacgaggccaacaaacagaacgcttgctacgccaccaacgccagctccgtccacggttacagctgcaacgccaacgccacctccactccggcctgcgagacctacctcatcgaccggtcgtcccccacagactagaagacgccggtctaaatatcctacctcctcaacgcgttcccagacatcatagcttacgaacaagggcgccccggcccggagagcccagctcgcggggttgaagcctcaaccctggaaccccggttccctgtggcctgtaaggacccgggagggaagatagctggccaaggctcgcttcggaggacctggggaggtgtctggatgggggggtcggaagtgtccaccagaggctcgaccatgaaggccagtactgggggtagagagccagccctgggcagaggggcgttcatactccggataaaacaactccggatgtcaacggaaggtagttgagtgaggcagacgcgcgtggagcgactcgtgtataagagaaggagctcacatgattcgtgagggatgtgctcagtagtgcacgccggttgtcccctgtcttaaacgagtgcacaaaggactcgttgtgcgcggtgggcatcaaaagaatagtcagttggcgcccgcggagagtggatgatcctgtaggtggggggagagctgcggcatggtggaatatgaagacggggagacggaaccccttattcagaaaggaagaggagacgccggccggaggtgagggtatgccagcagaggggccgcgactagttcgtgcaaacagcgtgtagtctgtggggtagcgacgcaccggcggaatcgagtgcgtagagggtcatcttctcattggggcggaggaaaacttcattgtcctgggtggcgag

SEQ ID NO: 95315 - protein, 76 aa, Zea mays
  misc_feature: Ceres CLONE 1585492
MAPPPQPELPAAALELLVLLLAAAVPARAQQEYEANKQNACYATNASSVHGYSCNANATSTPACETYLIDRSSPTD

SEQ ID NO: 95316 - DNA, 929 bp, Zea mays
  misc_feature: Ceres CLONE 1585494
  misc_feature: Encodes the peptide sequence at SEQ ID NO. 95317
ctggagctccccgcggtggcggccgctctagaactagtggatcccccgggctgcaggaattcgtctcacccctagaaaaattgaatgaaacgaaatcaaaccccttccacccagcgaggcgacagaggctggcctcttcgcctatcaccccgaaggcccgaaacaagattagattagagatagcaaaaggcgaagccacggtaaccgccaccaccaaatcgctaccgccaatccgccatgatgctcccgacggccaccgcgacggccgtcttcctcaccgcggcgccttcctctttctccacccgccgtcggcgcagtcgcgccatcttcgcatccctttcgccgtccttctccgcctcggaggagccgctgctggtgcgcgcggagcggggtgaggacggcctcccacgcccgcccgcgtggatgatgcggcaggcagggcggtacatggtggagtaccaggcgctggccaagcgccacccctcgttccgggagcgctccgagaacacggacctcatcgtcaagatcacgctgcagccgtggcgtgccttcgcgcccgacggcgtcatcctgttctcggacatactcacgcccctgccggacatcgggggtgccgttcaatatctcggactcaaggggggcccgtgatccaatcgccagtacgggccaaagtagcaggtgagggagctcgggccccctccacctttgaaaagctcccgttcgtcgggggagtcccttaagattctgccaaatggaaaatgttgggaaaagctgcctttgcaaggatttggggggggccccaagggacaattgcaaccttaaattgggttaaaagggggggttaactcaccgcgttacccctattttaagagggggtggtgggcttttaaagctcccgaagggtcattggaagggggcctcttctcccc

SEQ ID NO: 95317 - protein, 136 aa, Zea mays
  misc_feature: Ceres CLONE 1585494
  misc_feature: SWISSPROT Homolog: EC 4.1.1.37 Uroporphyrinogen decarboxylase
MMLPTATATAVFLTAAPSSFSTRRRRSRAIFASLSPSFSASEEPLLVRAERGEDGLPRPPAWMMRQAGRYMVEYQALAKRHPSFRERSENTDLIVKITLQPWRAFAPDGVILFSDILTPLPDIGGAVQYLGLKGGP

SEQ ID NO: 95318 - DNA, 887 bp, Zea mays
  misc_feature: Ceres CLONE 1585496
  misc_feature: Encodes the peptide sequence at SEQ ID NO. 95319
ctggagctccccgcggtggcggccgctctagaactagtggatcccccgggctgcaggaattcgtctcacccctagaaaaagtccatccctcgcacgcgctggccgcccgccccccatctccacttctcctcgccgctctcctgaatccttcgcccgaaagcctccgaccgcagaaccttagcgttgccgtccacctccatggaatcgaagcctcacgcgccggcgtctgggctggcaacgccgcggttcaggctgggtaaacagtcgtcgctggcgcccgagcgcggcggcgagggcggtggtgcggggtcggcagatgggtcggccgaggcgaacggcgtcatgagcttccagctcatgtacctggcccacgagggcagcgcggaggggatccgcgagctcctcgacggcggcgtcgaccccaatttccgcgactccgacggccgcacggcgctgcacatcgccgcctgcgagggccacgccgaggtcgtcgagctgctgcttcagagcggcgcggaggccgccgtggaggaccagtggggcagcacgcctttggcggatgcaatgcattatcagaatcatgatgtgatcaagatctttgagaagcatggctccaagcataagattgctccgatgcatgtgaacaatggtcgtgaaagtcctgaatatgagattgacccggctgagcttgatttcagtaatgggcatgattttatcaagggcacatttagaaaggcacatggaggggcatcccggggtgctgtagaagctggacgatgatctaattgcggacggcagcaaagtgcaggcattcagaaacgagcttgatgtgctgcaactatacgtcatccaaatgtgtgcaatttttgggcgctgtgacccaagca

SEQ ID NO: 95319 - protein, 193 aa, Zea mays
  misc_feature: Ceres CLONE 1585496
  misc_feature (81)..(113): Pfam Name: Ank Pfam Description: Ankyrin repeat
  misc_feature: SWISSPROT Homolog: EC 3.5.1.2 Glutaminase
MESKPHAPASGLATPRFRLGKQSSLAPERGGEGGGAGSADGSAEANGVMSFQLMYLAHEGSAEGIRELLDGGVDPNFRDSDGRTALHIAACEGHAEVVELLLQSGAEAAVEDQWGSTPLADAMHYQNHDVIKIFEKHGSKHKIAPMHVNNGRESPEYEIDPAELDFSNGHDFIKGTFRKAHGGASRGAVEAGR

SEQ ID NO: 95320 - DNA, 890 bp, Zea mays
  misc_feature: Ceres CLONE 1585498
  misc_feature: Encodes the peptide sequence at SEQ ID NO. 95321
  misc_feature (771)..(771): n is a, c, t, g, unknown, or other
  misc_feature (772)..(772): n is a, c, t, g, unknown, or other
  misc_feature (814)..(814): n is a, c, t, g, unknown, or other
  misc_feature (815)..(815): n is a, c, t, g, unknown, or other
agctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaagggatgctggagtgactgctgggcctaatgtgctgcgtatcatcaacgagccaacagctgcagctatcgcctatggtcttgacagaaggctaccagtgtcggtgagcagcatgtcctcatctnntgatctggaggttggtacttttgatgtctccctccctcacanntgagaaggaatctttgaggtcaggccacagctggtgacacccattttgggtgtggagactttgacaacagatggc

SEQ ID NO: 95321 - protein, 171 aa, Zea mays
  misc_feature: Ceres CLONE 1585498
  misc_feature (9)..(172): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMVLIKMREIAEAYLGSTIKNAVVTVPAYFNDSQRQATKGCWSDCWA

SEQ ID NO: 95322 - DNA, 674 bp, Zea mays
  misc_feature: Ceres CLONE 1585499
  misc_feature: Encodes the peptide sequence at SEQ ID NO. 95323
  misc_feature (129)..(129): n is a, c, t, g, unknown, or other
ctggagctccccgcggtggcggccgctctagaactagtggatcccccgggctgcaggaattcgtctcacccctagaaaaacccccctttccaaatccgtctacgccctcacgcacgcgggcccaactangcctaacaaaccctagctagatttagaaaaaaagtttgtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctgccgccgggggttcgccgcccgcagacagcaagccctccggggttctccgaccacgccgaacgccgctcctcccagcaccagcatgagacacaatcacatgacagtggttccctcgaaaatctccagaaagggaccggagaaacgcaataaggggcaagggattagggaagcgtgacagggatcctggcccaagaaaagggggagggacgaaaacgggggataaaggatcttgaaaaaaaattgccgaaaaaccgggggtttcccgaatttccccccccccccgggggacccctttccaaaaaggccccccccccggggaaaaaaggggggaacacccccccggaggaaaaccggtttttccgaggagggaag

SEQ ID NO: 95323 - protein, 60 aa, Zea mays
  misc_feature: Ceres CLONE 1585499
MSEYDERYQGNADMPAAEGGYPQAEYAAAAAPAAGGSPPADSKPSGVLRPRRTPLLPAPA

SEQ ID NO: 95324 - DNA, 1105 bp, Zea mays
  misc_feature: Ceres CLONE 1585502
  misc_feature: Encodes the peptide sequence at SEQ ID NO. 95325
  misc_feature (885)..(885): n is a, c, t, g, unknown, or other
aaagctggagctccccgcggtggcggccgctctagaactagtggatcccccgggctgcaggaattcgtctcacccctagaaaaagccggcgccgtccatccccaccgcacaccaccgcctccaccacgccaccgactccgcctctcgctcccccctcgccgcgccgcccgaacgccacgatgcgtcacctcctcctctcccgcttcctccgccgcggtggcggcagcggcatccccaacggccactaccaccacctccccctcctccgcgccctctcctcctccccctccctggtctcctcggacagcagagctccgcaagtacacgggctacgcgctgcttcttctcgggtgacggagcggaacctactactccttcgtggtcccaggcggagggcccccacccacagccgtgccattcccaggatacacacgcggggggaggaactttcacgcccgttttcggactggggggggccgttcacgaagggtcaagacgggaggtgggggcacacaggaaggaatcagagtcccggggtcgaataagggggtgcgctagggacccccctggggcaaaagtgggagggatcttgcagggatttaagagggccccttggaggaaaagctcggacgtgtgggcccgaacaaatgtggggatattgtatagcttgccttcggcgtatcgggagtggggaggagatggagttacacgcactgtgctccttgtattattgtgggagaaagatagcggggtaggtctaatgtcggctcgggaggtgacggagagagtggagaaaaatactgtaccctcgcagacggcagagaggaggtttgagaaagacatatgtgggcgttcgcggccgctaatagtacgagaagcggtgtngtcgtggcgagagaagagtcgcaccactacgccatgagaataagttgtgcgagctctactagctcgaggagacggagcggaggtgatagaggtggcgatataattgcggcgcggtggcccgtccggtgagattagggcggatgtggagacgaacagctcgggtgaggtattgaaagggagataaagcagcggatcggatgggagtgtttgcaagagagag

SEQ ID NO: 95325 - protein, 121 aa, Zea mays
  misc_feature: Ceres CLONE 1585502
MRHLLLSRFLRRGGGSGIPNGHYHHLPLLRALSSSPSLVSSDSRAPQVHGLRAASSRVTERNLLLLRGPRRRAPTHSRAIPRIHTRGEELSRPFSDWGGPFTKGQDGRWGHTGRNQSPGVE

SEQ ID NO: 95326 - DNA, 839 bp, Zea mays
  misc_feature: Ceres CLONE 1585503
  misc_feature: Encodes the peptide sequence at SEQ ID NO. 95327
  misc_feature (770)..(770): n is a, c, t, g, unknown, or other
  misc_feature (796)..(796): n is a, c, t, g, unknown, or other
  misc_feature (839)..(839): n is a, c, t, g, unknown, or other
ctccccgcggtggcggccgctctagaactagtggatcccccgggctgcaggaattcgtctcacccctagaaaaagtggtcgcaacgtccccagtcgttgccgcgtgctatcttcctcctccctccctccttgccgcacgcgtcaaaccttgcaaagagagttcggtcgacggcgccagccggcgatggcagcgccgcgccaccgccagggccacattgcgcagtgccttggcaggatcctcgcctgccgtggcagcgccaccgccgccgtcgctgccggcccaggcggccgacggctcaccggcgcggagttcgtcgacggcgtgcggagcctggccgctggcgtcgccgaccgcggggtgcgccctggccacgtcgtcgccgccgtcgccctcaacagcgtcgagtacgtgcagctgttcctcgccgtcacctacgccggagccatcatcgcccctctcaactaccgctggagcttcgaggaggcggcgcaggcggtggagctcgtgcggccgacggcgttcgccttcgacggcgcgttcagctcctgggcgcttcggctgatggagggtgacaggttcccatccatcggcctctacctcctcctgggcgatccttgcaggaccggccgcgctgctgcaggttgtgctgtacccattgccgacgtcacggggagcctcggcggagctacggcggcggcggcgatggagcccgtgtcggctccagacgacgttgctctaatatgcttcacatccggaaccacggggcggncccagggcgtagcgataagcacacgntcttgatcgtcagtccctcgccaagatcgccattgtcggctan

SEQ ID NO: 95327 - protein, 205 aa, Zea mays
  misc_feature: Ceres CLONE 1585503
  misc_feature: SWISSPROT Homolog: EC 6.2.1.12 4-coumarate--CoA ligase
  misc_feature (196)..(196): Xaa is any aa, unknown, or other
MAAPRHRQGHIAQCLGRILACRGSATAAVAAGPGGRRLTGAEFVDGVRSLAAGVADRGVRPGHVVAAVALNSVEYVQLFLAVTYAGAIIAPLNYRWSFEEAAQAVELVRPTAFAFDGAFSSWALRLMEGDRFPSIGLYLLLGDPCRTGRAAAGCAVPIADVTGSLGGATAAAAMEPVSAPDDVALICFTSGTTGRXQGVAISTRS

SEQ ID NO: 95328 - DNA, 903 bp, Zea mays
  misc_feature: Ceres CLONE 1585506
  misc_feature: Translation starting site: 440
  misc_feature: SWISSPROT Homolog: EC 2.7.7.27 Glucose-1-phosphate adenylyltransferase
  misc_feature (448)..(448): n is a, c, t, g, unknown, or other
  misc_feature (724)..(724): n is a, c, t, g, unknown, or other
  misc_feature (809)..(809): n is a, c, t, g, unknown, or other
tggagctccccgcggtggcggccgctctagaactagtggatcccccgggctgcaggaattcgtctcacccctagaaaaaacggggagcagggcacacgcggcgtagtagcgccaagcgaggccgcggccacgccttctccaccgttcgtccgtccattcccattctcatttccatttgcctcgctcgccttcctcctccccactccactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtngagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttggggtggtggtaccgggactcagctttttccctctcacaagcacaaggggccacccctgctgttcctattggaaggatgttacanggcttattgatatccccatgagcaactggtttcacagtggcataaaacagatatttgttatgactcagttcaactcagcttctcntaccggtcacatcatcgtaccattttgggggggggggataacttccctgaatgaattgttgaggggcttgctgcaacccaatgtcctgggaagg

SEQ ID NO: 95329 - DNA, 919 bp, Zea mays
  misc_feature: Ceres CLONE 1585507
  misc_feature: Encodes the peptide sequence at SEQ ID NO. 95330
ggccgctctagaactagtggatcccccgggctgcaggaattcgtctcacccctagaaaaaacggggagcagggcacacgcggcgtagtagcgccaagcgaggccgcggccacgccttctccaccgttcgtccgtccattcccattctcatttccatttgcctcgctcgccttcctcctccccactccactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagagggatgaggatcaactgcttgcagcatctggcgcaacaaggcactgaggaggatgtgtttcattgcaaggggtggtgggagcagcccccaatgtgtgcttcacatccaaatgctgggcccagacaactcttgtcatccgaaacatcctttttcgggaagaatttatgctggatcctaatgaagtccctgcccgtcattttttggggtgggggtaaccgggaacttcactttttccccttctcacaaagcaccaaggggcaccccctggctggttcctatttggaggaagtttaacgggctttattgatattccccctgggagcaaagtggtttaaaaaggggggaataaacaagaatttttggttgaagactcgagtttacctcctcgttttttttaaaccggtcatattatatgggaacctatttttgggggggggggagaacaacttcgccggagggggatttgtgtgagagggggggggttaca

SEQ ID NO: 95330 - protein, 43 aa, Zea mays
  misc_feature: Ceres CLONE 1585507
  misc_feature: SWISSPROT Homolog: EC 2.7.7.27 Glucose-1-phosphate adenylyltransferase
MQFSSVLPLEGKACMSPVRRGSGGYGSERDEDQLLAASGATRH

SEQ ID NO: 95331 - DNA, 857 bp, Zea mays
  misc_feature: Ceres CLONE 1585509
  misc_feature: Encodes the peptide sequence at SEQ ID NO. 95332
  misc_feature (800)..(800): n is a, c, t, g, unknown, or other
  misc_feature (801)..(801): n is a, c, t, g, unknown, or other
tggagctcaccgcggtggcggccgctctagaactagtggatcccccgggctgcaggaattcgtctcacccctagaaaaaaaaaaaaaccttcccggcgcggcggcgcggcgccgaaaccgaccgacgccgcttatccacttcgcccgctcccatcgcggcttgctattctcatcacgtccatcggcggtccctctccccgggacgcgaactcctccgcaccgccttccaccgaagcgaagcactctacccaccttcctgctgccgccctcttgtgcacgggcgtggaacgtagatctgtctgtgctggcacttgttttttgctttcattggtcagtattttgcagctaagaggataattcacatttgttgctatcaaggtttttgaaagttttatatgattcagagaaatatatattcttcggctagtgggtctgctcattgatggaaggcaaccagattttggtccagtcagagcagagccttataccaggtgtgcaaactcttgtcatcggtcaagagtttgcagatgttgacacttgtcggagggctgtcaaggacatggccattgctttgcactatgagctccgtgtggtgaaatctgatcgtagccgtttcatcgcaaagtgctcaaaagaagggtgcccttggcgtgagcacatcgctaaagtgccctggtgttccaactttcactgtcaggactttgcatgaagaccacaaaggtgagggtggtctgaaactgcatcatcagcaggctactggtgggttgggttgctaggtctgttcgaggcaaggctcaggnnataccctcaaataaggccaagggagatactgcaggatattcgggagcagcatgttg

SEQ ID NO: 95332 - protein, 88 aa, Zea mays
  misc_feature: Ceres CLONE 1585509
MEGNQILVQSEQSLIPGVQTLVIGQEFADVDTCRRAVKDMAIALHYELRVVKSDRSRFIAKCSKEGCPWREHIAKVPWCSNFHCQDFA

SEQ ID NO: 95333 - DNA, 967 bp, Zea mays
  misc_feature: Ceres CLONE 1585510
ctccccgcggtggcggccgctctagaactagtggatcccccgggctgcaggaattcgtctcacccctagaaaaaacgaatgctcagtgatatttctctcgaggtctgcacactcgtctcctaccgagaccgtcggcggccatcgtcgcacacgctgtgctcatgctaagtgtcgaggctcacacgtactactactacccgaccgcgaggccgagacggaagctatgcgcctgcagaaacgtcttgcaggaaaccgccccgcgtgacgcagaggcaaatccctgccgtcacggcgagaagaagagcaggagaaggggcgacggtgcttattacatcgacaaggacggggggggcgtaacccaggaccctctgaccggaaagaaaaaatccagaaagaacccccgggtgcttttaaaaggggcgccgaaatggaaaaaaccgggttcccgggttcccttccaaccgcaaatgttttccccacgggcctaaaatccccaaagggggcccaaggagatttgtgtttaaaaacttctttgccaaaaaaaaaggggggagaccccaacacggggcccaagggtttttgggggagaaatactctggggaaaaaaaaaatccccccctaaaggggcgcccaaataattttttttgggagagaaaaaatattgtttaaaaaaggtgtgtcccgtgttaacaaatttcccccccttggaaaaccgcggaaaatgggggagggcgacaatattttaccaaattctttttgaaagaagggggggtcctcctcccccgagaaaaaatattttttctccccccccacaaaaatttttgttgttaaaaaaattttgtttttattaaacccactttagtggccgaaaaaaatttctctttttaattaaaggaggggggaggggccccccaataatcgcctcttttgggggggggggccgctttttttggcccgcgggaaaaac

SEQ ID NO: 95334 - DNA, 979 bp, Zea mays
  misc_feature: Ceres CLONE 1585512
  misc_feature: Encodes the peptide sequence at SEQ ID NO. 95335
ggccgctctagaactagtggatcccccgggctgcaggaattcgtctcacccctagaaaaaatcgatggagctgtgagctgagctgagctgagctcaccaccaccacacacgggagatagctatagctagcatagcaagccagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggggggcacaccgcagcaccgtgttctcgaccaacatccccgcccaccttccccttcttcgggggggtgggacccgcgcgggggtcgcccttgagggaacgccgccgcctttaccggggctcatcgaacccgggactctgggagaaaaagcgcgaacatcctcattcggggccttataaacccgggggggccgggtttcatccggcgggggaaacccccttttggggggggttccctctaacacccgcggggagggggggaacccgccggccgctgtaaagaacccttcttcccggggggaattgtttttataagattttccccaccccacatgtggggtgccccccaaaatttctcccggcaaggtttgtaggcccctccattttggggaacctccggggagacacggaaatttctccggaaagaaacaacccgctcctaaaaaaaagacccccccgagcacataagcctgccccccgcgggaggagaaggcattttttgtgggcttactgaagagaattgtacaggggggggctccacaacctcccgcaatgaggagggggaagaaaagagttggcgaacgcacggaagaaatggtgggggggggcgcgaatacgccccccctaagaaagaggttctcg

SEQ ID NO: 95335 - protein, 85 aa, Zea mays
  misc_feature: Ceres CLONE 1585512
  misc_feature: SWISSPROT Homolog: EC 4.2.1.92 Hydroperoxide dehydratase
MLPSFVSPTASAAASVTPPPRPIPGSYGPPVLGPLRDRLDYFWFQSQDEFFRKRAGGTPQHRVLDQHPRPPSPSSGGWDPRGGRP

SEQ ID NO: 95336 - DNA, 887 bp, Zea mays
  misc_feature: Ceres CLONE 1585515
  misc_feature: Translation starting site: 152
  misc_feature (777)..(777): n is a, c, t, g, unknown, or other
tggagctccccgcggtggcggccgctctagaactagtggatcccccgggctgcaggaattcgtctcacccctagaaaaaatcccacaggtaggggagggaaacaaacacccaaatcaaacccgcgcgtcgccagccgcagccgcagcaccaatgtcgtgcgtcgccgcgctcttcgcctccccggcgctcctccccttcccctccaccacctcgtccatggcctcctgctcgtgccgcctccgccccgccgtcgtcgcccgcgcgccgcgccagcagccgcggggccggcgcgcgctccggcgcttcgatgaggtggaaggggtgtcgaagaaacggcgcggcatcggaggcggtggcggcgtcggcgctggcgggtcgcagccgtcgtcctcgcgcagggacagggggctttccgtcgatttcaaggagccgcaggttgctgagtttgatgatcttgaagaggacaaattccttaatgctgtcgtcaaggtctattgcactcatatcgcacccgattatggtcttccttggcagaagcaaaggcaacattcaagtagtgggagtgcttttatgattggggatggtaaactcttgacaaatgcgcattgcgttgagcacgacacccaggtcaaagtaaagagaaggggagatgacaaaaaatatattgccaagggtttagctaggggtgttgaatgcgatcttgcattgctatctgttgagaatgaggagttctggagaggaacagagcacttcattttggtcgtttgccatgcctncaggaatcagtaactgttgtgggatatcctcttgggtgagacactatatctgtaacaaaaggcgttgtgtcccgcattgaggtcacttcatatgcacatggaaacatcaa

SEQ ID NO: 95337 - DNA, 895 bp, Zea mays
  misc_feature: Ceres CLONE 1585516
  misc_feature: Encodes the peptide sequence at SEQ ID NO. 95338
tggagctccccgcggtggcggccgctctagaactagtggatcccccgggctgcaggaattcgtctcacccctagaaaaacacgctcgtggcaccgcactcactccgaatcctgaagcaacaaacaccagaagcgcaccaactccccaaccaccggagaccgcaccccagcaaaggatggcatctgactccacggccgccgtgacggtggacggcagcgcgcttgcggggcgcgcgctggccgcggcgggcacgcggcacatgttcggggtggtgggcatccccgtcacctccctcgcgtcccgtgccgccgcggccggggtccgcttcctcgctttccgcaacgagcagtccgcggggtacgccgccgccgcctacggcttcctcacgggctcccccccccccctactcaccgtctccggcccaggatgcgtccacgggctcgcgggcctctcccacgccaccgccaacgcctggccgctcctcatgatctccggatcctgcgatcaggctgacgccggcaggggcgacttccaggagctcgaccagatcgccgccactaagcccttcgccaagctcgccgtcagggcaacaaccatcgcccgacatcccgcgcctcgtctttcaggccctcgccgccgtcgtgttcggccgttcccggagggggctacctcgatatcccgttcggacgtcttcaccaaaccctccctgaatcggagcccgcggcttctcaaagaaacaacagcccgccgaattgggcgcattccaattcttccccggtcaaggcccagagctcttgaccagggaatcccccaaactgcggaaccggttccgggggtgcgagaacggccttctggtttggatatggggaaaggggcggggctatatccccccccc

SEQ ID NO: 95338 - protein, 240 aa, Zea mays
  misc_feature: Ceres CLONE 1585516
  misc_feature (11)..(155): Pfam Name: TPP_enzyme_N Pfam Description: Thiamine pyrophosphate enzyme, N-terminal TPP binding domain
  misc_feature: SWISSPROT Homolog: EC 4.1.1.8 Oxalyl-CoA decarboxylase
MASDSTAAVTVDGSALAGRALAAAGTRHMFGVVGIPVTSLASRAAAAGVRFLAFRNEQSAGYAAAAYGFLTGSPPPLLTVSGPGCVHGLAGLSHATANAWPLLMISGSCDQADAGRGDFQELDQIAATKPFAKLAVRATTIARHPAPRLSGPRRRRVRPFPEGATSISRSDVFTKPSLNRSPRLLKETTARRIGRIPILPRSRPRALDQGIPQTAEPVPGVRERPSGLDMGKGAGLYPPP

SEQ ID NO: 95339 - DNA, 866 bp, Zea mays
  misc_feature: Ceres CLONE 1585518
  misc_feature: Encodes the peptide sequence at SEQ ID NO. 95340
  misc_feature (776)..(776): n is a, c, t, g, unknown, or other
  misc_feature (819)..(819): n is a, c, t, g, unknown, or other
  misc_feature (866)..(866): n is a, c, t, g, unknown, or other
ctccccgcggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaagggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtcccgcaagttcgacgaggacagcctggcgtttcagtcgcgtctgctggccaagtccggcatcggcgacgagtcgtacatgccgcgctgcgtgttcgaagcccaagccagctgcgccaccatgaaggagggccgcgncgaggcgtccacggcatggtccgcggcctggacgagctgttcnacaagtgcccgtcccggccaaaggactggggctgtctggtggtcacn

SEQ ID NO: 95340 - protein, 109 aa, Zea mays
  misc_feature: Ceres CLONE 1585518
  misc_feature (1)..(106): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature (80)..(80): Xaa is any aa, unknown, or other
MSRPRPVYLIDFACYKPADELKVSKAEFIDLARKSRKFDEDSLAFQSRLLAKSGIGDESYMPRCVFEAQASCATMKEGRXEASTAWSAAWTSCSTSARPGQRTGAVWWS

SEQ ID NO: 95341 - DNA, 843 bp, Zea mays
  misc_feature: Ceres CLONE 1585519
  misc_feature: Encodes the peptide sequence at SEQ ID NO. 95342
  misc_feature (157)..(157): n is a, c, t, g, unknown, or other
  misc_feature (164)..(164): n is a, c, t, g, unknown, or other
  misc_feature (179)..(179): n is a, c, t, g, unknown, or other
  misc_feature (189)..(189): n is a, c, t, g, unknown, or other
  misc_feature (465)..(465): n is a, c, t, g, unknown, or other
ctccccgcggtggcggccgctctagaactagtggatcccccgggctgcaggaattcgtctcacccctagaaaaacccccccatcagatgatcagatcagtccgtccctgcccatctgccctgctctctaatggcattaactgccgcccacccacccngccatcntcctcccctacccangctgcacacngctcctcttctcctgctagcagtactgctatatatcaataatactagctggaccctttccactcccctcacctctcactaccaccaccactgccccggatccataccagctgcagcagcagcgcgcgcgagctagcttcggtcggtcgatagatcgatcgatcgctcggccatcatgggcgcggaggagcaggcgctgctgtcaacggagatcgtgaaccgcggcgtggaagcgttcggccccggacgccggctcgcccgccttctcgggtgcccntgcgcccgcccctggccggactccctgcagtcggtgaaccctcaggaactgggccctcggggaacattacctaataaaccacggggggaaacctggcacccatccccggtattttggttgggggggggggcccaaatggggaaaccctatcccccaaaaaattttggccaaagggtggggggggagccccctaaaaaccccccccccggggtggcttttttctgggggctccgccctaaaaaatttgcggaaaaaaaagggtttaaggccccggcccccggtaacccctaaaaaatttttaagttaaaaaaacggcggcaaaaaaaattaagggggtttcacgggggggattttttttccttgggggggggaaaaagc

SEQ ID NO: 95342 - protein, 130 aa, Zea mays
  misc_feature: Ceres CLONE 1585519
MGAEEQALLSTEIVNRGVEAFGPGRRLARLLGCPCARPWPDSLQSVNPQELGPRGTLPNKPRGETWHPSPVFWLGGGAQMGKPYPPKNFGQRVGGEPPKNPPPGVAFFWGLRPKKFAEKKGFKAPAPGNP

SEQ ID NO: 95343 - DNA, 916 bp, Zea mays
  misc_feature: Ceres CLONE 1585521
  misc_feature (397)..(397): n is a, c, t, g, unknown, or other
gagctccccgcggtggcggccgctctagaactagtggatcccccgggctgcaggaattcgtctcacccctagaaaaaaccacccgctaaccacagtccacagcccaaagcggcggtcgctcccccgcttaaacccttaagcccgcacaccgacgaggcgaacggaccagagtcggcgagaccccaggaggctccgactccgcctccggctctgaccggtctttagacccccccccccccccccccccttgccccaggcgacgacgaaaccagcagcgctgcgcagcgccgaccactccgggaacctcacgatccaggggagatgctggtcgccgccgccgcctcgccgtcgcagccgtgaaccggtttccccaggggggggagggacttgggctccnattcggcggatcttgggctggtctcgtgcattcgagccgcggcaggcgtctgggtaaccgcttctcccgaggaaaaggaaccaaagctgctcggccaacttttggatcaaggatcggcgaaaaggaaaagaaaaaggagggatctttttggggaggtctgtttggagccttcggggttaccgtaccttcgggcaaactcctggcaagggatttcctcaaaaataaaaatcccgggaagggaaaaaaaaccccgggggtgggggaaaagccttttaaacccaacacacacccccccggggggggagacccccccggggccgggaaaaacttaaacccgggctttcgggaaagaactaacccccaggggggcgccaaaggggcaacgcgcggcaaaggggggggttttaaaaagagggggggggggggggggtttttggggacaccccaataatttctcccccccaaggggggagaaggggctccctaggtttcagggaaaaaaacttttgtggttgtcct

SEQ ID NO: 95344 - DNA, 893 bp, Zea mays
  misc_feature: Ceres CLONE 1585523
  misc_feature: SWISSPROT Homolog: EC 2.1.1.14 5-methyltetrahydropteroyltriglutamate--homocysteine S-methyltransferase
  misc_feature (783)..(783): n is a, c, t, g, unknown, or other
aagctggagctccccgcggtggcggccgctctagaactagtggatcccccgggctgcaggaattcgtctcacccctagaaaaatgcattctctgctgcatactcacaacttgaatctgtactttctggattgaatgtgcttgttgagacttactttgctgatgttcctgctgagtcctacaagaccctaacatccctgatcagagtgactgctaatggttttgatcttgtccgtggaacccaaactcttgagcttgtcacgagtgctggtttccctgctggaaagtacctctttgctggtgttgtggatggacacaacaactgggctgatgatcttgctacatctctcagcactctccagtctcatgaggctgttgttgataaagacaaacttgtcctccccacctcctcctagctcatgcacaccgctgaggatcttgtcaacgagactaagcttgacagcgagattaagacttgccttgcttttgctgccaagaaggttattgaggccgatgctcttactaacgcattggctgggtcaaaggattaggcttacttcacaacaaatgctgctgctcatgtctcgaggaaatcctcgccccgtatgaccaataaatacctccagaatgctgctgctgctctcagcggctctgaaccaacgacctgggaacaaacattaacgctagattggatgccaagcaaaagaaaattaacttccacaacccttcccaccactacaatggagttcgtaccccacagaccattgagcttacggaaggatctngccctaagtttcaaggcaaaatagaatctcttgacgaaggaaatacttcactgcccatctcctggaggcaaagtcaaccaaggccttctataggctttcaacaagaaagt

SEQ ID NO: 95345 - DNA, 882 bp, Zea mays
  misc_feature: Ceres CLONE 1585526
  misc_feature: SWISSPROT Homolog: EC 3.2.1.21 Beta-glucosidase
  misc_feature (490)..(490): n is a, c, t, g, unknown, or other
  misc_feature (502)..(502): n is a, c, t, g, unknown, or other
gagctccccgcggtggcggccgctctagaactagtggatcccccgggctgcaggaattcgtctcacccctagaaaaaaatacacaagcagagctcaaacaattcttgcttcccgctagctagctcgcaagaaataatggctccacttcttcttgcttctcgcacagcctgtcgtcctggccttacaagccgccatgcccatgataatggccggcacggcctgtcttcttcaccaccaggaagtcgtagtaagcgaagccgtagccttagcttgaggccacgagctgaaaagacgacgacaggcggtgggggtcatgttgtgagcgaaaagctgagcccctggcaaatccccaggagggagtggttcccccctagctttatctttggtgctgccacttcagcataccaaattgaaggggcttggaacgaaggtggaaagggggcaagcactttgggacgacttctgccacaaactatcgggagtggatagncgacgggagcantggggatgttggaccaaactcctactatctgtataggggaggacgtcaaattgcttaaaggaaaggggatggaaccccaacggttccccatcctttgggcccaaaatttgcccaaggggaacctccggggggggctttaccctaaagggcttcgggtcccaaaaaggttataaccttttttaaaaaaaacgggaaaaaaccattttggaactttttcccgggaacaccccccaaacctttgggggacaaaccggggggtcctttaaaaggggtggtaaaaaaaaccccccccctctcccagggggggtttttgttcctctccggccccctaaaaaaaattttttttttttaagaagccaaaaattttttttttttttcga

SEQ ID NO: 95346 - DNA, 899 bp, Zea mays
  misc_feature: Ceres CLONE 1585528
  misc_feature: Encodes the peptide sequence at SEQ ID NO. 95347
  misc_feature (418)..(418): n is a, c, t, g, unknown, or other
  misc_feature (544)..(544): n is a, c, t, g, unknown, or other
  misc_feature (570)..(570): n is a, c, t, g, unknown, or other
ctccccgcggtggcggccgctctagaactagtggatcccccgggctgcaggaattcgtctcacccctagaaaaagccgtctcctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctccctgcacatcttcntcacgcaggaacacgccgccccgcgcatcgcgcgcgactcggccgccgtgttcgcctggaagggggagcccctttgagagtactggtggtgcaccgagcgctgccttgactggggcgagggcggcngccccgacttcatcgtcaagacgggngggaaccccccgttgctcatccacaaggggtgtcaggcccaaggagggatccaaaaaaacggggaaaatcccaacccgggatcccccgaaaaccttgaattacaaattgggtccaccttttccgggagggtttaaggggtaccccaaaaaacccccaaaataagaaaggtttttccggttttctaaggaaacccccgggggttaaagggttttcccaaaaggggagaggccgccccctcttcccccgttaaaaaaaaaatttccccccaaaaaagatttaaaccccttgggggggccccccccccccctgtggggggagggggcgcccc

SEQ ID NO: 95347 - protein, 114 aa, Zea mays
  misc_feature: Ceres CLONE 1585528
  misc_feature (12)..(113): Pfam Name: AdoHcyase Pfam Description: S-adenosyl-L-homocysteine hydrolase
  misc_feature: SWISSPROT Homolog: EC 3.3.1.1 Adenosylhomocysteinase
  misc_feature (90)..(90): Xaa is any aa, unknown, or other
MALSVEKTSSGREYKVKDLSQADFGRLEIELAEVEMPGLMACRAEFGPSKPFAGARISGSLHMTIQTAVLIETLTALGAEVRWCSLHIFXTQEHAAPRIARDSAAVFAWKGEPL

SEQ ID NO: 95348 - DNA, 971 bp, Zea mays
  misc_feature: Ceres CLONE 1585531
  misc_feature: Encodes the peptide sequence at SEQ ID NO. 95349
tggagctccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatccccctggtgtgccgcgccgagctgggcagcctcaaccgcaaccagctttggcgcaagggggtggggggaaggccacctaacgacctcgccacgcgggttggcttttcctggccgcccctggctttaccaatttccggttaaaataatggtccgggcccagggcccggggacccttcatcaaattttgaggggtaaaaagccgggcccaaaaactttcaggggtttccaaaggggggagagtttttatacccttgggggcgccaaattccggggaatttttcaaaaaggaaaaaccggggggtttcctcatccccttttgggggggcaaaagccgggttagtggagaaaaaaaaaaaaaagaccccgcgtggtggttttttaagataaaaaccacagggtggccccccaagaaaaagggggggggacggcgagatccccaacaacatattttttgggggggtgggggaggggtggtaaaaataattctccccccccccgcccaagaaaagggaggggggggtgggggagataaagagattttttaaacaccaccacccccccgcccccgccgataaaa

SEQ ID NO: 95349 - protein, 116 aa, Zea mays
  misc_feature: Ceres CLONE 1585531
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIPLVCRAELGSLNRNQLWRKGVGGRPPNDLATRVGFSWPPLALPISG

SEQ ID NO: 95350 - DNA, 958 bp, Zea mays
  misc_feature: Ceres CLONE 1585533
  misc_feature: Encodes the peptide sequence at SEQ ID NO. 95351
ctggagctccccgcggtggcggccgctctagaactagtggatcccccgggctgcaggaattcgtctcacccctagaaaaaaccgcagagagaggacagaggagcgagccatcatccccccccgagccgtgccaaccaagagccatccacccaccaccaccaccccggccgcttccttgtccctgcccctccgttggtctcctttgcccatctcatcctctctctctctctccctctctctctctctggcggtcggcgtggctccgggggcgcgaagcgcgggctcggcggggcgactcgccggcggcgacctgcaggtttgggtatgagaggggtcacccacgcggcgcccaccacaagcgccccccgcccccgcggacgcctcatggacggcctcctcatcttcgtcttctacctctcgctgcccacccgtgccggccgcgaccactcgtcaatcgccgcctctaaattgtagcccgcgccggcacgcatttgctcggcacgccttcccaagaagctcaatctgcggcctagccagccaagcctcacgcgggaatcgggatcgatgggaccgcccccccaatggaattcccccgcgggaaggttttttccccccccttgatgggcaaaaaccttcccccccccttctaaaaattgccattggggggagggaatttcagggttcccactctccccgtttttttttccaaagtctttttttttaaggtgcaaccttcttggaacccaaagaacccaatttgggggggcggggggacacccaaaaaattttttttgggggcccccaataaaggaggggaaaacattagggttccgcgggggttttccaaaaaaaaaattcttttgcccccccacaaaaaaaaagacgggggggtgttttttaattttccccaaacgggggaaaaccttctctttttttaacacaacaaaaaaaaaaaaaa

SEQ ID NO: 95351 - protein, 154 aa, Zea mays
  misc_feature: Ceres CLONE 1585533
GAPRGGGRSRTSGSPGLQEFVSPLEKTAERGQRSEPSSPPEPCQPRAIHPPPPPRPLPCPCPSVGLLCPSHPLSLSPSLSLWRSAWLRGREARARRGDSPAATCRFGYERGHPRGAHHKRPPPPRTPHGRPPHLRLLPLAAHPCRPRPLVNRRL

SEQ ID NO: 95352 - DNA, 882 bp, Zea mays
  misc_feature: Ceres CLONE 1585535
  misc_feature: SWISSPROT Homolog: EC 2.4.1.13 Sucrose synthase
  misc_feature (381)..(381): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
ctccccgcggtggcggccgctctagaactagtggatcccccgggctgcaggaattcgtctcacccctagaaaactccctgttgaccattggggtatgcttgctgccttgctctcctgttcatctccgtgctaaacctctgtcctctgggtgggtttttgctgggattttgagctaatctgctggtcccggtagaaaagatcatgtcccctgacgagctcaagcgctcgccttagccgcgtccttgccccccgccattttttgcggtttcggtgtgttcccgtgactcgccggtattctgaaccatcgagccatggctgcccagctgactcgcctccacagtcttcgcgaacgccttggtgccaccttctcccctccatccnatgaactgatagcactctttttccaggtatgttcacaggggcaggggaatgcttcagcgccatcagctgcttgcggagttggatgccctgttggatatgacaaagaaaagtatgccccttttaagactttcttcggctgcccaggaacattgggctccccccatgggtgccttttctatcggccaggcctggggtctggaatcaattccggaaaattaaaataactggctttgaagacctaaagtttttaaaaattttgcttcagaaaaccgtgggggggatcaactggagattgctagctcctcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnnnnnnnnnnnnnnnnnnnnnnnnnntggnnnnnnnnnnnnnnnnnnnnnnnnnnnnnnnnnnnnnnnnnnnnnnnnnnnnnnnnnnnnnnnnnnnnnnnnn

SEQ ID NO: 95353 - DNA, 901 bp, Zea mays
  misc_feature: Ceres CLONE 1585536
  misc_feature: Encodes the peptide sequence at SEQ ID NO. 95354
  misc_feature (759)..(759): n is a, c, t, g, unknown, or other
  misc_feature (760)..(760): n is a, c, t, g, unknown, or other
aagctggagctccccgcggtggcggccgctctagaactagtggatcccccgggctgcaggaattcgtctcacccctagaaaaatcgtcctcctcttcgcattagcgcggccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagtctactactcatgcaagaagaatcgttcacacgctgaagaacaagaatcggtgtgtatttgcagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggagggtctgggacatcgccatcttcatgatcatctacattttcggcctggcgctgctgacgatggcttcgtcggtggaagggctggttgctacnntcgtgcgcgaccagaatgtgtgccacccgacggacgcgcaggccggcgtggggtttcgtggcgctgtacctcatcgcgctggccacggggcggaatcaacccgtgcgtgtccttccttcgggccgaccagtttcaacgaaa

SEQ ID NO: 95354 - protein, 173 aa, Zea mays
  misc_feature: Ceres CLONE 1585536
  misc_feature (127)..(127): Xaa is any aa, unknown, or other
MGEVEDMYTQDGTVDMKGNPAVKKGTGNWRACPYILANECCERLAYYGMSTNLVNYMKTRLGQVNSVASNNVTNWQGTCYITPLIGAFFADAYMGRVWDIAIFMIIYIFGLALLTMASSVEGLVATXVRDQNVCHPTDAQAGVGFRGAVPHRAGHGAESTRACPSFGPTSFNE

SEQ ID NO: 95355 - DNA, 880 bp, Zea mays
  misc_feature: Ceres CLONE 1585538
  misc_feature: Encodes the peptide sequence at SEQ ID NO. 95356
ggagctccccgcggtggcggccgctctagaactagtggatcccccgggctgcaggaattcgtctcacccctagaaaaaatccccactcccaccccaccccctcgatcccaactccacccagccgaggccagcccagcaaatcatggcgacggtcacgcagggggtgctgctgcggctgctgcaggcgatgcacaccgaggagcgcgtggcgggggagcaccgttcgccggtgctgcaggtcacgggcgtggtgccggcgctgacggcgtccacctccgacgcgccgctgctcgccgcgccgccgtccaacggcgtgctcctcaacctctccgacggcctccactccacctacgtgcaggtcccgcccgccgacgccgacgcgctgctggccgccgcgcgcccgcacctcgtgggccacctcgtccacctcgaccgcctccgcctcgcgcgccccgtgccgcgcgcgctcggcctccgcaccgtcccgtcctctcgctccctgccctgcgctggcgcgccccagccgctcgtcgtgcgccccgccgcctgcacccgcggctacgtcatccagcccgccgcgtccgccgctgacgccgcgccgccgctcatgccctcctgccacacatcctccatcgacgaacacgagcgctagcggaccgtcctcgggcccgataacgccgtcgctgaccccgcgccgcctgcgcagcagcccgtcgagcgccgggttctcgtcgacggggacgacgtccaagcagcgagacccgtcgcctgccgtccaagccgcggtctcgggggcgatctctctcctcgtgggtaaagcacgtcgcggccaactcgccggcgctcaggtccagcccagtgcgacgtcacggagactttc

SEQ ID NO: 95356 - protein, 169 aa, Zea mays
  misc_feature: Ceres CLONE 1585538
MATVTQGVLLRLLQAMHTEERVAGEHRSPVLQVTGVVPALTASTSDAPLLAAPPSNGVLLNLSDGLHSTYVQVPPADADALLAAARPHLVGHLVHLDRLRLARPVPRALGLRTVPSSRSLPCAGAPQPLVVRPAACTRGYVIQPAASAADAAPPLMPSCHTSSIDEHER

SEQ ID NO: 95357 - DNA, 782 bp, Zea mays
  misc_feature: Ceres CLONE 1585540
  misc_feature: Encodes the peptide sequence at SEQ ID NO. 95358
  misc_feature (432)..(432): n is a, c, t, g, unknown, or other
tggagctccccgcggtggcggccgctctagaactagtggatcccccgggctgcaggaattcgtctcacccctagaaaaattcgtcctatggaaatcctacaagcacgtgtcgaatttgagagctactgcaagatcagcaccagatgttaaaccagaggagtttgcggtgttggtgagagatatccctagaccgtctccagatgaaactataaaggactctgtagactcatattttcgagcccttcacccaaatactttctacagatcaatggttgtgacagatcacacaaaggctgataagatataccaagagatcgaaggtcacaagcagaaaattgctcgcgccgaagtcgtatatgcaaactcgaaaactgaaagtaatactgagggcacaaggcctactcataggactggattccttggtcttatggntaacaaggttgacaccattgaatactgcaccgagcagataaaggaatactgcccaaactggaggcttgaacagaagactaccctttccttagaaacagcagcggggctggccattgttcgttcttccaaaagtaaggttctggccgcaaactttccccatttccagaaatcttccctggggctcaaggggttttgaaaaaaagggggaacggtttttggggaaagcccccctggaaaccccgccccccaaaaaaatatttggggccccaacccctttctccgggggggaaaacttttttttgtgtggggggggaaatcccccaaacccacttgggtggggggggtttatt

SEQ ID NO: 95358 - protein, 208 aa, Zea mays
  misc_feature: Ceres CLONE 1585540
  misc_feature (144)..(144): Xaa is any aa, unknown, or other
GAPRGGGRSRTSGSPGLQEFVSPLEKFVLWKSYKHVSNLRATARSAPDVKPEEFAVLVRDIPRPSPDETIKDSVDSYFRALHPNTFYRSMVVTDHTKADKIYQEIEGHKQKIARAEVVYANSKTESNTEGTRPTHRTGFLGLMXNKVDTIEYCTEQIKEYCPNWRLEQKTTLSLETAAGLAIVRSSKSKVLAANFPHFQKSSLGLKGF

SEQ ID NO: 95359 - DNA, 913 bp, Zea mays
  misc_feature: Ceres CLONE 1585542
  misc_feature: Encodes the peptide sequence at SEQ ID NO. 95360
ctggagctccccgcggtggcggccgctctagaactcgtggatcccccgggctgcaggaattcgtctcacccctagaaaaacccccccatcagatgatcagatcagtccgtccctgcccatctgccctgctctctaatggcattaactgccgcccacccacccgccatctcctcccctacccagctgcacacgctcctcttctcctgctagcagtactgctatatatcaataatactaactggaccctttccactcccctcacctctcactaccaccaccactgccccggatccataccaactgcagcagcagcgcgcgcgagctatcttcagtcggtcgatagatcgatcgatcgctcggccatcatggcgcgggaggagcaggcgctgctgtccaccgagatcgtgaaccgcggcgtggagccatcgggcccggacgccagctcaccggcctactcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcaaccgcgacaagctgtggcgcaaggtgtggggggaaggcacataagacttcgccaccggtgctcgcatccctcacggtcatcacaatcaccatctccgtctacatcaagtccaggcccaggccccgtgtacttcatcgacttcgcatgccacaaaccgggcccacaaactcaatgtgtccaaaggccggatttatttgaccttggcgcgccaattcgggaaaaatttcgaacaaaaaacatcctgagcggttccaaatcccgggtctgtcttggccaaaaatcctgttatatcgttgaacaaaga

SEQ ID NO: 95360 - protein, 95 aa, Zea mays
  misc_feature: Ceres CLONE 1585542
  misc_feature: SWISSPROT Homolog: EC 2.3.1.119 Icosanoyl-CoA synthase
MAREEQALLSTEIVNRGVEPSGPDASSPAYSVRVRRRLPDFLQSVNLKYVRLGYHYLISHGVYLATIPVIVLVCGAELGSLNRDKLWRKVWGEGT

SEQ ID NO: 95361 - DNA, 811 bp, Zea mays
  misc_feature: Ceres CLONE 1585543
  misc_feature: Encodes the peptide sequence at SEQ ID NO. 95362
  misc_feature (667)..(667): n is a, c, t, g, unknown, or other
ctccccgcggtggcggccgctctagaactagtggatcccccgggctgcaggaattcgtctcacccctagaaaaagcgcaatcaaactgcggtggccaaccccggaagcggcggcgggcaaagcgcgcgacgcagagaagcgtaacttcaggccgccggtcgctctacgcatcctgctccccgttctcgtcggagatccaccggggcagcctttctttccccttcctcaatcaagtcgatccaatttcgcgcgcgggtcgggctcgccttctcctccagtctccacctccaccagcgctcgaggtcgacggacgctactcgcagcagttcttctttgcggtgcggccgagaagaagctaaggctcaagcatgagcttccgggaccaggagagtggcggggaggatgggggcaggacgtcctccgcctccgacctgcggaagccgctcatcaacaccgggagctggtaccgcatgccgccggcgggtggcgtgatgggctcgcggcaatccagcctcatggagcgcttgggctcctctgcgaactctcgtcgcgacgtcgctatctcggccacgctctgcacgcttattgtcgcgctaggtcccatccagttcggtttcacatgcggatactcctcgccccggcagacgccatcattgctgatctcggnctctccttctcgaggtctccctcctcggttcattatctatgtaaggggcaagggaggccccatccccgggggcaactttgcaagtaaaccgcccgagggggtcttccaagaaggggcggattcaaaaaaattggggtggtcgca

SEQ ID NO: 95362 - protein, 147 aa, Zea mays
  misc_feature: Ceres CLONE 1585543
  misc_feature (100)..(100): Xaa is any aa, unknown, or other
MSFRDQESGGEDGGRTSSASDLRKPLINTGSWYRMPPAGGVMGSRQSSLMERLGSSANSRRDVAISATLCTLIVALGPIQFGFTCGYSSPRQTPSLLISXSPSRGLPPRFIIYVRGKGGPIPGGNFASKPPEGVFQEGADSKKLGWS

SEQ ID NO: 95363 - DNA, 1111 bp, Zea mays
  misc_feature: Ceres CLONE 1585545
  misc_feature: Encodes the peptide sequence at SEQ ID NO. 95364
  misc_feature (397)..(397): n is a, c, t, g, unknown, or other
  misc_feature (406)..(406): n is a, c, t, g, unknown, or other
  misc_feature (407)..(407): n is a, c, t, g, unknown, or other
gagctccccgcggtggcggccgctctagaactagtggatcccccgggctgcaggaattcgtctcacccctagaaaaaatgggattgacgcacacacccgccctccgccccgcaagccaaatacgccgtggcacgcgtcgccatgccgccccagttccccaccgcccgcctcctcctccctagtcacaggctgctcccgctcctctcccctctcccctccgcgtccctgtcccctgctcctcgcaccctccgcctcccgccgccgcagcttcttcaccgagtcgcccgccgccacccgctgctgcgcggcatggcctccgccgccgcccccgggtcacacgccgccgcggaagcgccccccgtcgacgtggggggaggggggcgctgtgtgtgcccancccccccannctgaaggacctgcaccgggacccttctctcctcctccagaaaaccggccaccccccgaacgggatacaatcgccggcgcgaagtaccattaggcactgtttaattcagggctgttcttgccccttgtcccaaaggatcccagaggcggggagttggggaaagcgatttgttcttaatttgcggaagcaagggaatgtctttcaaacggggggggaccaataagagttggggtcttccacaaggcccgagaagtgttcgccgtccgctccaatgtttctccagggggggcaaaggttactctattcatggagtgtgcgcagtgtgcctattggcaaggaaagaaatattttttagaggatttgtaactcgagcctgtgggacatgatattgggggggaagtgcgctaacaccagaggtagggtttttatggcatgcgcgaatagcctcagtttttgaagagggcggtatagagagagctagactctctggttgttgacagaccgacacagggggatagcagagggtgcgggtcataatgtgcgaaggaggatcagaaggaagcgcgcctatcccggaaaatggacgccataagtgtcctcctcccatgtgagagtcgcatcttacaagagtctgctgcaatacgcgcggggtgatgttcttcttccacgatgtctgtcggtgtcttgaggtgttatagagatggg

SEQ ID NO: 95364 - protein, 32 aa, Zea mays
  misc_feature: Ceres CLONE 1585545
  misc_feature (30)..(30): Xaa is any aa, unknown, or other
MASAAAPGSHAAAEAPPVDVGGGGRCVCPXPP

SEQ ID NO: 95365 - DNA, 935 bp, Zea mays
  misc_feature: Ceres CLONE 1585546
  misc_feature: Encodes the peptide sequence at SEQ ID NO. 95366
  misc_feature (935)..(935): n is a, c, t, g, unknown, or other
ccgctctagaactagtggatcccccgggctgcaggaattcgtctcacccctagaaaaagcgacccctcgaccgtgcgaacgagcaaaggacaaatatcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccgcgggtagcatacgcgccgtctccgcgcctgcgaagaaggacgcttctgaagtttagcgaaagcagggtttgagataatcaaggcccaacgagcaaccttcctcccgggtacccttttgaaacgagggagttggtcttcagaggggccccaaatattcaacgaagagttgctggttcagcctgattcaaagtttccttggaagcttccccccaaactggccctagaatgcccgtggggccaaaaaaaaatacccccgttttatgcccccgggaacaaaaaaaccctttttgggggaaagtttcccaaacccaaccttttttttttggccggtggggaaacccccaaccccggaaagaattttgggcctctgggaaaccattcccccccttgaaaaacacggggagaaaaatttcccttgtgggccggggggtttctcttaaaaaacaccttgaaaaaaccgtgttttttaaccccctgttattaaaaaaaaaatggggcgctccccactttggggggctttgggcgggctatttcccccaggagggtgattttttcctccgcgggaacccctttttgttaaaaaaaaaattactcttttttttttccccccacaccccccggagaaaaatgttgccccn

SEQ ID NO: 95366 - protein, 62 aa, Zea mays
  misc_feature: Ceres CLONE 1585546
MSGAIGGAEVHGFRGAAAQLPRSRVLGRPIRVAPPAAARPGGASAGSIRAVSAPAKKDASEV

SEQ ID NO: 95367 - DNA, 892 bp, Zea mays
  misc_feature: Ceres CLONE 1585547
  misc_feature: Encodes the peptide sequence at SEQ ID NO. 95368
aaagctggagctcaccgcggtggcggccgctctagaactagtggatcccccgggctgcaggaattcgtctcacccccccctagaaaaagaggacatcctcggccttccagggcagcaaccacgaaagccttctgcgcggggtgctttcctcgcagcaaatattcctgccttttgcattccggctttgcaagttccttgctttgggcatatatattgtgaggtctctatatatataggtggttcgaggtgatcggcagaaccacacaggcaaagatggcgagcgtgcacaaggccaccacccttgttctcatgttctgcctgctagcgctggggagagcggagtacctcaagtacaaggacccgaagcagcccgtcgctgttcgcatcaaggacctgctgggtcggatgactctcgctgaaaagatcggccagatgacgcagatcgagagggaaaacgccacggccgacgcgctggccaaatacttcataggtagcgtgctgagcggcggaggcagcgtgcctgctcctcaggcgtctgctcaggcttgggcccgcatggtgaccgagatgcagaaaggcgctctttctacgcgtctgggtataccgatcatctacggtatcgatgcagtgcatgggcacaacaacgtctacaaagctactattttccctcacaacgtcgggcttggagctaccagggaccctgacttcgttaaaaagaatggaaaaaccacctgctccttgaagttaaacttactggaaattcttaacgcctttgctcccctgaaaaacgggttttaaaaaatcccaaaaggggaacccttccttaagaactcccggggaggaacccaaagggtgccccaaacaccgaaattcccataatttgtgggcggga

SEQ ID NO: 95368 - protein, 174 aa, Zea mays
  misc_feature: Ceres CLONE 1585547
MASVHKATTLVLMFCLLALGRAEYLKYKDPKQPVAVRIKDLLGRMTLAEKIGQMTQIERENATADALAKYFIGSVLSGGGSVPAPQASAQAWARMVTEMQKGALSTRLGIPIIYGIDAVHGHNNVYKATIFPHNVGLGATRDPDFVKKNGKTTCSLKLNLLEILNAFAPLKNGF

SEQ ID NO: 95369 - DNA, 932 bp, Zea mays
  misc_feature: Ceres CLONE 1585549
  misc_feature: Encodes the peptide sequence at SEQ ID NO. 95370
  misc_feature (436)..(436): n is a, c, t, g, unknown, or other
  misc_feature (437)..(437): n is a, c, t, g, unknown, or other
ctggagctccccgcggtggcggccgctctagaactagtggatcccccgggctgcaggaattcgtctcacccctagaaaaatagttccagagccctccagagcaaaaaaaatatattatcgaatactaaagcattttcctcatcgatagaatatagaattttaaaaagggagcgaaataggtttttcctttttgcagctccgtcgtccaccaacctcctccgatccggccgccgcagcgtagccgaattgtcccctcgctagcttctccggccggctagaggctgtttcaggcggcctcgatctcctccgcgcggctgaggaaggagatcacgcggttgctcaggggctggggcgtgcatgatgggattttggttgattccgatggagactccggcgaagcttctgtggagcacgagcttcttccgccacaagatcnngcgcatgctcgcctcctccctctggcttctatagatccaacccccctcgccgtcgtcgtcggcacggcagctagctcgctagcttcgggacatagggcgaaccgccaataaaaatactaggctctgaataaccggaaaattaaaggcaaaggatcctccagtttggcttcctctttgccatgaaccagggaatcgggaagggtatttttaaaaccccggggtttggggcccggggaaaaattttttttctcaaattgggggaaaggggggggctcccgggggggggtttttttccttgggggggggagaacctatttttttctttaaaaaaggggggggggaaaaaaaggctttttttttttccccccaagaaagtttcccgggggaaaaatatcacaaagacacctcccaaaaaaaaaaacccccccctccccaaaaaagggtttttttttggaggggattcttgagggaaaaaaaaattttggccgggcaaaa

SEQ ID NO: 95370 - protein, 37 aa, Zea mays
  misc_feature: Ceres CLONE 1585549
  misc_feature (27)..(27): Xaa is any aa, unknown, or other
MMGFWLIPMETPAKLLWSTSFFRHKIXRMLASSLWLL

SEQ ID NO: 95371 - DNA, 1016 bp, Zea mays
  misc_feature: Ceres CLONE 1585550
  misc_feature: Encodes the peptide sequence at SEQ ID NO. 95372
  misc_feature (406)..(406): n is a, c, t, g, unknown, or other
tggagctccccgcggtggcggccgctctagaactagtggatcccccgggctgcaggaattcgtctcacccctagaaaaacctagaaaaaaacaacgcctcctccagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccgccccccgcgcccnacccgcgggggggggcggtcctggaagccaagagcttccccgttgctcttcgacttgggaaagggtgggagaaaaagggacttgttcaggggacacctacttggccgggcacgctccctcatggggggggttaccgtagttttggtcgcgacgggggaacccttccgaagcccccacagaaggagaggggaaggtgttttgtttctttttcccgtgctgggatctccggggaaggggaaaagtgtgtcccccgacccttccggcgtcttaaggttcctcctcctattcccctgacaacgtttgtaagacgcaaattgttgggcaaaggaggtggacaaggtctcaaaatttccccacggcgccgtagggggcggggggattctcttagttgaatttgttaggtccagtgagcgttatgttcgggtgtggcgcccctctttagagcggtatagagagttggggagtggggcgaaggtgcgccgagacaaagagatagcgaagtatttcgccgcacttttggcgataatctgccccggcgagtgttgtgtgtgcaagttaagataatgcatgtgtgtggagcacgaggagaatgtgacatcgctgtagcctg

SEQ ID NO: 95372 - protein, 113 aa, Zea mays
  misc_feature: Ceres CLONE 1585550
  misc_feature: SWISSPROT Homolog: EC 4.2.1.92 Hydroperoxide dehydratase
  misc_feature (68)..(68): Xaa is any aa, unknown, or other
MASSDHGSTTAPKDVPGSYGLPLVGAVRDRLDFYYFQGQDKYFESRVERYGSTVVRMNVPPGPAPRAXPAGGGGPGSQELPRCSSTWERVGEKGTCSGDTYLAGHAPSWGGLP

SEQ ID NO: 95373 - DNA, 899 bp, Zea mays
  misc_feature: Ceres CLONE 1585554
  misc_feature: Translation starting site: 344
  misc_feature (651)..(651): n is a, c, t, g, unknown, or other
aagctggagctccccgcggtggcggccgctctagaactagtggatcccccgggctgcaggaattcgtctcacccctagaaaaaattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcgggtgggcgtggcgcccgaggtgggcaggggtcgtcgtcggcgaccacaatgctcagcaggcggcgcagctccctccgccgcccgccgctgccgcggtggtccctcgcaacgaggcgcccgccgtcgtaccgagaactgtggtggctcctgcggcgcccgaggacgagcagctgggcgtgaccanccgtgacttgatgcacctctggcggctcgtccagaagaggacggtggcccgtcgtggatcacatgatggaccgcaccttgccgaccatgaggtaccaggcctggcggagagacccaccgaatggtccacaacagtaccgcagtagcactatctttgaggatgcatcaccagaaggttgtgagagatttcttctgggacgacgaatttccgggtgaggaacagctggaacaacatgcttcttcagtaca

SEQ ID NO: 95374 - DNA, 910 bp, Zea mays
  misc_feature: Ceres CLONE 1585557
  misc_feature: Encodes the peptide sequence at SEQ ID NO. 95375
  misc_feature (721)..(721): n is a, c, t, g, unknown, or other
  misc_feature (730)..(730): n is a, c, t, g, unknown, or other
ctccccgcggtggcggccgctctagaactagtggatcccccgggctgcaggaattcgtctcacccctagaaaaaaaaaaaaaccttcccggcgcggcggcgcggcgccgaaaccgaccgacgccgcttatccacttcgcccgctcccatcgcggcttgctattctcatcacgtccatcggcggtccctctccccgggacgcgaactcctccgcaccgccttccaccgaagcgaagcactctacccaccttcctgctgccgccctcttgtgcacgggcgtggaacgtagatctgtctgtgctggcacttgttttttgctttcattggtcagtattttgcagctaaaaggataattcacatttgttgctatcaaggtttttgaaagttttatatgattcagagaaatatatattcttcggctagtgggtctgctcattgatggaaggcaaccagattttggtccagtcagagcagagccttataccaggtgtgcaaactcttgtcatcggtcaagagtttgcagatgttgacacttgtcggagggctgtcaaggacatggccattgctttgcactatgagctccgtgtggtgaaatctgatcgtagccgtttcatcgcaaagtgctcaaaagaagggtgcccttggcgtgtgcacatcgctaagtgccctggtgttccaactttcactgtcaggactttgcatggggacacaaatgtgaggtntgtctgaanctgcatcatcagcaggctactggtggggtggggtgctaggtctgtcgaggcaaggctcagggataaccctcagattaagccaaagagatactgcaggatattcgggagcagcagggggtccctgtttcttaatgcaagcatggcgtgaaaagaaaaaacatggcttcagtattgggactc

SEQ ID NO: 95375 - protein, 96 aa, Zea mays
  misc_feature: Ceres CLONE 1585557
  misc_feature (95)..(95): Xaa is any aa, unknown, or other
MEGNQILVQSEQSLIPGVQTLVIGQEFADVDTCRRAVKDMAIALHYELRVVKSDRSRFIAKCSKEGCPWRVHIAKCPGVPTFTVRTLHGDTNVRXV

SEQ ID NO: 95376 - DNA, 792 bp, Zea mays
  misc_feature: Ceres CLONE 1585560
  misc_feature: Encodes the peptide sequence at SEQ ID NO. 95377
  misc_feature (344)..(344): n is a, c, t, g, unknown, or other
aagctggagctccccgcggtggcggccgctctagaactagtggatccccctgggctgcaggaattcgtctcacccctagaaaaagactctttcatttccttctaccgcagcctcagaattcccccctcccccgtagcgaaaccctagccgccacgccaaaaccaaatcccgccgagcccgaaaaattccggcgggttccttgccgcgaatcgattgatttcgagcgattcgattccttgtgatctctcggcggggtagagcgcggtcgaccgtcggccatgtcgaggtgcttcccctacccgccaccggggtacgtgcggaacccagtgggcgtggccgagccngagtcgaccgctaaggtttgttgaactttcggatttacccacgcacgtgccaaatcggtttgttcaataggtaggttttgcccggatcggtggtttgcccctgcttgaagtggggaatgcccgtggctaagctacccagcttaagaaaggaatggatttttggtaacttaaacaggtcctcccaaatcattggaaaaatttaatttttttggccgggaggcccaaattggggttatcccggtttttcaaaaccggggaccgggggttttcggggacttttgaaaaaattttaaaaaccccaaattttttttaaaaggggggggaaaattggaaaatttaagccccccccaaaaaatagggggagcgggggggggaaccaaaaaatgggttttttttaaaaaggggggggaaaaaaaaaaccccccttggtgggttcttcgggaggggg

SEQ ID NO: 95377 - protein, 29 aa, Zea mays
  misc_feature: Ceres CLONE 1585560
MSRCFPYPPPGYVRNPVGVAEPESTAKVC

SEQ ID NO: 95378 - DNA, 880 bp, Zea mays
  misc_feature: Ceres CLONE 1585561
  misc_feature: Encodes the peptide sequence at SEQ ID NO. 95379
  misc_feature (799)..(799): n is a, c, t, g, unknown, or other
  misc_feature (827)..(827): n is a, c, t, g, unknown, or other
  misc_feature (846)..(846): n is a, c, t, g, unknown, or other
  misc_feature (863)..(863): n is a, c, t, g, unknown, or other
ctggagctccccgcggtggcggccgctctagaactagtggatcccccgggctgcaggaattcgtctcacccctagaaaaaatcttcggaccttccccagttccccgcgatatcgctagggtttccgcgatggcgacacttcgctccccgagcccccgcggagacgttctcctcgactcggcgccgctcctcggtggtgtcgggcggcaccgcgcgggcgcgctgcgccggccgtctctccggggcgcggcgcggctgctgcggcgtggcgggcgccgagcgatgcgggagccgtcactgctggtgcgggaggccgcggcggagcagctggaggaacggcaggcggattgggcctactcccgccccgtggtggcgctcgacttcctttggaacctcgccttcatcctcgtctccgccgtcgtgctcgtgctcagccacgacgagagcccctccatgccgcttcgtttctggatcgctgggtacaccgcccagtgcgtcgtccacatggtctgcgtcgccatcgagtatcgtttgcgatacggccagctcggcgggtcgccaattcctgtcgacgaggagagcgggaggtggtagtgcgtcgtcctcctccagcgacgacgacagagagcacggctcccatagtcgaagtggcgactgcctcagcaaggactaagccctctggagtgagccagctaatgacgtcagctgcttccatcgagatattgagcagcagtaccagtctaagctggggagtgacaccggaggaaagttgctggggtgatctggatctggatgctgcntagcagtggcgggagacaatcaaaattnagggtgtgctacacaaacnatgggaaaaaactgttnagactacattggctgaa

SEQ ID NO: 95379 - protein, 154 aa, Zea mays
  misc_feature: Ceres CLONE 1585561
MATLRSPSPRGDVLLDSAPLLGGVGRHRAGALRRPSLRGAARLLRRGGRRAMREPSLLVREAAAEQLEERQADWAYSRPVVALDFLWNLAFILVSAVVLVLSHDESPSMPLRFWIAGYTAQCVVHMVCVAIEYRLRYGQLGGSPIPVDEESGRW

SEQ ID NO: 95380 - DNA, 841 bp, Zea mays
  misc_feature: Ceres CLONE 1585563
  misc_feature: Encodes the peptide sequence at SEQ ID NO. 95381
tggagctccccgcggtggcggccgctctagaactagtggatcccccgggctgcaggaattcgtctcacccctagaaaaaagcacagggcactgcccgattccacccctgcagcctctcgctgcccactttccatgtcactgcaccactgccgcgctgccacgacgcccgccatgcccgccaccggcctctcgtccgcgggcgcttccccgtttcgcctgcccgcctccagctcctccgcccagggccacctccgtctctccccccctgctgccagtgccaccgcctgccgccgccgcttgcttctccgctgcgccgcctcttctggcggtggcggcggcagcggctccgacccggtcctagaggagcagcggcgccgccaggccgagctcgccgcgcgcattgcgtccggcgagttcaccgtgcaaggccccgggtggattgcgcctctcgtggggaggctctccaagctgggcccgccgggggagctcgccgccgcgctgctcaccagggtagcgggcgctggcggccccggagatcccgcaggcagtggggtcgatcaacgcggtcgtgggccagcctttctcgtgcccctgtacgacctcttcttcacctacggcggcatctttcgcctcaactttggacctaagtcgttttctattgtctccgatcccgctatcgctaagcacatccggagggagaactcaaagcttattccaggggaatcttgctgaaaaattggagtttgtgatgggtaaccgtttaatcccactaaaggggaaaatttggcgttttcggaggggggtaatgttcccgcacggaataaaaatatgtaactgccaa

SEQ ID NO: 95381 - protein, 186 aa, Zea mays
  misc_feature: Ceres CLONE 1585563
MPATGLSSAGASPFRLPASSSSAQGHLRLSPPAASATACRRRLLLRCAASSGGGGGSGSDPVLEEQRRRQAELAARIASGEFTVQGPGWIAPLVGRLSKLGPPGELAAALLTRVAGAGGPGDPAGSGVDQRGRGPAFLVPLYDLFFTYGGIFRLNFGPKSFSIVSDPAIAKHIRRENSKLIPGESC

SEQ ID NO: 95382 - DNA, 1152 bp, Zea mays
  misc_feature: Ceres CLONE 1585565
  misc_feature: Encodes the peptide sequence at SEQ ID NO. 95383
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (341)..(341): n is a, c, t, g, unknown, or other
  misc_feature (352)..(352): n is a, c, t, g, unknown, or other
  misc_feature (373)..(373): n is a, c, t, g, unknown, or other
  misc_feature (376)..(376): n is a, c, t, g, unknown, or other
  misc_feature (377)..(377): n is a, c, t, g, unknown, or other
  misc_feature (398)..(398): n is a, c, t, g, unknown, or other
  misc_feature (401)..(401): n is a, c, t, g, unknown, or other
  misc_feature (1103)..(1103): n is a, c, t, g, unknown, or other
  misc_feature (1112)..(1112): n is a, c, t, g, unknown, or other
  misc_feature (1114)..(1114): n is a, c, t, g, unknown, or other
  misc_feature (1115)..(1115): n is a, c, t, g, unknown, or other
  misc_feature (1116)..(1116): n is a, c, t, g, unknown, or other
  misc_feature (1117)..(1117): n is a, c, t, g, unknown, or other
  misc_feature (1120)..(1120): n is a, c, t, g, unknown, or other
  misc_feature (1121)..(1121): n is a, c, t, g, unknown, or other
  misc_feature (1122)..(1122): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttnnnttacaagctgggactcaccgcggtggcggccgctctagaactagtggatcccccgggctgcaggaattcgtctcacccctagaaaaatcgggctgcggcatatccccttctccgtcctcccgcctgcccgcatgtctttcgcttcgccctcgncgccggcgccngcggaagaagagggccgggcnccnnaccagtacgtgctgatcaccngcngcgtcgtcagcggccttcgcaagggcgtcaccgccagcagcatcggggtcgtcctcaaggcctgggggctcccggtaccttggctcaaaaacggatcccaacttgaaacccgaagcctgggacaaatggccccccttttgaacagggcaaggggtttttttccttaaaaaaagtgggaaaagttttccctttgttttttggggaaaaatttaaagccttttctacaaaagtttttccccccccggggggggaaaaaaccttttccccccccggaagaaaaaaaccccccccccccccttttaaaaaaaaaaaaaaaaaaaggggggtttttttttttttaaaaaaaaaaaacccccggggttttttttttcccttcggggggggggagagaaaaaaaaaaaaaaaagggggggaaacccccccgggggggccctcccccccccccccgcggcgggggggggggggagaacaccccccccccccccaaagtggttttgtgggtgttttaaaaaaaaaaagatgggggcgccgccccccccggaaaaatattatttttttttcccccccccccctctcttttagaaggggtggggcggggccgagcaaaaataatttttttttttttttgtttgggaggagaaaaaaaaaaattttttccccccccccaaaaaaaaaataaatttttttttaaaacccaggggnggggggggngnnnnggnnntttaaaaaagaaaaaaatacaccccccccc

SEQ ID NO: 95383 - protein, 82 aa, Zea mays
  misc_feature: Ceres CLONE 1585565
  misc_feature: SWISSPROT Homolog: EC 6.3.4.2 CTP synthase
  misc_feature (8)..(8): Xaa is any aa, unknown, or other
  misc_feature (20)..(20): Xaa is any aa, unknown, or other
  misc_feature (27)..(27): Xaa is any aa, unknown, or other
  misc_feature (28)..(28): Xaa is any aa, unknown, or other
MSFASPSXPAPAEEEGRAPXQYVLITXXVVSGLRKGVTASSIGVVLKAWGLPVPWLKNGSQLETRSLGQMAPLLNRARGFFP

SEQ ID NO: 95384 - DNA, 1259 bp, Zea mays
  misc_feature: Ceres CLONE 1585566
  misc_feature: Encodes the peptide sequence at SEQ ID NO. 95385
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (860)..(860): n is a, c, t, g, unknown, or other
aaacccttgctgggcggcccgagggtgggggcggcccatccggcaagagtgttnnnnnnnnnnnnnnnnnccaaagctggagctccccgcggtggcggccgctctagaactagtggatcccccgggctgcaggaattcgtctcacccctaaaaaaaatgcaacgccttccacacttgaagcagccaagctaagtgaggtgagcttagccatgccgacggcttcctctgcccaccgctcactcctcctctgcctctgcctggatctgctctccaacccggtcgccgcctcgccctcgccccgcggccgccgcttctccgccaaggacatcgcggcgagtggaggccgcgctgccgcgacacttttgcagggtgtcggcgacgtctagtaccaccggcgttggaggtggaatgaccattcctccatcccagaggcagctcagggccctgcttcacgctgttgcttctgaattccccccccctttttcgcttaacaaagtcgcccgatcaccacggacctacttcggcgcctgtcgtggctttgtaacggcttccgagcgcgccagctagttttttttttcacccagttttttatttggtcgcgaccaaggtgtgccgcggttgtcgcgacttactaacctgccattctactcaggccttggtggtcttaggaatagtcgacggggagtcacccggggcgacgtgtataggcccccccgctcggaagcgatgtggacgtcccctagactagaggaatcgagagtcgggtgggtgtttcattggtcacccaagagcgcagtatataatattcgttggggatgtgtaccactatgggagaggtccacccgcacattaatagcgangacagagtgactaatgattagactacgctgggttcgcgggtactctgactatatctctttagtggggaacagactccagtctatgcggaatataagacgatctcccatagatttgacggtagcagtcgattccgtgttcgtgcgcttgggatagtgcataccaggcgctcttagctcacaccgtctctgaagtgtgttcaccagccactctaggggtggtaggaacgggaggaagagaacgaggtgctcatcgctctctatgatgagacgcacgcgcttatgagtggctgtgaccgcggcacgcggctacgcggccgtggagaatgacgagtggtgcaatggcaagattgtagggtgcttccgttagtttctgctttgataccccgagagcagcagtac

SEQ ID NO: 95385 - protein, 58 aa, Zea mays
  misc_feature: Ceres CLONE 1585566
MPTASSAHRSLLLCLCLDLLSNPVAASPSPRGRRFSAKDIAASGGRAAATLLQGVGDV

SEQ ID NO: 95386 - DNA, 866 bp, Zea mays
  misc_feature: Ceres CLONE 1585572
  misc_feature: Encodes the peptide sequence at SEQ ID NO. 95387
  misc_feature (752)..(752): n is a, c, t, g, unknown, or other
  misc_feature (796)..(796): n is a, c, t, g, unknown, or other
  misc_feature (851)..(851): n is a, c, t, g, unknown, or other
  misc_feature (862)..(862): n is a, c, t, g, unknown, or other
tggagctccccgcggtggcggccgctctagaactagtggatcccccgggctgcaggaattcgtctcacccctagaaaaatttattagggatgtgcaaagatttagcaagggattgatctcttaacagattgtacttagcaattagcatgaccttttttagttggaaacatgctagctatagtttttaaggaatgtttagatccaccctactaaagttttagtccctgtcacatcgaatgtttgaatgataatttaattacgagtattaattaaaaaaatcgcgctgtctacctctctctctctctctcatcacagcacagctccagctctaggctgtagagggtggaagaagcgaggtcgagtcacagaggcctgcagcaaccgtctgcgctgagcatcgaggccgcgctctgcagtctgctgtctgctctccctcgataagccgggttccaagctagctctgcagagtgtgagctctgactgaacacgaagtgattggcggcttctcatcgatcgatggttgtgttgtgctggccatctgagcgatgaaccagttcgtccctgattggagcaacatgggagacacctccaggccgctcggcgaagaagacgacctcatcgagctgctctggtgcaacggccatgtcgtcatgcagagccagagccaccggaaggtgccgcctaggccggagaaggcggcggcagtggcggcttcaccagcccccgcgtccgtgccgcaggaagacgagggnccgcctgtggttccccttcgcgctggccgactcgctggacaggnacatcttctcgggagttcttctgcgaaccaccaacgccggcaccgggcggcggcngaatgcgcgtngggc

SEQ ID NO: 95387 - protein, 107 aa, Zea mays
  misc_feature: Ceres CLONE 1585572
  misc_feature (84)..(84): Xaa is any aa, unknown, or other
  misc_feature (106)..(106): Xaa is any aa, unknown, or other
MNQFVPDWSNMGDTSRPLGEEDDLIELLWCNGHVVMQSQSHRKVPPRPEKAAAVAASPAPASVPQEDEGPPVVPLRAGRLAGQXHLLGSSSANHQRRHRAAAECAXG

SEQ ID NO: 95388 - DNA, 987 bp, Zea mays
  misc_feature: Ceres CLONE 1585574
ctggagctccccgcggtggcggccgctctagaactagtggatcccccgggctgcaggaattcgtctcacccctagaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcccccccctggtccttttgcgctttctcgtccctctttctctcaatctctccttattcttctccttccacggcgaagccgggcggctggtatggatcccaatgggcctcaaaactgggaggccttttgctcccgaacatcgaggagggggtgcacgtccccctccatccgtcatttgccatccgcggttggcatctcgggggtttgaaattgcccctggcccctttccaatttttcttttaagggggacgtttttgtgaaatccagagaaatttattttggggggggcctttcctaccgagaaactccccttgggagcgcccaattgaatggggggccccctgggtggtcccggggctgttggaaagaggaaaacccccgggccccctttgataaaatcttttctgggggggggggtttatcccccgcccacgcgaggagacacacccccttctttggggcaccgagttttataaacggcctccttctttttttaaagaggagagaggaatccggcgcccaccggaggaaacgttctctaaaaggtgggagaaaaatctccgggagatattcttttagagagaggggggggggg

SEQ ID NO: 95389 - DNA, 881 bp, Zea mays
  misc_feature: Ceres CLONE 1585576
  misc_feature: Encodes the peptide sequence at SEQ ID NO. 95390
  misc_feature (729)..(729): n is a, c, t, g, unknown, or other
  misc_feature (873)..(873): n is a, c, t, g, unknown, or other
ggagctccccgcggtggcggccgctctagaactagtggatcccccgggctgcaggaattcgtctcacccctagaaaaaaaaaacttctcggcggggtttctgcgctcgcctctagctcagccggccggcctctccgattcctcttcctccgtgcctcccactcagccggccggccagacccacccactgcctggtgatcgtcgtgctcgtggtggcgggtccggcgagcgagcgcggcgcccatggcgagcgacggcgaccacggcggcgcgctgcagaagccgctgctgccgaaggcggccaggggcgggggctggttccggaaaggtacgagcacggcgcacccgtccggcctcagcgccgccgctgccggcacctcgtccaaggccgccgcgctgcggccgacccaccacgtgcccgcgctgctctgcacgctggtcgtcgcgctcggccccatccagttcggcttcaccaccgggtactcctcgccagcgcaggacggcgtcacccgggaccttaacctctccatctccgagttctcggcgttcggctcgctgtccaacgtgggcgccatggtcggggcgatcgccagcggccagatggccaagtacgtcggccgcagagggtcactgatgattgcggcggttccgaacattatgggctggctcgcaatctccctggccagagacacttcgtttctgtacatggggaggctgctggaaggattcngtgtcggtgtcatttcctatgtggtaccagtatacatagcagaagatatctcacaaaacatgagaggagctcttggcgtcgtaaacccgttgtctataacctttgtgccatgcttgctatgtgcttggcttgttttttcctggnagcttctt

SEQ ID NO: 95390 - protein, 213 aa, Zea mays
  misc_feature: Ceres CLONE 1585576
  misc_feature (163)..(163): Xaa is any aa, unknown, or other
  misc_feature (211)..(211): Xaa is any aa, unknown, or other
MASDGDHGGALQKPLLPKAARGGGWFRKGTSTAHPSGLSAAAAGTSSKAAALRPTHHVPALLCTLVVALGPIQFGFTTGYSSPAQDGVTRDLNLSISEFSAFGSLSNVGAMVGAIASGQMAKYVGRRGSLMIAAVPNIMGWLAISLARDTSFLYMGRLLEGFXVGVISYVVPVYIAEDISQNMRGALGVVNPLSITFVPCLLCAWLVFSWXLL

SEQ ID NO: 95391 - DNA, 849 bp, Zea mays
  misc_feature: Ceres CLONE 1585578
  misc_feature: Encodes the peptide sequence at SEQ ID NO. 95392
ctccccgcggtggcggccgctctagaactagtggatcccccgggctgcaggaattcgtctcacccctagaaaaaactccctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcacgactcacagaggcaggcacgagggatgctggggtgattgctggcctcaatgtgctgcgtatcatcaatgagccaaccgctgctgctattgcctatggtcttgacagaaagcaccagcgtccgtgagagaatgtcctctcttgaccctggagtggtaccttcgagtctccctcttactatggagaaagtatctt

SEQ ID NO: 95392 - protein, 177 aa, Zea mays
  misc_feature: Ceres CLONE 1585578
  misc_feature (9)..(177): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISSMVLIKMREIAEAYLGSTIKNAVVTVPAYFTTHRGRHEGCWGDCWPQCAAYHQ

SEQ ID NO: 95393 - DNA, 888 bp, Zea mays
  misc_feature: Ceres CLONE 1585580
  misc_feature: Translation starting site: 218
  misc_feature (604)..(604): n is a, c, t, g, unknown, or other
  misc_feature (756)..(756): n is a, c, t, g, unknown, or other
  misc_feature (888)..(888): n is a, c, t, g, unknown, or other
ctccccgcggtggcggccgctctagaactagtggatcccccgggctgcaggaattcgtctcacccctagaaaaaccttttgactccgccgccgggtctgctcctttattgctgcgcctgcctgattgtcttttctcgtcggaacgcgcggtatcccgagggcggcgatcgcggattcgcctccggaagcggcgatttggtccccagtacagtccgccatgattaagcaaatcctcggccggcttcccaagaagccgaccaaggccggcgagaaggagctggccggcgcgggcccgtcgctgcccagcccgacgtccgacgcgagaaccaccaccgatctgaccgcgtctagcaggcttgtcagccccagcaactacgcctccgcggcaacaaatccaggccagagctacgcgcccagggccgccgggctcggcgccggcgccagcaacgggttcgcgggctcggcggccgggtacgaggcgctgccgagcttcagggacgtgccggcgtccgagaagccgggcctgctcctcgggaagctggccatgtgctgcgtggtgttcgacttcgcggacccgaccaaggacgtgcgggagaaggaggtncagaggcagacgctgctcgagctggtggactacatcacctccgccaccagcaagttcccggagcccgtcgtgcaggaagtcgtcaggatggtgtctgtgaatctggtcagggtgcccacccctgccccgagagagaacaagcgctcagtccnttcgacatggaaggagaggagcccgtcatggaacccgcgtggtcgcacttgcagatcgggtatgagcttgtcctgagggtaattcagtctccggaacggacccaaagctgccaaaaaatcattgaccacgcn

SEQ ID NO: 95394 - DNA, 886 bp, Zea mays
  misc_feature: Ceres CLONE 1585583
  misc_feature: Encodes the peptide sequence at SEQ ID NO. 95395
gagctccccgcggtggcggccgctctagaactagtggatcccccgggctgcaggaattcgtctcacccctagaaaaatctccggcccatcgcccgtgctctgcactgtctcgcctccgacctccgcgccctctcaaggtctcaccggagaccgcgctgcggtccgcgggctttgggtagcgcgggatggcctccgtggggtgggctgcacgcgacgcgtacgacgaggaggccgcagtccgccgccctctcgagctcgagggccgtggcgtcgccgcatcgtcctccgaccaccggcccggcgggaatgtcatgcctaggtatcaagtgggctcgacaaagggtgattcaagtagtagacgacactctgaggagtggcggcaacctagcacagatgatgtgcgcatgagcaagccggggtcgagatatttcacggcgtttggggtggatctgtcccctgataatatggcagttgccattgtatattttgtgcaaggggttttaggtcttgcacggcttgctgtgagcttttacttgaaagatgatcttcatctagatccagctgagactgcagtggtatctggtttctcgtccttgccgtggctgatcaagccccctctatgggctttatcagtgattccatccacctctttggatatcgaagaaggccatatctcttttctgtcaggggtactttggagcactttcattggagctttaatggcccaccggtagtggagcattaaataccgcggcagcattcttctattcctccttgggctcaactttcttgtttgctttcctgcaatggttgaaggggggatttccattgggtggttgaaaagaaccccgttggaaaaatccccaaagttacttcctgggattcc

SEQ ID NO: 95395 - protein, 182 aa, Zea mays
  misc_feature: Ceres CLONE 1585583
MASVGWAARDAYDEEAAVRRPLELEGRGVAASSSDHRPGGNVMPRYQVGSTKGDSSSRRHSEEWRQPSTDDVRMSKPGSRYFTAFGVDLSPDNMAVAIVYFVQGVLGLARLAVSFYLKDDLHLDPAETAVVSGFSSLPWLIKPPLWALSVIPSTSLDIEEGHISFLSGVLWSTFIGALMAHR

SEQ ID NO: 95396 - DNA, 874 bp, Zea mays
  misc_feature: Ceres CLONE 1585584
  misc_feature: Encodes the peptide sequence at SEQ ID NO. 95397
ctccccgcggtggcggccgctctagaactagtggatcccccgggctgcaggaattcgtctcacccctagaaaaaatcttcggaccttccccagttccccgcgatatcgctagggtttccgcgatggcgacacttcgctccccgagcccccgcggagacgttctcctcgactcggcgccgctcctcggtggtgtcgggcggcaccgcgcgggcgcgctgcgccggccgtctctccggggcgcggcgcggctgctgcggcgtggcgggcgccgagcgatgcgggagccgtcactgctggtgcgggaggccgcggcggagcagctggaggaacggcaggcggattgggcctactcccgccccgtggtggcgctcgacttcctttggaacctcgccttcatcctcgtctccgccgtcgtgctcgtgctcagccacgacgagagcccctccatgccgcttcgtttctggatcgctgggtacaccgcccagtgcgtcgtccacatggtctgcgtcgccatcgagtatcgtttgcgatacggccagctcggcgggtcgccaattcctgtctaccaggagagcggaagtggtagtgcgtcgtcctcctccagcgacgacgacagagagcacggctcccatagtcgaagtggcgactgcctcaccaaggacaaagccctctggagtgagccagctaatgacgtccgctgcttccatcgagatatgtagcgcaatacccgtctttgctgggggagtgaccccggaggaaagttgctggggggatcctggatctgggaggctgctaagccaggggcgggagggcaaatcaaaaattaagggggttgccaaaccaaaacaatgggaaaaaaacactttttaaaaca

SEQ ID NO: 95397 - protein, 198 aa, Zea mays
  misc_feature: Ceres CLONE 1585584
MATLRSPSPRGDVLLDSAPLLGGVGRHRAGALRRPSLRGAARLLRRGGRRAMREPSLLVREAAAEQLEERQADWAYSRPVVALDFLWNLAFILVSAVVLVLSHDESPSMPLRFWIAGYTAQCVVHMVCVAIEYRLRYGQLGGSPIPVYQESGSGSASSSSSDDDREHGSHSRSGDCLTKDKALWSEPANDVRCFHRDM

SEQ ID NO: 95398 - DNA, 916 bp, Zea mays
  misc_feature: Ceres CLONE 1585585
  misc_feature: Encodes the peptide sequence at SEQ ID NO. 95399
ctccccgcggtggcggccgctctagaactagtggatcccccgggctgcaggaattcgtctcacccctagaaaaaaatccaccggccccggcccgatcgctatctgggtcactctcacgtcacgaggtcgcccaatggctcggagctgcatcatgacggcgacggcgccgccaccactggtcggcgccggcgtccgcctcctggcagtcgtcgtggcgatgctggtggtcgcgggcggcggcggcggctgccacggcgcgctgctgaaggcgcacttctaccggcacagctgccccgcggcggaggcggtggtgcgcgacatcgtgctggcgcgcgtcgccgccgaccccgccaagctccccgccaagctgctccgcctcttcttccaccactgcttcgtcagggggtgcgacgcgtctgtgctgatcgactcgacgccgggcaacacggcggagaaggacgctgcgccgaacgggtcgctgggcggcttcgacgtgatcgacaccgtgaaggccgtgctggaggccgtgtgccccggcaccgtctcctgcgccgacatcttggcgctcgccgccagggacgccgttctcgttcagttcgggcgggacctgtgagagtgcaacctgggggcgaatcaaagtgctcactccctctagcaagaaaaagccctcttggagtgcgccagataatgaaatacggttggttccgtcgagagttttgtgagggaaaccgggttagagtgggggatgacacctgaggggaaattttctgggggaaactgggtttgtgagcctcgccaagacgagggggggggggaacaattccaaatttagcggttggtgtgaaacgcagaacagaggggataaacaactggtttagagaagtactttaatgttgtacatatctcagactctttg

SEQ ID NO: 95399 - protein, 159 aa, Zea mays
  misc_feature: Ceres CLONE 1585585
  misc_feature (60)..(160): Pfam Name: peroxidase Pfam Description: Peroxidase
  misc_feature: SWISSPROT Homolog: EC 1.11.1.7 Peroxidase
MARSCIMTATAPPPLVGAGVRLLAVVVAMLVVAGGGGGCHGALLKAHFYRHSCPAAEAVVRDIVLARVAADPAKLPAKLLRLFFHHCFVRGCDASVLIDSTPGNTAEKDAAPNGSLGGFDVIDTVKAVLEAVCPGTVSCADILALAARDAVLVQFGRDL

SEQ ID NO: 95400 - DNA, 928 bp, Zea mays
  misc_feature: Ceres CLONE 1585586
  misc_feature: Encodes the peptide sequence at SEQ ID NO. 95401
  misc_feature (835)..(835): n is a, c, t, g, unknown, or other
tggagctccccgcggtggcggccgctctagaactagtggatcccccgggctgcaggaattcgtctcacccctagaaaagatgtgcgtggcagcgtcaaaaatccagagcgctggtaggagtatctcgtagacattgaacaacggctgcatggggagcgcctgcgccacctccatccgcctcgtctcggcgccctctggatgctgtccaagaagaccagcgtcgccaggtccggcgccgcaggcgacgtgcagggccgcagcggctgtcgcggtggccgggtgcccaaaatgatggctcctttggctgccccgcgggagtgatggtcaacggcctgtcacggacccccccgggatgacctggtacccggggcgtccgacccgcccggatgctttgtcccccgggggctaaaaggggaaaggaaaaagacctgaaatggccccggaccgggggggggccttttcccggggccccccgggggggggaaaaagaaccccccggggatttttaacgcggaaaaaagagggggggagccccccctcccggggaaaaccccgggggagaattttcgggggaggcccgggggaaacccccccgagggaaaaaaaaaaagaggggggctctccccccacaaaaaaaagaagagcctccttccgcaaaaaaaaaaccccctttttttttctcccgcccggtgggggccccccacccccatgttttttgtgggcccccccccctcctatatataattaaaaccccccccgccgcgggaggggaaccccccccccaggagggcttcctctttgggggggtttttttcccccgggggggggcgccggnatggaggatatttttataaaacccccccccccccggggagagtttttttggaaaagacaccccctccctccccctcctaagaaagaggaaaaa

SEQ ID NO: 95401 - protein, 40 aa, Zea mays
  misc_feature: Ceres CLONE 1585586
MLSKKTSVARSGAAGDVQGRSGCRGGRVPKMMAPLAAPRE

SEQ ID NO: 95402 - DNA, 988 bp, Zea mays
  misc_feature: Ceres CLONE 1585589
  misc_feature: Encodes the peptide sequence at SEQ ID NO. 95403
  misc_feature (400)..(400): n is a, c, t, g, unknown, or other
ggagctccccgcggtggcggccgctctagaactagtggatcccccgggctgcaggaattcgtctcacccctagaaaaagtggtggtgatcactacccacatttcagttcaccccggcgtcgtcatgtttccccggagctactctcccgctgcacgttccagaagaaaaatggcgtcccatattgttggataccctcatatgggccccaagagagagctcacgtttgccttggagtctttctgggatgggaagagcagcgcccatgatttagagaaagttgcctctgacctcaggtctagcatctggaagcaaatgtcagacgctgggatcgagtacattcgcagcaacacctgctcgtactatgaccagatccttgatagcacgcccatgcttggggcancccccaaagcgctactcttggtactggaggcaagattgggcttgatcacccatttctaaaatggtccggggaaaatggcccctgacccctgcaaagggggaagaacccagggggatggattgcaaaagggccctttctttttggcccctgaaatttgggcccaaaggggccaagttccccatggcccttttctcaacaggggttgtttttggggagaaccacggggggggcaaaaaaagcccccccggtattttttaaaaacgtgtgccccgacgccttttgtttgggaaacaaaaagagaaaaattgtgctctccctcttcaaaaacttgccccggggggggggggggagaaaaaaattatgcccgcgataagttattactctccggcgagggaaagtttctcctctttctacaaaaacagggggtggttctgtttataaagagaaaaaaagaagccctccccacaaactagttttgtggaaagaaaaacaccccctctgtatagaagcatactctttcttaaaaggggggaggctctctcctcccctctttatgagaattggtgaggtatttctttcttttttatt

SEQ ID NO: 95403 - protein, 96 aa, Zea mays
  misc_feature: Ceres CLONE 1585589
  misc_feature: SWISSPROT Homolog: EC 2.1.1.14 5-methyltetrahydropteroyltriglutamate--homocysteine S-methyltransferase
  misc_feature (78)..(78): Xaa is any aa, unknown, or other
MASHIVGYPHMGPKRELTFALESFWDGKSSAHDLEKVASDLRSSIWKQMSDAGIEYIRSNTCSYYDQILDSTPMLGAXPKALLLVLEARLGLITHF

SEQ ID NO: 95404 - DNA, 928 bp, Zea mays
  misc_feature: Ceres CLONE 1585590
  misc_feature: Encodes the peptide sequence at SEQ ID NO. 95405
  misc_feature (398)..(398): n is a, c, t, g, unknown, or other
ggagctcaccgcggtggcggccgctctagaactagtggatcccccgggctgcaggaattcgtctcacccctagaaaaaagcctcctccgtctgctcaagacgagggaggagcagagaccgaactctgccgtctcttcctcctccctctgcacccccacgagctccatggccgccaccgccatgattgggattaccaacctacgttgccgccacgacccgctctcctcccttccccgggctacgtcgtcggccgcccggtcctgtacgctgcttcctcctcgatgccgccgccattcttcttgctgctccccttcctcctccgtctctccgtgccgggcccgggtccgaccaacagcagcactgaagcgcatccctgccgccgacaccggcttcatggntccagccaacaatgagggcaccacgcttaaacgatcatcgtcggccgaccttcgccgccgccttatcgtccccagctccaccgctggcaccggacaccccgccagtgctttccacggagtgctggcccgccattatcggggtggcgcatcttgctcctgtcgccggggcatcctgctcctccagggaaaaggttcctccagggaggagttcgttcgccccggtcactcaaagttccccaggggccctttttccgggagggtccgggggtcctttcccgggggctcgggagatcttcacaacaattcggggccccctcccgggcgaagggggtttattgggcttttttttgagcgccgcccgccctgtttacataccaagggggagtcgtattattggttctcacgtcccggacacgaggggggtgagagggacgttcggcgggagaggagatatttccacggtgggcgtcgaggaaaccagagaccttgggacgtggtcttgtggtgggggggtgttggccgcgcacgat

SEQ ID NO: 95405 - protein, 254 aa, Zea mays
  misc_feature: Ceres CLONE 1585590
  misc_feature (78)..(78): Xaa is any aa, unknown, or other
MAATAMIGITNLRCRHDPLSSLPRATSSAARSCTLLPPRCRRHSSCCSPSSSVSPCRARVRPTAALKRIPAADTGFMXPANNEGTTLKRSSSADLRRRLIVPSSTAGTGHPASAFHGVLARHYRGGASCSCRRGILLLQGKGSSREEFVRPGHSKFPRGPFSGRVRGSFPGGSGDLHNNSGPPPGRRGFIGLFFERRPPCLHTKGESYYWFSRPGHEGGERDVRRERRYFHGGRRGNQRPWDVVLWWGGVGRAR

SEQ ID NO: 95406 - DNA, 906 bp, Zea mays
  misc_feature: Ceres CLONE 1585591
  misc_feature: Encodes the peptide sequence at SEQ ID NO. 95407
ggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacaagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgcttctccccctactgcggcagctgcaagtacccggcgaagaccttcttccacgacgtcggcctcggcggcatcggctacgaggtcacccgctacctctacgccacctgcaacgacctcaagttccccaacttcggcatcaagacgggcgccaaccgccaagatgtggagcgagtccgggacgttctatccggtacgttgccggtgtccaccgacgaaggagacggggccgcttcggctctcggggacatccccggtgggggtggggcgggaaccattacccgggcctggg

SEQ ID NO: 95407 - protein, 218 aa, Zea mays
  misc_feature: Ceres CLONE 1585591
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYDRFSPYCGSCKYPAKTFFHDVGLGGIGYEVTRYLYATCNDLKFPNFGIKTGANRQDVERVRDVLSGTLPVSTDEGDGAASALGDIPGGGGAGTITRAW

SEQ ID NO: 95408 - DNA, 885 bp, Zea mays
  misc_feature: Ceres CLONE 1585592
  misc_feature: Translation starting site: 166
  misc_feature (394)..(394): n is a, c, t, g, unknown, or other
gagctccccgcggtggcggccgctctagaactagtggatcccccgggctgcaggaattcgtctcacccctagaaaaaaaatccacgcgaccgcgagagctctcagaaggccctagcacgcaaaaaccccacgagagagacgaatcttccgaatctctcggtggcgatggcgctctccgaccgctcccgcgagtcgctcctcccgagcttcctctacggctcctcggcgcgctctttcgctgccacaggagccgccgcgcgcctccctgtctcctccccggcgcctgccgcggctggagcaggaggcggcgtgccgttctcgatccaggcgcccaaggagaagatcgagatgtactcgccggccttctatgccgcctgcactgccggaggaatcnccagctgcgggctcacccacatggccgtcacgcctctcgacctcgtcaagtgcaatatgcagattgacccagcgaaatacaagagtatctcatctgggatttggtatcctgttaaaggagcaaggggccaggggtttcttcaggggatgggtgcctactttgcttggctacagtgctcaggggggctggcagtttggcttctatgagttctttaagaagtattactcggacattgcaggggcctgagtatgcccaaagtacaagactctaatctaccctccaggatctgcatctgctgaggtaaattgctgatgtggctcctctgccctttttaaactctttagggtacgtgtgccaaaccccacctgggatttgccccgggaattgagtgatggggctccccaaaattggcccccatctggagggggttcctggggctccacaaaggggaatggttcctcctccggggggcggcgaattcctctataacc

SEQ ID NO: 95409 - DNA, 1269 bp, Zea mays
  misc_feature: Ceres CLONE 1585595
  misc_feature (60)..(60): n is a, c, t, g, unknown, or other
  misc_feature (69)..(69): n is a, c, t, g, unknown, or other
ttaagtggggaatcgtaaataggaaaatgagcgcggtattcgcgtcgagatgcttttttntcctttacngttactaataagagtaaccacgtggcggccgctctagaactagtggatcccccgggctcgcaggaattcgtctcacccctagaaaaaagcccagcaccgcagaggcgcagagacaggcgtcttcgtactcgcctatctccgcgactcaaagcttcttccatttcctaccgccgccgctgcagctccaccccattccgtcgacaccatgagggagtgcatctccatccacatcgggcaagcctgtattccggtcggaaacacctgctgggaggctctatgcctctagcatgggattcagggcccataggcagaattggccccggacaagaacattggggggtggggagaattgtttttaataaattgcctcacgggaaacaaccccgcgggaaaactccttcccccctctcttcccccccccccccgggggggtggggcggctctccaaaaaagggggagagaatgcgaattcattttactggctcaatgtcgggccgtggagtccgtgtgattttttatgtaagaaagatacttgtttttacaacatacagatagcaccgctgctgcgatttcgatccacgacaaattgtgagaatagagtagttaatagctggcattatgggttgccggtccaaaatgaacccttgagctgttgaatagggtttcatatccgacccctccgtttgcttgttacgcctaggatatctacgtctcttacaatgactacccccatgacttgcccgctctgatgagtggggagagtattattatgtggcgtagaggtacagtggggaattggtcgcgcgtaattcttatcccgccgctttcgcccttcgtgttagttataagcgaccgtctacgtaagcttgatagagcttgtgagtcatatgagaggtatcagtggacagatgcggtggagacttgttacgtgagcagggagtcgtaggagcgattggcaggtttattgagagtaatgatgagctttctgccgtacaggtgttgcgggaatccagctcatgcgatcggtacatccgtacggagtcctacccgaacatatctaagcggctatgacggtgggggtggccggctattataaaggtttaagacctggcgcgctccgtaccattcagcatactgccaagtgcatcttagtggatcaccgcatcggagcaccacagttcggccggctgggaatgtgcg

SEQ ID NO: 95410 - DNA, 1165 bp, Zea mays
  misc_feature: Ceres CLONE 1585599
  misc_feature (1)..(1): n is a, c, t, g, unknown, or other
  misc_feature (12)..(12): n is a, c, t, g, unknown, or other
  misc_feature (52)..(52): n is a, c, t, g, unknown, or other
  misc_feature (57)..(57): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
nattttggtaanaccaccacaaaacaaaaaaacacacacacccacccaacanaaaanaaaccccnnnccaaaactgggactccccgcggtggcggccgctctagaactagtggatcccccgggctgcatgaattcgtctcacccctagaaaaaactcccatcccacatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcacccgccgccaggacggcctcctcgtcttcgtcttcttcctctcgattcccatacgtaccagtagttttaatttaaagagttgtaattgtaggagcaatctctttgaaactggggtcccccctgcagctgtcaaggtccttttgcactttcccggccctctttcacacaatctctcccaagatcttttcctttcaccggcgaaatccggccggtgggtatgggatccccaatggccctcaaaaaatgggaaggcccttttggttccccaaaccatttttagaggggggggtgcaaacttccggcctcccaattccggtccaatttgttccatcagggcggggggggcaattcttccggggcggtttggccagacttgacgcccgctgggctcccatacttcccaaaaatcctttacccatttttaaacggggggcaacccgcgttttttggggaaaaacccctagaggagaatactcctcattttgtggtcggggcgcccccgatttcgctgaccttggaatacaaccatcctctttggggggatgcccccccacttgttatgttgaggggaaggccttccagtggccttaccccccggcggtgtgcgcgcatggtgaaaaatccctcctggggccccccattgttttaaagcgcaatcctttggggtttcgggggtttttaccccccccagccgccaggaaagaactcgcgttccggctagagattgtgattttaaaagaggttgtcctcccctggtttaagggtggtaaattggggccccagaggaaaagtggaaaaagtggggaaaattctga

SEQ ID NO: 95411 - DNA, 817 bp, Zea mays
  misc_feature: Ceres CLONE 1585601
  misc_feature: Encodes the peptide sequence at SEQ ID NO. 95412
  misc_feature (498)..(498): n is a, c, t, g, unknown, or other
  misc_feature (518)..(518): n is a, c, t, g, unknown, or other
  misc_feature (600)..(600): n is a, c, t, g, unknown, or other
tggagctccccgcggtggcggccgctctagaactagtggatcccccgggctgcaggaattcgtctcacccctagaaaaacccagcaccagcaagcagccttatctatcccctcagctctgcagctcagtgtccaccaccgccgcctccttccagctgggtggaagaaacatgtcgcgaatggcgcccccgtctccgcctcagtccctgaagcccccgacgctgcccttctccccgcccaaaaagccaccgccgatgccggtgtacaaggacctgcacttcaaccgcaacctctccgccaccaagaagctccaggccggagtggacctggtggcacggttgttgggggtcaccctggggcccaaggggaggaacgtggtgcttggcaacaagtatggccctcccaagattgtcaatgacggggagaccgtccttaaggagatcgaattggaagatccattagaaaatcttggagtgaagctggtccgacaggctggagncaggaccaatgatactgcanggagatggttgtaccacatccataaatctttgcccaaggcctcattgctgaggggatgaaggttcttgcagctggaatcaancccagtcaggtcgcacgtggcattgaagagactgctgctgctttgggtgtcgggcctcagactgattgcccggggtgaatgtaaaaccttgaaatgcccattgttggctgcaatttatgccgggaaaatgattttgcctgttggaaaaatagatttatagagggcttttcaaaagaatggttagacaagggaagggggggaatttgaaaaatggaaa

SEQ ID NO: 95412 - protein, 107 aa, Zea mays
  misc_feature: Ceres CLONE 1585601
  misc_feature (82)..(82): Xaa is any aa, unknown, or other
  misc_feature (89)..(89): Xaa is any aa, unknown, or other
MPVYKDLHFNRNLSATKKLQAGVDLVARLLGVTLGPKGRNVVLGNKYGPPKIVNDGETVLKEIELEDPLENLGVKLVRQAGXRTNDTAXRWLYHIHKSLPKASLLRG

SEQ ID NO: 95413 - DNA, 897 bp, Zea mays
  misc_feature: Ceres CLONE 1585603
  misc_feature: Encodes the peptide sequence at SEQ ID NO. 95414
  misc_feature (44)..(44): n is a, c, t, g, unknown, or other
gctccaccgcggtggcggccgctctagaactagtggatcccccngggctgcaggaattcgtctcacccctagaaaaaaaaaaaaaaaaaaaacaaatctctcttcctcgagttctcctcaaccaaattcaaagtcacagtcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggttttggcggtcgtgttgtgttcttggtctagttagtctgtgttgtctttatcggtgctgttttctgtggtggttgtactgcatcgttctagtttctagtccatgtgctgtaatatctcgctgctgtaatcaatgaaatgtccctcgtttcagcctcatgacatatcgctcttttgtaaaggacacagagtcacttcgccacgaacaaagcgcatcgatctcgctgtcgtcactcctcgtcaccagccacgaacagaggcaccaccagcatggccttggcaggggggctcctcccatcaccctctcatccgttcccaagaagtgcacctcccgttcccggcgaggacccgcatttctttacgtattcaaaagaaggtgcagggcggcttccctttcggtgaaaaccgggtggcaacaacggccctgtggccacccggggtcc

SEQ ID NO: 95414 - protein, 109 aa, Zea mays
  misc_feature: Ceres CLONE 1585603
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGRVVFLV

SEQ ID NO: 95415 - DNA, 915 bp, Zea mays
  misc_feature: Ceres CLONE 1585605
  misc_feature: Translation starting site: 469
  misc_feature: SWISSPROT Homolog: EC 2.7.11.1 Non-specific serine/threonine protein kinase
  misc_feature (680)..(680): n is a, c, t, g, unknown, or other
ctccccgcggtggcggccgctctagaactagtggatcccccgggctgcaggaattcgtctcacccctagaaaaaccagccgtccagccccggtttttctcctcccgcccccgttccccgtcccgactcccgacccaacccatatcagagattccttccgttggtggcgctggcgtccgcgctggcgttcccgtgagtcggcccgcgcgcgaaggcggccgtgaccgaccgtccggagcttcatgcgccaggggcggcggctccaccccgtcgtttgatgggcaacgcatgcggcggcgcccttagatccaagcaccagcacagcttcaagcacgccgcgtcgtcgcagcgccaccacgcctcctccgagtacagcgccagcgccgcggccaacaactcgcccaggaagccgccaccgccgcccgccaccacggacgcccacgcgccgccgccgccgcccgccaccgccatgaggcgcggcggggccggcgcgccgccggaacctgggggtcgtgctcgggcaccccacccccaacttcgcgacctctacgcgctcggcaagaagctcgggcaggggcagttcggcaccaactttcttctgcaccgagctcggcacggggggtcgactacgcctgcaagttcattttcaaggcgcaggctcatcaccagggagggacgtcnacgacgtggcgccccgagatccagattatgcaccacctctttcggccaacacaaggttgttcgcatttagggggccctacgaggaaccagttttactccaaattgttatggaacttctgggccgggggggacctctttcgacgggaaaaaaagggggggcccttaaaaagaggcaaggcccccaaacttcccaagatatattttgggggttcttgagggcctggcccttcccttg

SEQ ID NO: 95416 - DNA, 825 bp, Zea mays
  misc_feature: Ceres CLONE 1585607
  misc_feature: Encodes the peptide sequence at SEQ ID NO. 95417
tggagctccccgcggtggcggccgctctagaactagtggatcccccgggctgcaggaattcgtctcacccctagaaaaaattccgtccacagaagaagaatccttctcgacgccgcccccattcattcttggagggcaagaagaacgcgcagtccaaaagcgaaacaaggggaaggggcgaggcagccaaacgaatcccagcacctgcctctcctttgcttgcgcagatctagcgatggcggcgggcggtgagttggcgtggggggagaacccgtggcgcggcccggcctaagacaagatcgtctgcacgctcggcccggcgtcacgatccgacgagatgatctcgcgcctgctgcgcgcccggatgtgcgtagcgcgcttcaacttctcccatggctcccacgagtacaaccaggagacgctcgacaacctgcacgcccccattggagctcaccggggatccttctgcggcggtttatgctcgaccccaaggggcccagagattaaaacctgggattttttgaaagaatgggaaaccccatttcaatttgattaaaagggcccaagaaattcaaaattttctaaacaaactattaggatttccgggggaaagaagaaaattggttttccatgggccccccaaaaagccttggtttttttattttaaaacccccgccaaggggccaatattgggggggcggaaaggggaccccacaaccccctttcgggggctcttccccgggggaaaaaaaaaaaaaaggggtttgtgtcccccctccccccccggtggaaaaaaacccttttctaagtcttggggggaaagag

SEQ ID NO: 95417 - protein, 72 aa, Zea mays
  misc_feature: Ceres CLONE 1585607
  misc_feature: SWISSPROT Homolog: EC 2.7.1.40 Pyruvate kinase
MISRLLRARMCVARFNFSHGSHEYNQETLDNLHAPIGAHRGSFCGGLCSTPRGPEIKTWDFLKEWETPFQFD

SEQ ID NO: 95418 - DNA, 894 bp, Zea mays
  misc_feature: Ceres CLONE 1585608
  misc_feature: Encodes the peptide sequence at SEQ ID NO. 95419
  misc_feature (894)..(894): n is a, c, t, g, unknown, or other
ggagctcaccgcggtggcggccgctctagaactagtggatcccccgggctgcaggaattcgtctcacccctagaaaaagtccggcaccacccagagcttgtccctctcgcgtgttgcttcctcggttcctccccagttccaacttccaagaacccgtgaagtgaagtgaggaggtcggcggaaccggaacccaggcgatacgagatgatcgcaaacggcctccgcaaatccagtgctgcctcctcccaggttagcaagctggtgaaatacattgctagtgctggaagcttgcaaggggggcacagtttatcagagccgtctgccagacattacagctctgaaccttcacttcaggcgacagaagaaaatgggtttaaggggcacagcatgctggctccattcacagcggggatggcagagcactgatgtacacccattggttatagagagatcagagggttcttatgtctatgacagcaatggggaagaagtatattgatgctccttgcagagacggtggtgcacagcttttagggtgggaaatgaagcctccgactagtcaaaagcggggaacctggagcaatttaaaacaaatttcccgttttctaccctttccctttttgggaaacccgttaaacccaaaccccctcaattgggatcctccgcaaaatgatatttcttcaggcatggttcaccggcaaggggaaaatgggggaaaagggggttccttccacaaaatagggggggttccagaaagcaaaatggactcccccaggttaaaaaccaagggggggggatttaaaaataaatggcaccggggggaagggcccgaaacaaaaaaaaaagttttttttgctcgccctccaaaaaccgtggccctggggatatcaaccn

SEQ ID NO: 95419 - protein, 73 aa, Zea mays
  misc_feature: Ceres CLONE 1585608
MIANGLRKSSAASSQVSKLVKYIASAGSLQGGHSLSEPSARHYSSEPSLQATEENGFKGHSMLAPFTAGMAEH

SEQ ID NO: 95420 - DNA, 1044 bp, Zea mays
  misc_feature: Ceres CLONE 1585612
  misc_feature: Encodes the peptide sequence at SEQ ID NO. 95421
  misc_feature (10)..(10): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (492)..(492): n is a, c, t, g, unknown, or other
gggggggggnacaaaaaaaccaaaatannnntntcgggggtttccacatttnnnnnnnnnnnnncnnnnaaaaaaaaactgggactccccgcggtggcggccgctctagaactagtggatcccccgggctgcaggaattcgtctcacccctagaaaaattgggaaggggcaggtagtaacgtaggctggcgctgcagatcaaaaggctctcgcctcggcttggcagtcggcactccctctccaccgcgctgcaggggcgacgcaaggccgagcgctcctcgatccagatccaaggtaggagatggctctcacgagaattggcctcgccggcctcgcggtcatgggacagaaccttgccctcaacatcgcggagaaagggttccccatctcggtctacaacaggacaacctccaaggttgatgagaccgtgcagcgtgccaaggtcgaaggaaacctcccagtgtttggtttccacgaccccccgccgcggcntgagctccatccagaagccccgtggtcgtcatcatgcttcgtcaaggctgggggcgccggtgggaccagacccattgccaccgctcgcgggcgcaccttttgatcagggcggaactgtattccgccgatgggtgggcatacgaagtgggtaccgaggaacccccggagaagggaggggaagaaaggtcgtattggaagggaacccgccggggccttcccttaatatttcttttgggcatttggggcccgtccctccccggaaaggaaaaagagaaagggttggcccccggccaaaatgggcctcccgtcccttttggatgggccccgggggggggcctccccttccgaagggccataacaaaaggtgcccacttggaaaaaaaaaatttccttccatacaaagggggggccgtgccctcaagggtaaccccggataaaggccggcccccgtgggccgtccacccaaaataatatgggccaaaaaagggtgggaattcagggcgcacatttcgccccaaaaagtgggtgcccccaatgtggaaattggaatta

SEQ ID NO: 95421 - protein, 97 aa, Zea mays
  misc_feature: Ceres CLONE 1585612
  misc_feature (3)..(98): Pfam Name: NAD_binding_2 Pfam Description: NAD binding domain of 6-phosphogluconate dehydrogenase
  misc_feature: SWISSPROT Homolog: EC 1.1.1.44 Phosphogluconate dehydrogenase (decarboxylating)
  misc_feature (64)..(64): Xaa is any aa, unknown, or other
MALTRIGLAGLAVMGQNLALNIAEKGFPISVYNRTTSKVDETVQRAKVEGNLPVFGFHDPPPRXELHPEAPWSSSCFVKAGGAGGTRPIATARGRTF

SEQ ID NO: 95422 - DNA, 1083 bp, Zea mays
  misc_feature: Ceres CLONE 1585617
  misc_feature: Encodes the peptide sequence at SEQ ID NO. 95423
  misc_feature (36)..(36): n is a, c, t, g, unknown, or other
  misc_feature (335)..(335): n is a, c, t, g, unknown, or other
  misc_feature (476)..(476): n is a, c, t, g, unknown, or other
gggggggggagcctaggaggcgtggacattatcccnaaaaaacaaacaacagcgcgggcggtgagaaaaaacaaaaaatggggctccccgcggtggcggccgctctacaatagtggatcccccgggctgcaggaattcgtctcacccctagaaaaaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcntgtgatcgagaggttcgagaaggaggctgctgaaatgaacaagcggtccttcaagtacgcgtgggtgctcgacaagctcaaggctgagcgtgagagaggtatcaccattgatatcgctctgtggaagtttgagaccaccanaccccccccccaccgtcattggatgcccctgggacaccgtggacttcatcaaagaacatgaatcactgggtaacctcccagagctgaactgttgctggtcctttattcattgaactccacccactgggtgggtttttgaagggctggggtatcttccaaagggaatgggcccaggaccccggtgaaaacctggcttcctcccctttggcgtttacagcccctctttggaaggtgtgaaaggcaagaaaaagaaatttttggcctgtggcttgcgcacaacacaagggattgggggattgcgcaaagcccgaccctcccccaataattaacctcccacaaggggcacaccgtctgattggcaaagaagaaatttgttggaaaagggaaaaggtcttcaattccctctacccctcaagataaagagtttgtggggtaacacaaccccctgaaataaaggaattggcccttttggattgccacacattttcctggggtttttgggaggggcgcgaaccaacattggaattggagaaagggtcccccacctaccctttggcacgggggtacaaaagggcccccaacccttgcgtgtgggggctctcttgag

SEQ ID NO: 95423 - protein, 103 aa, Zea mays
  misc_feature: Ceres CLONE 1585617
  misc_feature (5)..(103): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (37)..(37): Xaa is any aa, unknown, or other
  misc_feature (84)..(84): Xaa is any aa, unknown, or other
MGKEKSHINIVVIGHVDSGKSTTTGHLIYKLGGIDKXVIERFEKEAAEMNKRSFKYAWVLDKLKAERERGITIDIALWKFETTXPPPHRHWMPLGHRGLHQRT

SEQ ID NO: 95424 - DNA, 896 bp, Zea mays
  misc_feature: Ceres CLONE 1585619
  misc_feature: Encodes the peptide sequence at SEQ ID NO. 95425
ccgcggtggcggccgctctagaactagtggatcccccgggctgcaggaattcgtctcacccctagaaaaagaaaggccgccaactgcgcaactggccctcgctagctgtagctggggcgctctctaccgccgctagggtttctaccgccgccgtcgatgggcgccctcaccgacagccggaagcgtctctcggcggaccactgcctctcggccgaccaccgcctcccctacccctcctccccgccgtcccttacccctcccttcaagcgggccaagctctccccaattcctgaacacgatccctccacctccgatttcccgcctatccgtccctctcctcaaatcatccactccgctgcggggggatccacctcctccacgccgggcccgtgccccccctcctaccacggtttcaaccccgtttccgcacaagggccgaacttccaaccggcgccatttccaggggcccgatcccaggggcccccagggggaaccctccccgggtttcccaacttgggaaggggcccgcaaggggccccagcgcggccggggcaatttttggggttcccccccgaaaattccccccccccccccttgagctttttggaaaccccccgcaaaaaacctttgagggctcgtttaaaaaaggggttgccccgcccgcgggggggccccccccctttcccgcccggccttttaccaatagtttaaaaagggaaggggggagggcggccgccccccccggggggggggccccccccctggggggtgtggggccccaagagaaccccccccaacaaataaaagtgtttttgggggccccttctctataaaaaaaagtcccccctccctaaaaagaggcgcctcggtggaggtgtaccacacgtcagcggggg

SEQ ID NO: 95425 - protein, 184 aa, Zea mays
  misc_feature: Ceres CLONE 1585619
MGALTDSRKRLSADHCLSADHRLPYPSSPPSLTPPFKRAKLSPIPEHDPSTSDFPPIRPSPQIIHSAAGGSTSSTPGPCPPSYHGFNPVSAQGPNFQPAPFPGARSQGPPGGTLPGFPNLGRGPQGAPARPGQFLGFPPENSPPPPLSFLETPRKKPLRARLKKGLPRPRGGPPPFPPGLLPIV

SEQ ID NO: 95426 - DNA, 839 bp, Zea mays
  misc_feature: Ceres CLONE 1585621
  misc_feature: SWISSPROT Homolog: EC 1.14.13.93 (+)-abscisic acid 8'-hydroxylase
ggccgctctgaactagtggatcccccgggctgcaggaattcgtctcacccctagaaaaacaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacccaccttctgggctgcccgtgcgtgatgctggccagccccgaggcgggcccggttcgttgcttggtgaccccaggccccacttgttcaaagccgaacctaccccgcggaagcaaaggagcccctttaatcggggccgttcgggttctccttttctttccacccgggggggaatttacccccctccggccctcccacaaaacctccgtcccaggggggggcgcgttgggggcccccaaaagcccctgtgccgcccccctctgttcccctaaaggggggggagagggccccccgtggggggggtccccacttctctccccttttcccgggggagaacccccggccccccctttaaaaaaaaagaaaccttttccccccacccccccaaaaaaaaaccccccttttcctttttttaaaacggggggggcatcctcggggaaaaaaattttttttcgggggaggccccgcgatggatgaaacacaaaatgga

SEQ ID NO: 95427 - DNA, 830 bp, Zea mays
  misc_feature: Ceres CLONE 1585623
  misc_feature: Encodes the peptide sequence at SEQ ID NO. 95428
  misc_feature (403)..(403): n is a, c, t, g, unknown, or other
ctggagctccccgcggtggcggccgctctagaactagtggatcccccgggctgcaggaattcgtctcacccctagaaaaaggccctgttcctcgtcctcctcatcaattcccgtctctcagtcctcccaataatggtggcgtggtgagaaatccttccgtccggccgtcgtcttagaagatgaactgttcctcttgctgcgccgctgccactccatcttctccggcgcttctcgccaggccgcgggggggtttagctgctagctgctccacgacgacagcaaatcagaaggtgcttttcctgggctcaaaacagtttccacggatcacgtatagccgtgcgtcgtcacggttgtcgcggagagaggtaatagcttttgccgggcaacaaccttgggacatccncagatttgtcaagacgctgtatttcttcaacgggcctccaaaccttctcaagattgtagaatctatcatcagcagtttcactggacctgcttctagtgaagtggcaaagaaaatggaaacgtcggatgtggtgctggttactggagccacccgtggggttgggcgacgggtggtggacttcctgcagaagaaaggagtacttgttccagtttgggctagaaatgtagacaaagcaagggagcattttgggggccggatgtaccctctgatcataggagatgtttacgaaggaagataccctttgatccctaacttttccaaggggattaaaaaaataggttcaatgcatcctctgtccatagtggggcccaagggaagggggattcccccgaacagggcgaaattccaaacaagggcattcaaattt

SEQ ID NO: 95428 - protein, 217 aa, Zea mays
  misc_feature: Ceres CLONE 1585623
  misc_feature (75)..(75): Xaa is any aa, unknown, or other
MNCSSCCAAATPSSPALLARPRGGLAASCSTTTANQKVLFLGSKQFPRITYSRASSRLSRREVIAFAGQQPWDIXRFVKTLYFFNGPPNLLKIVESIISSFTGPASSEVAKKMETSDVVLVTGATRGVGRRVVDFLQKKGVLVPVWARNVDKAREHFGGRMYPLIIGDVYEGRYPLIPNFSKGIKKIGSMHPLSIVGPKGRGIPPNRAKFQTRAFKF

SEQ ID NO: 95429 - DNA, 1184 bp, Zea mays
  misc_feature: Ceres CLONE 1585624
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (974)..(974): n is a, c, t, g, unknown, or other
cccacgcggacccgcaacaacaaaaaatnnnnatgtcctatgtgtaccccccaannnttnnnnnntttggggtcccccggtggggcgctctgaatagtggatccccggctgcggattcgtctccccctagaaaaaaacagtgtgctccatctccatttttctcctcctctcgtttttgcgtctaggcccctggggaagccgggattctggcggaggtccctccccccggctctcccgcctcgcggctccgatcgatgccgcagcgtcaatacattttccttaatgggaaaccaatcccaaaatggagcctactggtcccgggagcgtttacaacaggttcaatccacttttaaaaggaccctctggcttttttggcactgtgaatggggacgaatactgacgggtttgctccccggggcccttcttagacccgggcttgtgctgaccttttttggcgtaagggggatggaaccccccccccttttacaccccccattttgtggcttctttgggcggagaacagacccccttaatgggccacggggagcgctttatatccccttttggtcccgggcaagtctgtgggagtaggggtgggtcccttggggggagcccatcccctatatcttctcggggagccggggggaacccggtgccgcctggggggtgctcctcaaggttgtccgcacttatcgtaagatttgccctagttgccatggtcggtgtactccctggtaggtttctcaccgccggtaatgacattgttacctataggtagctctcctatcttgtgggaagggaataaaactctatgtggtctgccccgccagtgtgatgggattcctcccaatgtgagaataatgtgtggcaggcggcttgtgccctttgtgtgttgaggggagggcctcctaaccaggggggggttgcttggtcgcgtcgggcgggcggtatagattgattctctagctccgcgnctcgtttcttaatgttgggcgcgttgactggtttgtgtgtggtctgtatggtctgatcggagttctgttctggcattatggagggccgcttctccgcgggggttgttaagaggaccgtcgagtagtgtgcgcgttggtgtgcatcccccccgcgcgctgggcgggtagggtgtgggctgaacgagcttgtcgaggatgagaaggaggatg

SEQ ID NO: 95430 - DNA, 834 bp, Zea mays
  misc_feature: Ceres CLONE 1585625
  misc_feature: Encodes the peptide sequence at SEQ ID NO. 95431
  misc_feature (396)..(396): n is a, c, t, g, unknown, or other
  misc_feature (398)..(398): n is a, c, t, g, unknown, or other
ctccccgcggtggcggccgctctagaactagtggatcccccgggctgcaggaattcgtctcacccctagaaaaagcttgccgggcgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccgcagtcccagcgcccggggacgacncntcgcccaagttcctgggcgtggagacgaagacaatcaagaagatcgtgcccctggggctcatgttcttctgcatcctcttcaactacaccatcctgcgagataccaaggacgtgctcgtcgtcaccgccaagggcagcagcgccgagatcatcccgttcctcaagacctgggtcaacctgcccatggcagtcggcttcatgctcctctacaccaagctcgccgatgtcctctccaaggaggcgctcttctacgccgtcatcttccccgtcatcgccctcctcggcgcctttcggctacgtgctctaccccatgcgcgacggcatccaacccactggcgctcgctgatcgccctcctcgcctcgctcggggcccagctccctcggacccgtttgcaatcctcggcgtttgggagctcctggcctcttctacgtaaag

SEQ ID NO: 95431 - protein, 231 aa, Zea mays
  misc_feature: Ceres CLONE 1585625
  misc_feature (65)..(229): Pfam Name: TLC Pfam Description: TLC ATP/ADP transporter
  misc_feature (86)..(86): Xaa is any aa, unknown, or other
MESGLVASHRLRVPPPSASAGHHHLIRHRHAHAPVAAAPLRLSLPRHLPRSTPLRLPAALPLRHCLPPLRAASAAAAAVPAPGDDXSPKFLGVETKTIKKIVPLGLMFFCILFNYTILRDTKDVLVVTAKGSSAEIIPFLKTWVNLPMAVGFMLLYTKLADVLSKEALFYAVIFPVIALLGAFRLRALPHARRHPTHWRSLIALLASLGAQLPRTRLQSSAFGSSWPLLRK

SEQ ID NO: 95432 - DNA, 1288 bp, Zea mays
  misc_feature: Ceres CLONE 1585626
  misc_feature: Encodes the peptide sequence at SEQ ID NO. 95433
  misc_feature (16)..(16): n is a, c, t, g, unknown, or other
  misc_feature (55)..(55): n is a, c, t, g, unknown, or other
  misc_feature (56)..(56): n is a, c, t, g, unknown, or other
  misc_feature (60)..(60): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
aaattttaaatggttnggtggtgggagttttttattttcagcggacggggggganngcanccccnnnnnnntaaactggggctcaccgcggtggcggccgctctagaactagtggatcccccgggctgcaggaattcgtctcacccctagaaaaacttcccctggctcgactcgatccgcagcaagctaagcgcaaccgaccagctacgcaaccctggctttcgcttcctccaatgccaagcagagcctctacccggatgtggaccagtcccaccctgatttcaaaacccctttcttatccggacccaccaccttccacctgctcccggggccggcgtcccccacgagcaactccgtctaacccggctggcgacccccaggaggtgggcacagaacccctttcccggagagggacagaaagaggacgtgggtccctctcgcggcgagacgagtgaaggagagcaggggggggtatgggcccctggggggaggacccccccggggggggaagggaggaacggggaggggggggaaagcagggcggccgggccacgacgccggggggcggtgcgcgctgttccggcggcgggagggcagacttcggggaggggcggcggggcggaagcggggcgcgtgcggccgccccgtgacacagtgccgtgcgagcccgagacaaaaagtgggaggacacaccgacgcccccctgcctgctcggaaactaggagatcggcggggggccggtacgtgtctgggcctgtaggggggatgcgtacatcctaaggcgcgaccaatattgtacggtcgacgattgtgaccgcgttattggcttccatccgacgcccaccgcagtcacggagatagagttgacctgaacgttatcctagcttcacttaagaacccctctcttaacacgtaccgcacgtcagaacgacatctgcggcacgaaatacgtttcggacggcctgcacctctatccactgacacgaagacccatcttcgacatatccctactaacggagttgggacacagatacactggcgctagcctgctcatcactggaggcagggggttgtgcacgggggctatccacacccttgcacacatatgcgacacccgcacgccacttggggtcacacgtcaagtggatcgtgttctgttaccaaatacgtggcctcgtccgcgtcgaagcgcaggagggtcgcgcccccccgcccggccgcgcctggcgccacgagagggtagagagatacaaacacggcctcgcgtcaactcccctgtaagcgtgcg

SEQ ID NO: 95433 - protein, 58 aa, Zea mays
  misc_feature: Ceres CLONE 1585626
MGPWGEDPPGGGREERGGGGKQGGRATTPGGGARCSGGGRADFGEGRRGGSGARAAAP

SEQ ID NO: 95434 - DNA, 1302 bp, Zea mays
  misc_feature: Ceres CLONE 1585627
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (286)..(286): n is a, c, t, g, unknown, or other
  misc_feature (821)..(821): n is a, c, t, g, unknown, or other
  misc_feature (993)..(993): n is a, c, t, g, unknown, or other
  misc_feature (1103)..(1103): n is a, c, t, g, unknown, or other
  misc_feature (1226)..(1226): n is a, c, t, g, unknown, or other
gggggggggggnacnngagggagcgggccttccctcaattatttaaaaaaaannnnnnnnnncctcntnnnnnnaactctgaactccccgcggtggcggccgctctagaatagtggatcccccgggctgcaggaattcgtctcacccctagaaaaatctctcactcgctagcactagcatagtcgtctctttcttttctgcttccagacattgtccacacgagctagtgcactggtgtcgctcgcaaccaaattaaggacgtactgagccatggcatccaagggcntcctcttcttggctctcaacctcctgttcttcacagtggccaacgcctgcggcagctgccccgaccccaacgccggcgggggtggcacccgccgccgccctccttctgcgtacgcagcccccgttatcccgccagggcggaattccccccccccacaggggggggggggggggggggggcggttattgtgcttaaaataacccccccggcccaggctggggaggtgtggcgggccgggcgctcggggcgcggtcgcgcggaccagcgccgccggtcaggccctgcgagagggcccgccgggtcgggcgtccctggcaacacgggggttcgaggggggagaggcctgaggcgctggacgccaatttttcctgctgccaagatggcgccctcactccacacctcgcacagacggggccccgcggggactccactgggtgcgtcgatccccactcgtactcgctctcggtgcgccgggcagtcgggtgaggcggcgtgcgctgttggggccgctggggcaggtcgctcggatcgtgcngccacggaacgcgcgggcgggtgggcatgagcgccactacagattagggtgcgggtgcgtagtcgcacccgatgggggtgttctggctatgggagcggcgtcttgggtgctgatcgacgtgggtgtgggcgcgacgcacgggtggtgcgacgagcgtccgcggcggcgccanactctattatcaccccggctgcgtgtgcgcgtggcgtcgcgcgtccgccggcgcgactgggtagccacccccctctctcgataccctctgctctgcaatgcactatcaancctcccccgcgctatggcatgcgtccgagtctgtgggctccggtggagagcggccctcggtggatactagcgctatcttgtgtaggccccgtgggaggctgccggtctgcggcgcggcgccanttgtgcgccgcgcctgggtgggccgccgtcagctgcgcgctcttcctcggtgcaacggttatattggccagctccg

SEQ ID NO: 95435 - DNA, 845 bp, Zea mays
  misc_feature: Ceres CLONE 1585630
tccccgcggtggcggccgctctagaactagtggatcccccgggctgcaggaattcgtctcaccccctagaaaaagggcatttcggaccaattgacgacggattcccttctgagttcttgcccttcatgggaaaccctcgcactctagcggccggcttaaagccgccggagcgccgcgccaccatgtagcggcttttctgctgcatgttctacatggctgcctagggttgcgctcgcatcgcctcttcctatccacgacgctgacctccatgtcttcgacctcgcggcaacatcttgcggacgagctgtaccaccacaacatgcatgtcgggggaacaagcatcccgttctcccacggtctggagcaatggaagtgggagggccctacgcccacaaattgatgctgggaggcatggtcatagagctggagaggaatccggggctgggcccaaacactcgaggttgcggttttggaaaacgaccggtggagcctccaccctttccggccgggaaatgcccgttccggattggacttaaaccccagggggcacaggcctggggaaacccccccaagaactttgggtatggttcctaaaacagggaaggaaaaccccattggctccggggccccccggggaaaggggaaactggaaggccaaagggccccccaacagggccggaggaagtcccttccccaaaaaaacccgggaaaatgggggattgaaaaaaattttcttaggcccataccccgggggggaagaagggaagaattttacccttcaaaaaaaggggggggggggtttataaaaagaagtgcaaaccccccttttttcccagagagaaaag

SEQ ID NO: 95436 - DNA, 696 bp, Zea mays
  misc_feature: Ceres CLONE 1585632
  misc_feature: Encodes the peptide sequence at SEQ ID NO. 95437
  misc_feature (280)..(280): n is a, c, t, g, unknown, or other
  misc_feature (305)..(305): n is a, c, t, g, unknown, or other
  misc_feature (321)..(321): n is a, c, t, g, unknown, or other
  misc_feature (322)..(322): n is a, c, t, g, unknown, or other
ctctcggcggtggcggccgctctagaactagtggatcccccgggctgcaggaattcgtctcacccctagaaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccngtcggcgtacgtggcgtggcgactnaccgtcgctccctcgnngcgagcaggggagaaagacaccccgaggtggggtggacgggtggaaagtttccggcctgggaaaaagaaacccgtcccggggggaaccaaacctgggatttcgggggggtcttttccccccccccggtcctggaaaatttcaaaacttcgggggcgggggtttaaattggtgccccgaaaaaacccccctggggggggccccccgccctaaaaaaaaaaaaaacccccccttttttttttttttttttgggtgcccaagaaggagccccccccccccgttgtttgaaaggggggggtgttttttcgcgtgttgtttttgtggccccccccccaaaaaaaaaaaaaaaaaacccctctctgggggggggagagaa

SEQ ID NO: 95437 - protein, 113 aa, Zea mays
  misc_feature: Ceres CLONE 1585632
  misc_feature (54)..(54): Xaa is any aa, unknown, or other
  misc_feature (59)..(59): Xaa is any aa, unknown, or other
MAVALLAALVASAAMLAGTASASPAEGIQPLSKIAVHRATVEMQPVGVRGVATXRRSLXASRGERHPEVGWTGGKFPAWEKETRPGGNQTWDFGGVFSPPPVLENFKTSGAGV

SEQ ID NO: 95438 - DNA, 912 bp, Zea mays
  misc_feature: Ceres CLONE 1585638
ccccgcggtggcggccgctctagaactagtggatcccccgggctgcaggaattcgtctcacccctagaaaaattttctacttccttagctaacttcccagccccgacaccttggccgccgctccgtgcgcacccagttgctgaggttgcaacgctgcagccggcgaggatcggatgaaccaccaacccctcctataaatcctaaccgagtcctctgcttctgctctcatccatctgtagagtgcaacatgcagtgccccatggacactgctgctagtggaacctcgccagtgatgcaattcccttagcaatggctgatgaggtctatccgcccatttcattctccatttggggaaaacattttaatataccaacggttttcaaaggggcgcccaattttggcctttttgggggggaattgggaaatccccccccgaggggccggaaaattttttcccccccccttttgggccttgggttggatatatacccccccacctttcgccaaatttttgtggggttgtcttccctccccccccacattgtggttgggggggtgggcctatctcttctctccgcctaaaatatatctccctctatatggaggagggcgggtaaaacacctccctcctagtggtggggggtgttgcctgccgccgggcaaaaataaaaaaaagaaatatattctttctgtggtgcgcaccacaaaaaagaatatatctccgtagggtgaaagatgtgggggctgttctgaaaactaagaggggggtgggggtatttatgttttgttttatggtcgggggggagaaatgaaaaaaaccccgcgtggtgcacgaaaggtgtgttgtttttttgggcagcacacaacaacaaagaaatttttttggatgaggagagtataggtgaaccccaa

SEQ ID NO: 95439 - DNA, 850 bp, Zea mays
  misc_feature: Ceres CLONE 1585640
  misc_feature: Encodes the peptide sequence at SEQ ID NO. 95440
  misc_feature (398)..(398): n is a, c, t, g, unknown, or other
ctcctcggtggcggccgctctagaactagtggatcccccgggctgcaggaattcgtctcacccctagaaaaaaggacatcctcggccttccagggcagcaaccacgaaagccttctgcgcggggtgctttcctcgcagcaaatattcctgccttttgcattccggctttgcaagttccttgctttgggcatatatattgtgaggtctctatatatataggtggttcgaggtgatcggcagaaccacacaggcaaagatggcgagcgtgcacaaggccaccacccttgttctcatgttctgcctgctagcgctggggagagcggagtacctcaagtacaaggacccaaagcagcccgtcgctgttcgcatcaaggacctgctgggtcggatgactctcncccaaaagatcggccagatgacgcagatcgagagggaaaacgccacggccgacgcgctggccaaatacttcataggtagcgtgctgagcggcggaggcagcgtgcctgctcctcaggcgtctgctcaggcttgggccgccatggtgaccgagatgcagaagggcgctctttctacgcgtctgggtataccgatcatctacggtatcgatgcagtgcatgggcacaacaacgtctacaaagctactattttccctcacaacgtcgggcttggagctaccagggacccctgacctcgttaagagaattggagaaagcaactggctctttgaaattaagagctaactgggaattcctttacgccctttgcctcccctggtaatagcgggttcttttaaaaggatcccaaagaatgagggaaccgtttcccttttgagaagacctccagtggggga

SEQ ID NO: 95440 - protein, 143 aa, Zea mays
  misc_feature: Ceres CLONE 1585640
  misc_feature (48)..(48): Xaa is any aa, unknown, or other
MASVHKATTLVLMFCLLALGRAEYLKYKDPKQPVAVRIKDLLGRMTLXQKIGQMTQIERENATADALAKYFIGSVLSGGGSVPAPQASAQAWAAMVTEMQKGALSTRLGIPIIYGIDAVHGHNNVYKATIFPHNVGLGATRDP

SEQ ID NO: 95441 - DNA, 710 bp, Zea mays
  misc_feature: Ceres CLONE 1585642
  misc_feature (137)..(137): n is a, c, t, g, unknown, or other
  misc_feature (147)..(147): n is a, c, t, g, unknown, or other
  misc_feature (148)..(148): n is a, c, t, g, unknown, or other
tggactcccgcggtggcggccgctctgaactgtggatcccccgggctgcaggattcgtctcacccctagaaaaaccccccttcccctctctcgcccctcctccctccgtctcgtctcccaggtcatggcaaaagctnggagcaccgnnggaaaaatagcaaagtgggaaaataaaacagggaagaagctagggtgaaatactttgggagaaaaaaggtcccccccaacacccccccccaaggaaggggtgaaattcccttaccaaggttagcccagttccccaaagggaaaaaaaaaaaacccccaatttttttgcccccccctttgaaaccttggccccaaaagggggaaaaattttgccccctataaaagggggttttttttgtgggtttaggggggggttttttaaaaaattttttttaaaaaagagggggttgccccccccccccccccaaaaattatattaaaaaaatttggggggggggaaaaaaaaagcgggcccctcccggggggccctcccccccttcgtttaaaaatatattaaaaaagggggggggggggggataattccctcccccaaaaaataaaacccccccccccccgccggggggggggggggttttttttttttctcccccccccccccccctccctggggggggggggggtttttttctctccccccccacaaaaaaaaaaaaaaatttttt

SEQ ID NO: 95442 - DNA, 1002 bp, Zea mays
  misc_feature: Ceres CLONE 1585645
  misc_feature: Encodes the peptide sequence at SEQ ID NO. 95443
  misc_feature (321)..(321): n is a, c, t, g, unknown, or other
  misc_feature (336)..(336): n is a, c, t, g, unknown, or other
  misc_feature (337)..(337): n is a, c, t, g, unknown, or other
  misc_feature (343)..(343): n is a, c, t, g, unknown, or other
  misc_feature (354)..(354): n is a, c, t, g, unknown, or other
  misc_feature (371)..(371): n is a, c, t, g, unknown, or other
  misc_feature (372)..(372): n is a, c, t, g, unknown, or other
  misc_feature (960)..(960): n is a, c, t, g, unknown, or other
ctccccgcggtggcggccgctctagaactagtggatcccccgggctgcaggaattcgtctcacccctagaaaaatagaaaaaacctagaaaaaactggaaagggacgcctgggagggtgagagccccgtccggcccggaccctgtcgcaccacgaggcgccgtcaacgagtcgggttgtttgggaatgcagcccaaatcgggcggtaaactccgtccaaggctaaatacaggcgagagaccgatagcgaacaagtaccgcgagggaaagatgaaaaggactttgaaaagagagtcaaagagtgcttgaaattgccgggagngaaagcggatggggnntttttnttttttttttntatttatatgtggtggnnggggcgagttgttggagaattatagtttgtgcccccaccaagaaaggggcgagtagctggtggtggtccctatttgataccaagccatgtgcatatacaacaaacattcatgatcttggtctaccttttcaaactagcttggcgcgggatgtgggtgcgttcggtattacattatacgtgtttaggtttgtaacaattatatgttcgaggtggagacaacacgttgactaagggtcggggtaccaacgtatcaaaataatttagtacaaagtaagatatacaaacagaagcggttgtgtatgtaatacttattgactcacactatcaaacactatgacaataatcttataaagaaacgtgggtataatgggtcgaaagacccgacgggaacatacctgggcgagaacaagaaagtaggttaccaataagaatcttatacacccacacattgcatataacaaaagtagatgttgaagcctatcttgtcggagccgagcactttttcgcacccgctgtgtgtgtcttacgtagttatgagaggtgcggtgtgtttgctctctttctaaatacaatggtgacggttcggtntcggcgactggtttcacaacaatatatacacaagtgataaaa

SEQ ID NO: 95443 - protein, 40 aa, Zea mays
  misc_feature: Ceres CLONE 1585645
MQPKSGGKLRPRLNTGERPIANKYREGKMKRTLKRESKSA

SEQ ID NO: 95444 - DNA, 813 bp, Zea mays
  misc_feature: Ceres CLONE 1585646
  misc_feature: Encodes the peptide sequence at SEQ ID NO. 95445
ctccccgcggtggcggccgctctagaactagtggatcccccgggctgcaggaattcgtctcacccctagaaaaagactagcagagggccatcttctactcttctctcccgtctctcccagcccccttgtccaacggttcagcctgctcaattttagtgaccagttacggcaaatgcagccctcggcggacagcagagaaaggaagcggcggcggcggcggcggaggaggctggcggcatgctgctcatcgagacctgctgccggcgccgctcaaggtcagtgtcagtgcggctcctctagccccggtggcggcggcggaagcggcagcctcgtggcaagaacaccgcgcgcgttctctagctgctcaagcgccgccgcctcgtctgcctgcgcgccggcggcggccgtccatctcggcacccagcacaagctgacggcgctcctcgtcgcgctcgcgctcctcctcgtcctccctcgccctcttctcgtgggaggggtccgggtgtcgccccgcaggatggcgaggatccgcagccacgtggagaggatcaacaagaccccctgcgcttcatccggacgcaggaaggcgacaccatcgactgcgtgggggcgcacgaacagcacggcctggaccacccgcttcctaagggcggaccccgtcaaaacggaccgcccaaggccccaagggggcgggggggcccttctccttccctttttggttttgcaaaaaaggaaacgggaaacggaatacggaacgggcgcaaggaaaggacaccagggggggggcccttggaaaaaatggggccccccggg

SEQ ID NO: 95445 - protein, 98 aa, Zea mays
  misc_feature: Ceres CLONE 1585646
MARIRSHVERINKTPCASSGRRKATPSTAWGRTNSTAWTTRFLRADPVKTDRPRPQGGGGALLLPFLVLQKRKRETEYGTGARKGHQGGGPWKKWGPP

SEQ ID NO: 95446 - DNA, 926 bp, Zea mays
  misc_feature: Ceres CLONE 1585647
  misc_feature: SWISSPROT Homolog: EC 2.7.11.24 Mitogen-activated protein kinase
  misc_feature (879)..(879): n is a, c, t, g, unknown, or other
cggccgctctagaactagtggatcccccgggctgcaggaattcgtctcacccctagaaaaagactagccgagggccattctctaatcttctatctcggctataccggacaccttggccagcggttcaccctgctctattttactgaccagtgtcggcaattgcagccctcggcggacaggaagaataagaagcggctggcgaggggagcagggtacaatatagaagaggtcatagggaaaagcagttgcggtgtggtttgctctgccttggacactcatactggtgaaaaggtcgccataaagaagataaatgacatctttgagcatgtgtctgatgcgacaaggatacctaagcgaaatcaaggtgcttaggactcctggggggatagggcccccccgcgcaaaaaaaagcatattctaatttccttccatcaagggaggggaaattccagggaatattttaccttccttgttttaacctttttgggaaccccgactttggctccaaggtttagaaaaggggtaaagtggaagggcttaaacacccccagaagcatttatcccagttttctatcccgggtgaacagagagggcctctccgaggggtgtgggaaatggtgcgttagcccccactagcgaaatagggtgtttcccccctagcacatttcttctaagaccgaataaaaaatttgttgtggggccaaagtgaccagattggggcacgcttcaaaaaagcacgtcgaagatgtggcccctgaggcacaaaaatcggttttgcgagtggatgaagttcaaagcatgggatttttttttgggaaagaaatttttatttcgcgaacactaggggggggcaccgggtgatcccgagaggtcgtcctnatttcctttttttcgatgagggttaagatcagcgcaggtttaaagtt

SEQ ID NO: 95447 - DNA, 1035 bp, Zea mays
  misc_feature: Ceres CLONE 1585650
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (102)..(102): n is a, c, t, g, unknown, or other
cttttttttttttatattaatttgttttattaaagaatgagtgttaaacgaaccactctnnnnnnnnnnnnccttttnnnnttttaatctggtgctccccgncggtggcgggccgctctagaactagtggatcccccgggctgcaggaattcgtctcacccctagaaaactcgtttcggaagattttgcaggtgatcgtggctccaaatcgtgcctctagaacacttagtactaaagagttcaggcaccttgcaaataaggtcggtaaccttgaacgtccattcctgaaagaattctttccacggtggattgaatcttgtggatgtccagttatgaggttgggaatctcatatagcaaaaaacgggatatggttgaattagccgtttcaaggggttgtacagggtaaacctacaccctgatcctgattatcacaccaaacgggtgacacctaaaaaaaaggcgaatgcctccctgggatgggcccaggaaattgatggaatgggtacccgtggtcccctggaaaaaccccaattgggggggcacattttgggaatcccctttccccggggtttccctgggcccccaaaatgggggcccttgggggggtaaaaaaaaaccctttttttgcacaaaaggtgtgttggggggttggtggaaaaaaaaaatttctcccccggggggggtggggagccaatttttttcccccgccaaaaaaaaactcttgtttgtcgcgcccgagcgccccgcaaataaaaacaccccgtgtgtggtttttttttgggggggagaaaaaaatatttcccccccgtatttatagagagggtggacagcccgccgcccgcaaagaaaaaccacctctgttgggggttgggggggggaggttctccccctgagaaagagaggagacacccacacaccggccctgtctatgggggattgtccccgcccccggctcccttatgaacctcccagagggaagagagaaatatatatcccccccgcccactaaaagagatttttttgttggctttctt

SEQ ID NO: 95448 - DNA, 794 bp, Zea mays
  misc_feature: Ceres CLONE 1585654
  misc_feature: Encodes the peptide sequence at SEQ ID NO. 95449
ctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaaacaggcagggcgctccgtaagcttgaagatggatgtctccagagcctacttcgtggcttacgtagcagggcagcgctcgtgcctcctcaagagatcaggccgcacgttctcgtcggcgatctgttactacggtggcccgtgggggaacaagttcggctcctgtcacgcgacctgctgctgctgcccgcgacggcgaggatcctggggtccgcgcatgccaagcgaaaaatctcgacgagggccatctcgttcgctgttccctggtccccactggcaaacgctaccgaaaaagagcttgaaaacgggga

SEQ ID NO: 95449 - protein, 208 aa, Zea mays
  misc_feature: Ceres CLONE 1585654
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVKQAGRSVSLKMDVSRAYFVAYVAGQRSCLLKRSGRTFSSAICYYGGPWGNKFGSCHATCCCCPRRRGSWGPRMPSEKSRRGPSRSLFPGPHWQTLPKKSLKTG

SEQ ID NO: 95450 - DNA, 1146 bp, Zea mays
  misc_feature: Ceres CLONE 1585655
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (38)..(38): n is a, c, t, g, unknown, or other
  misc_feature (54)..(54): n is a, c, t, g, unknown, or other
  misc_feature (877)..(877): n is a, c, t, g, unknown, or other
ggggggggggaacaccggggggggtggttannnaaaantttttggtggatcggnaaaaagttattgtgaaaaagggggggtccccgcggtggcggccgctctagaatagtggatcccccgggctgcaggaattcgtctcacccctagaaaaaaagtcccagtacaaagcctacggaatttccccccacctccaattcgagttgtccgcttccagtcagtcgccgccgctgaaaccgaaacttaaaaaatagctcgccgggggtccggccgatttcccaaaaattttgctgctgttgctgatagaaggccgcggcgaccacgcatgggcaactgctgcgccacgccgtcgacgacggaggagagcggcaaaacccgccagaagaagccaaagcagaaggcgaacccctacaacgtggcgtacaaccgcggggcggcaccggcgggagccccccccaggcctgggggtgctgcgggaacccccccccgcgggaacttgggggcgcattaacgagctgggcggcaaaactaggcccgccgcgaagttcagccgtcacctaacctggtgccccgggagcccgcccaggggggggcgccccctacaccgtgggaaagtgccgtgcctcccaacgcgcaaggcgtgccccaaccgcgcggttggaacgtgggagggaactgcgccgccccgggggagggggggaaaagatcagtgggggcccagattggcctttcccgctgtccggccagaatattcgggtgggggaggcccttccgggccgccccggccgttgaggagaaggaaacgaaggcggacgctcccgcgtgggctaccgccccggagcacttgggaaaggcctcctcggcgccgaggggaagacgncaatagcgccgcttgctcagacgaggattgccgtccgccgccccgtggtaggatccaaataaaacacccatcagacggcgtaccgggcgggctcgccggagggggaaagagtagcaccgtccggaggtgccacagagggggttccggcccctcgaacggggtggcccagcagcgcctttgtgccgcgttccttcgaccccccgggggatactctgtaaaaacaccaagagaaccatcctgtgttctttggggccaaaagcgatatcagg

SEQ ID NO: 95451 - DNA, 845 bp, Zea mays
  misc_feature: Ceres CLONE 1585656
  misc_feature: SWISSPROT Homolog: EC 3.2.1.21 Beta-glucosidase
ctccccgcggtggcggccgctctagaactagtggatcccccgggctgcaggaattcgtctcacccctagaaaaaattcactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccttcggaaatccctcgaagggactggttcccctccgacttcatctttggtgccgccacttcagcgtaccaaattgaaggtgcttggaacgaagatggaaagggggaaagcaattgggatcacttctgccacaattttccggaaaggataatggacgggagcaatgcagacattggagcgaattcgtaccatatgtacaaaacggatgtcagattgctgaaggaaatggggcatggacgcatataggttctctatctcttggcctagaatactgcctaagggaacggtcggaagggaggtatttaacccaggatggcatcgatttactacaaaaggctccatcaacttggttggctagaagaagggcatagaagccattatggtaacaaatttttccacctggggatggtccccttccagcacctaagaaagaagaaggtaccgggcgggaattcctttagaagtaaagacctccccaaaggaaggaatatgggataattggaatttaacaaaaaaacctctgccgc

SEQ ID NO: 95452 - DNA, 847 bp, Zea mays
  misc_feature: Ceres CLONE 1585659
  misc_feature: Encodes the peptide sequence at SEQ ID NO. 95453
  misc_feature (689)..(689): n is a, c, t, g, unknown, or other
ggagctccccgcggtggcggccgctctagaactagtggatcccccgggctgcaggaattcgtctcacccctagaaaaaaaactgtaaaaatcgaggggttcaaacagaaaagtgagccccaaaccctacaccctcatggaagcgtggccacctctcgcccccgcggcggccactccggcctgtgccttggcgtggggagcagcagcaacggcgcagcggaaggccgtggagcaggagtcagcggcgcaggcggtgagccgcatcgtggcgagctgcgccaactccagcggcgtggcagtcgccgtggtggacgccaacgccgtcatctccggcggctccgctctctccacttccgcggggcgccttgtcaccgtgcccgaggtactcgaggaggtccgggacgcaaccgcgcggcggcgcctcgggctcctccccgttccagttgagaccagtgaacctgcgccggagttcgttaagaaagttacaagtttgccagggagacaggagacatccaaacgctttcagaatgttgatataaagattattgctttgggcttacatggtagaagctgagatccaatgggactaagcatttggcgaaagcacccctcctcctctgcatgagggggaattgccaaaaaagctgtcccaaaccccaattggcctggttggggcttctaatgggcctnaccctaaaaaaagggggaaaaaattggaatcaaaagtctaaaactggggggaaaaattaaaatttccaaaaaaccttcccttgaagggaattggggaagcccaaaaaaccccgggaggggggaaaacccaaaacccttcttggggggcaaaaagaaaa

SEQ ID NO: 95453 - protein, 145 aa, Zea mays
  misc_feature: Ceres CLONE 1585659
MEAWPPLAPAAATPACALAWGAAATAQRKAVEQESAAQAVSRIVASCANSSGVAVAVVDANAVISGGSALSTSAGRLVTVPEVLEEVRDATARRRLGLLPVPVETSEPAPEFVKKVTSLPGRQETSKRFQNVDIKIIALGLHGRS

SEQ ID NO: 95454 - DNA, 784 bp, Zea mays
  misc_feature: Ceres CLONE 1585660
  misc_feature: Encodes the peptide sequence at SEQ ID NO. 95455
  misc_feature (140)..(140): n is a, c, t, g, unknown, or other
ggagctcaccgcggtggcggccgctctagaactagtggatcccccgggctgcaggaattcgtctcacccctagaaaaatttttcccgttcttctgaagctgtcctcttcttcccgtcgcttcgccgtcccgcaccagggnaggagaggaggcttcaccgcgaagctcgccatgatctcgccggagaggagttcgtcacagagcccgcggtcgcaggcggtggcgggggcgccattcctgtggatatctgtcatggatcccgtcaagatgggcaccggcgtgcatgcctacatctcctaccgcgtcatcaccaagaccaacctccctgaatttgagggaccagagaaaattgttattcgacgctatagtgattttgaatggttgcatgatcggcttgctcacaggtacaaaggcgtttttatacctccccttccggagaagaatgctgttgagaaattccggtttagcaaggagttcattgaattgcgtcgtcaagctttggatttatttgttaacaggatagcttcacaccctgaactcaagcaaagtgatgtcttgaggacatttttgcaggcagatgaagagataatggatagggcaagatcttatgagaccggtatttttaaaaaacatcagattttttacagatgtttaaggtactgtctctcgtatctcctgtgagacattcttgctactttctgaacatttttcttaagtcttacaagattagaaccagtattatcagctgtatagctcccatacatccctggtcactgttgatatcc

SEQ ID NO: 95455 - protein, 169 aa, Zea mays
  misc_feature: Ceres CLONE 1585660
  misc_feature (20)..(136): Pfam Name: PX Pfam Description: PX domain
  misc_feature: SWISSPROT Homolog: EC 2.7.11.1 Non-specific serine/threonine protein kinase
MISPERSSSQSPRSQAVAGAPFLWISVMDPVKMGTGVHAYISYRVITKTNLPEFEGPEKIVIRRYSDFEWLHDRLAHRYKGVFIPPLPEKNAVEKFRFSKEFIELRRQALDLFVNRIASHPELKQSDVLRTFLQADEEIMDRARSYETGIFKKHQIFYRCLRYCLSYLL

SEQ ID NO: 95456 - DNA, 853 bp, Zea mays
  misc_feature: Ceres CLONE 1585663
  misc_feature: Encodes the peptide sequence at SEQ ID NO. 95457
  misc_feature (70)..(70): n is a, c, t, g, unknown, or other
  misc_feature (853)..(853): n is a, c, t, g, unknown, or other
ctccccgcggtggcggccgctctagaactagtggatcccccgggctgcaggtattcgtctcacccctagnaattcactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaacgagcaggtcgcgggccccgcgtcgcgcgcgtcctacgcgctgctgtgggtgcgccgggacgtggcggcgtaccacccggccacgcagatccagggcatcgccgtgggcaacgaggtgttcgcgtcggccaagaacgtggacggcgcatctggtcccggcccatggccaactgtgcaccccccggctgggccagggctcggcctccaacggggccgtgcaggggggcgtgcgccccttcggggcttccgggcgggtcggggcctccctgcccaggccccggggggggggcggttcgggggaggggactcccccccgggcccgggctgagaagcccgagggcgccgacgttcccgggcgagaaacacgggtgtcgtatcctccgggggtggagcgcgcgtgccctggtgtttttgctttgttctcggggaagggcggggggaacaattcccccgcgggcttcacccccgtgttcn

SEQ ID NO: 95457 - protein, 192 aa, Zea mays
  misc_feature: Ceres CLONE 1585663
  misc_feature (29)..(193): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
MAPPRPLLAAVFLAAAVLLLLSPAEAGTVGVNYGRVANNLPNPAAVVQLLKQQGVAQVKLYDADPTVLRALANTGIKVVVALPNEQVAGPASRASYALLWVRRDVAAYHPATQIQGIAVGNEVFASAKNVDGASGPGPWPTVHPPAGPGLGLQRGRAGGRAPLRGFRAGRGLPAQAPGGGRFGGGDSPPGPG

SEQ ID NO: 95458 - DNA, 910 bp, Zea mays
  misc_feature: Ceres CLONE 1585664
  misc_feature: Translation starting site: 429
  misc_feature: SWISSPROT Homolog: EC 2.7.9.1 Pyruvate, phosphate dikinase
  misc_feature (398)..(398): n is a, c, t, g, unknown, or other
  misc_feature (399)..(399): n is a, c, t, g, unknown, or other
ctccccgcggtggcggccgctctagaactagtggatcccccgggctgcaggaattcgtctcacccctagaaaaaacccgttcgcctctcaccttttcgctgtactcactcgccacacacaccccctctccagctccgttggagctccggacagcagcaggcgcggggcggtcacgtaggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgttccacttcnncaagggcaagagcgaggggcaacaagaccatgaaggaactgctgggcggcaaggggcgcgaaacctggcggagatggcgagcatcggggctgtcgggtgccgccagggggttcacgggtgtcggacggaaggcgtgccaaacagtaccagggacgccggggtgcgccccctcccccgcgggggctccggggcccaagaatcttcgaacgggcctgccagggggggggaaaggaattaaatgggggcgccacccctggggcgaatcccgaaagggcccggcttccgtggtttcccggtccgattccggggggcccgcccgtgtttcattgccccggaatgattgggaaaccggtggctccaaacctggggggctcaaacaaacaaaaatggggcccccccgggtttgggggggcaaaaaaacgggggaagccctttcccccaaaaaattcctttccccccgcgtttccttaaaatgtgttggggaaaacatctcttcagaggaaatcccccc

SEQ ID NO: 95459 - DNA, 922 bp, Zea mays
  misc_feature: Ceres CLONE 1585665
  misc_feature: Encodes the peptide sequence at SEQ ID NO. 95460
  misc_feature (251)..(251): n is a, c, t, g, unknown, or other
  misc_feature (408)..(408): n is a, c, t, g, unknown, or other
  misc_feature (412)..(412): n is a, c, t, g, unknown, or other
  misc_feature (418)..(418): n is a, c, t, g, unknown, or other
tccccgcggtggcggccgctctagaactagtggatcccccgggctgcaggaattcgtctcacccctagaaaaagagtgcggccctcagctgctgcagttgctcctgctcgtttctgcctgctcgtttctgcggcggcggcggcggcggcggcctagcacctgagcggggcggcgagaggggacggagatggatatcgcgcgggcggctgctggcgtggcctgctgcaaggagcaccagaggatctacgccnagtggttcgccctggccgacccagatggcgacggccgcgtcacgggcgccgatgccaccagcttcttcgccatgtccgcgctttcacgcgccgatctcaagcaggtgtgggcgatcgcggattccaggcggcaggggtacctccccccccgcgcganttcntcacancaatgcagctcgtgtctctggcccaagcagggaacgagatcacacagggacagtctgaaacgtgaagaacctgagcacctttggatcccccctgtgatggaaaggggtttgatgagcctactgagctagaatcccaagggcttgttgtggaaagaaaagtttcccccaagatggaccaatgggcacccacctccgggccccaaggccaccctttccaataatattcaactgggttttgggttccaaaaatcccggccaccagaaaaggggggcaggattgcccctcctgggaactgcctggtttacccttcctgataaattgaattgggcttggaaaaaaaaactccttattggttgaaaaaaaaacgtgaaggccctttttgggaaagtccgcccctagccgggatttccagagggagttttgttcctgcccccaccacgttattggggccaaagaaatgtgtgatatttgggaaagcctaaagggctcgaagtggggctttt

SEQ ID NO: 95460 - protein, 119 aa, Zea mays
  misc_feature: Ceres CLONE 1585665
  misc_feature (22)..(22): Xaa is any aa, unknown, or other
  misc_feature (74)..(74): Xaa is any aa, unknown, or other
  misc_feature (77)..(77): Xaa is any aa, unknown, or other
MDIARAAAGVACCKEHQRIYAXWFALADPDGDGRVTGADATSFFAMSALSRADLKQVWAIADSRRQGYLPPRAXSSXQCSSCLWPKQGTRSHRDSLKREEPEHLWIPPVMERGLMSLLS

SEQ ID NO: 95461 - DNA, 882 bp, Zea mays
  misc_feature: Ceres CLONE 1585668
  misc_feature: Encodes the peptide sequence at SEQ ID NO. 95462
ctccccgcggtggcggccgctctagaactagtggatcccccgggctgcaggaattcgtctcacccctagaaaaaattttatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatctttatggaggtcaagtaacatcatgggaagaatgacaatgggggaagacttgcttttcctcagcagcaaggctattttcaaacctccaaatgctattcggtggtggtataccagatctgcttttccccaaatttggatcacatgggaaatctggaacaacatgggattccgctaaggaaccgggtttttgggactatttgaacaacaaatccaccctccctttaacatttaaaacccctgcttattaaaagcctttttggttgaatctggattcctggaagccctttctggaaaaaggattttaaaagatcctgggcccccaacaggttttggaatttcccgtttgaaaaatttgctcctttggaccttccgggaagattttgaatcctccccattccggaaatcatggaaacaacaaccccaaaatgggaagaaccttttccctttttaccatttgccatatcaacaaatactttttcttgtttcctgaacattaggtgaaggtgccggtgtcaataggact

SEQ ID NO: 95462 - protein, 63 aa, Zea mays
  misc_feature: Ceres CLONE 1585668
MAAPAPSGAASAAASPSPLMQLPSPFAELVKGPSGLEKVVLRGARNCCAEIYLYGGQVTSWEE

SEQ ID NO: 95463 - DNA, 908 bp, Zea mays
  misc_feature: Ceres CLONE 1585677
acccgcggtggcggccgctctagaactagtggatcccccgggctgcaggaattcgtctcacccctagaaaaaaccttccattcccagtcccaccaccacttgtctcaccgccgacatggtgtcctccagcgcggcctcgccgctcacctgccaccacctcggcagcgttggtgcccgccctagcatcccgtgcctctccatctccctccgacgacgatcgtcctcttcctctaagcccacctccctttcccactccctcccctccaagcactcgctggacccaccccccgacgcatccgcatcctcccgtcgcggtctcacccccggacacgactgcgactccggccgcagcggctacagcgccagatccaagatgcccgttccagaaacggccccccccacccgctccatcaccgggccgcccccgccgaaataaaccctcttttgaagggggacgggccaacaaggccgggtcccggggcctccaacggggaacagggcgttccttcattgtaggggcctttccccgggcccgccaatccggggggggggcccccgggcaaaagcgcgtgggaaaaagtgccttagacccaattctttccgggcgtccccgccctttggggggggggaaggataataaacccgggggcccgcgtgggcccccttcgggggcaaggaagggaaccttttccctccaagcaatccgggccgcccccccaatggtttccaggcacagaaggtcttcaacagtttcgaaaagagggagactttccccgagggcgttttgggagaccccccatttccccctggggcggccttgggaggaggagacatttcttttttttgggggaaggggggggcaaccaaaaaaaccggggctttcgggctcccccggggttggcttaacg

SEQ ID NO: 95464 - DNA, 1298 bp, Zea mays
  misc_feature: Ceres CLONE 1585680
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
ttttttttttgtgnnnnttgtcaccaacatcctcaggattgctttgggtggtgtggggggaggaataagagaaggagctcccgcggtggcggccgctctagaactagtggatcccccgggctgcaggaattcgtctcacccctagaaaaaagttctgatctgcttctccagtctccacacaacacaacagagcagaaggcagcacgggacgctgatgtcgatgggtggaggcgctagcgggcggctgccggctgacgcgggtggtgacattccaggtgggtgcttgtgcaatctccaacactgggggagcctcgtacgacggggggtgacgttcctaccttgaagcttgcaggggcgtcgcaacttcggcgcgtcctgggtcaccggtctcccctcccttctccggtcctccgtttttcggtctgtcaatattccttttggcgacgacacgtcggggggcggcctaggctttaaaccccccacccgggaggtgggccaggcctttcttagcggcggccggggagttaaccccccccgcggttcttgtgtttttgggaggtggggggtcccggaatgtaacggggcaccaggggctttgccggggcggctgtgtggggggggggtgccttccttttgccccttctccccgggagaccatttaattgcccggggcgtgcaattttacgggggggtcaccaagttctttggggtggggggaggcgctctggggtttcaaagagggggggatatattccccagcctaaaataggggtgtggctcgcgcttggttctccccacaaatatttgcgggcggggggcgagctggcgtctttggtgaatggtggagggagtccctcggtattggtgtcacgcggctcggtggactccttgggtgtggggtacccacgttggctgtgtcagtatgaggggagagagtggtgacgccgcagtctaacatccgtccggctgaggtgtagaacattgataggaaaaacatgtggtgtgctgaagaaatttcacgcacatgtaggttccggatggacgtcgcgggtggaagtacactatgcgcgggtcgttctcgccgctcgtgtggtggtggtgtaatacatgaatgtggaacgcagccgttgtcccttttgtctggagctccagtatgcaacacagccgttgccactaatgggtgcgtgcgggcattggtgttagcgtgggggttgtatatataagtctggttaccaacagaaaaaacaggggcgccctatgtattccgttctacccccgtgggcggtaatcacactgcg

SEQ ID NO: 95465 - DNA, 831 bp, Zea mays
  misc_feature: Ceres CLONE 1585683
  misc_feature (483)..(483): n is a, c, t, g, unknown, or other
ctccccgcggtggcggccgctctagaactagtggatcccccgggctgcaggaattcgtctcacccctagaaaaaagccgctatatagcggactaggggctcgttggagagaaaacttattacaaccgaccaacgcgctttgcaacgcctccgctgcaatcagcccccgcggcgagattgccctgcccctgagtgctagttctcgccgttacgtaaggcttcttggccttgcgtcctccgtctttcgttgctgatacatcgaggtattaaagaagctgcctggttccgggcagcagaggtcgccgccgcctgcagcaatggccgacttctcctggctcacggagcttggcttcctagttctcaccttcaactcaggcatggcgatttatcggtcacaacggtgacgccggctacgtagctttcgtcgtgggatcttatctcgacctggtggccctgttcgcctgcttgcgctactacgagcagntggatcagcagcactcccaaaaacgcgcgagggtcaaggctaggggttggaagctcacaacccgtcttactatcatgttcagttacaaggtggctgagaatattgcccctgcccggcaaacttggagtctgggcggatggctgccgctacccccggggggggggcgctaaggctttcttctttcaaaaggagaacctggcctgccattgggggggcccccgaccgccccgggcaagggttcaccccccaacttgggttgtttggcccccaaagggggaaatggggggggcttgggtttgaaaccccgccctaaatccaaggggcaaatttgtgtttcccttatttcca

SEQ ID NO: 95466 - DNA, 815 bp, Zea mays
  misc_feature: Ceres CLONE 1585685
  misc_feature: Encodes the peptide sequence at SEQ ID NO. 95467
  misc_feature (739)..(739): n is a, c, t, g, unknown, or other
  misc_feature (740)..(740): n is a, c, t, g, unknown, or other
tggagctccccgcggtggcggccgctctagaactagtggatcccccgggctgcaggaattcgtctcacccctagaaaaaagccttcacccctgctcgctgtgtcttctccacttcgccctgcgtacgctccccagtctcactctctctccccctctacctcgttcgtggcgacgacagggcgaccgccgctgccaccgccgcctctccactgtgtgcccagtgctttgcccggccgttcgccggcgacgggcactcaccaccaggtgacaaaggaaaaggaagaggggcagcaaatcggtgcgctgctgttcatcaaatgctggggaggaaatcaacagatcaggggcctggtgaaatgctgcgcagcgagggtgactgactggcaactccgcccgccgacgcccgtttcgtgcttactggcatgctcgcagcataaaggaatcttcccggaattagcccccctccctgtggccgtgacggccccaagtttcaagacatggaccatgtgccggctctagttcttgccgggtgctgcttcctggccctgctgcctggctgggcctgtggccttggctccatgtcgtccattgcggtgtcctatggggaggatggtccggtgttctgtggcctcaactccgacggctcccacctcgtcgcctgcttcggtgctgatgcatctgtcctgtacggcgcaccacccaacatcccttttcttggcctcacggcaggggatggggnntcgtgtgtggcctcctgctcgacaccgggcagccatactggctggggtaggcactcctatgtacagagcggggtg

SEQ ID NO: 95467 - protein, 106 aa, Zea mays
  misc_feature: Ceres CLONE 1585685
  misc_feature (81)..(81): Xaa is any aa, unknown, or other
MDHVPALVLAGCCFLALLPGWACGLGSMSSIAVSYGEDGPVFCGLNSDGSHLVACFGADASVLYGAPPNIPFLGLTAGDGXSCVASCSTPGSHTGWGRHSYVQSGV

SEQ ID NO: 95468 - DNA, 846 bp, Zea mays
  misc_feature: Ceres CLONE 1585688
  misc_feature: Encodes the peptide sequence at SEQ ID NO. 95469
  misc_feature (393)..(393): n is a, c, t, g, unknown, or other
gcggtggcggccgctctagaactagtggatcccccgggctgcaggaattcgtctcacccctagaaaaagtctagcattttcctacacccaatctgatctgaccaagccctctgaacaccaccgcccatcctcctcctcctccgccgccgccgcccaagatgggcttcgacgtgggcctcgtcccctacaaccccgacgggtggggtccacctgaagttgccgccgcgccgccttccctcggtggtggctcctcgtctgtccccttcgctcccttctcccgctccgacaagctgggccgcatcgccgactggacgcgcaacccgccgggccccggggctttcgccgcagctcgcgacgccgtcttcgatttcgcggggctcgaggactccatcnggctcgcgtccgcggacgactcgtccttccgcctcgtcgatggcaaaccgccgccgcggcacccgcggtttggacctcgctggcgcttccagcagcggccccaactcccgcagcggcgcgaacaagaggtcgagggtcgggcgtcgcgaggccgagaaaggagcggcccgccggaacggcactggcagaagaaccgccgcacgcaccaccagttcaaccgggggcgggcccttcctcggcgtcgggccaaaccgtccggtgaacttccaggcccaaaggggtccggggaaagagaagaatcccttttctcaacccttctccaaggttcctcctttcggcggtcgcccgaaccagcccggagggaacccccccgctctggggggcgccaatcgaaattacttagcaacgcgggacccttgcgatagcggggtcgcaccccgcggggggcgcgag

SEQ ID NO: 95469 - protein, 219 aa, Zea mays
  misc_feature: Ceres CLONE 1585688
  misc_feature (79)..(79): Xaa is any aa, unknown, or other
MGFDVGLVPYNPDGWGPPEVAAAPPSLGGGSSSVPFAPFSRSDKLGRIADWTRNPPGPGAFAAARDAVFDFAGLEDSIXLASADDSSFRLVDGKPPPRHPRFGPRWRFQQRPQLPQRREQEVEGRASRGRERSGPPERHWQKNRRTHHQFNRGRALPRRRAKPSGELPGPKGSGEREESLFSTLLQGSSFRRSPEPARREPPRSGGRQSKLLSNAGPLR

SEQ ID NO: 95470 - DNA, 937 bp, Zea mays
  misc_feature: Ceres CLONE 1585690
  misc_feature: Encodes the peptide sequence at SEQ ID NO. 95471
gcggtggcggccgctctagaactagtggatcccccgggctgcaggaattcgtctcacccctagaaaaagtgccagcttgagcattccactttgctagccagcatatacttacacgtagctagcttaataatcagcagctggtgcagcaagagtaacagctagcgacgacgaccatatggcggcgaagcagctagtcgtcgctgctgctgcctccggccaccccaagatgggggaggagaagctgatcatccggccggagaaggtgcggttcatagacgtgctgtcgatgctgctcctgaggcgccccatcaccagctacgcattcgtggaggccggcgaccggaccgccgccaacctgggcagcacgcccggcgactggctcgtcgcgccccccttttcatccaaaaggcgctcgccggcgcctactacccggctctcgtggtcggcgccgtcgtcgagttcctcctcaacttccgtcgcgcttcaaaaagggggatactcgggcatcttttctaaaccctcttcagaatgtaaagctggggggatcccccctgaaaccgggggaggggggccccaacttttccggggcccaatgtatcgggggaattaatcccaccgggggagggaaaggaaactttgaagaacccccctttgctcaggcaaaaaggggggggcgcccaaaaaaaaaaccagagggagtctgtcaaaggatgggggggggggggttttttccgcctccctctccccggagaaatccgggggggggaggaaacaaccccaccaccccaggaaatttgtaaaataaaaggaaaagaggggggtggggtcccgcggtgtggtcacctacatttatcttacgaatagagggggtggcggtttgagcgatagaggaggaaactcttcttttggagataagagtgggagaatatattatggc

SEQ ID NO: 95471 - protein, 144 aa, Zea mays
  misc_feature: Ceres CLONE 1585690
MAAKQLVVAAAASGHPKMGEEKLIIRPEKVRFIDVLSMLLLRRPITSYAFVEAGDRTAANLGSTPGDWLVAPPFSSKRRSPAPTTRLSWSAPSSSSSSTSVALQKGGYSGIFSKPSSECKAGGIPPETGGGGPQLFRGPMYRGN

SEQ ID NO: 95472 - DNA, 851 bp, Zea mays
  misc_feature: Ceres CLONE 1585691
  misc_feature: Encodes the peptide sequence at SEQ ID NO. 95473
ctccccgcggtggcggccgctctagaactagtggatcccccgggctgcaggaattcgtctcacccctagaaaaactcgcacggacgagcgaggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgcctcaacgcggagcgggagggggtccccccgctcaaggacctcttcctcatctggctcgtcaccatcacctgcaccctgccgatccagtctctgttccccttcttgtatttcatgataagggatctgcatattgctaaacaaacacaagacattggattttatgctggttttgttggcgcttcatatatgtgtggagagggcagtctcctcaacagtatggggaatcgtggctgataagtatgggaggaaaaccagttatcgaactgaccctttattgaaatagttattcttcaatactatggttgggaccaaagctcaaaactttgggaagggcattaattcaccccggaggccctgctttgggaatccatggtggtggtttattcttcgggggccaatttaagggcgttatgtgctaacaggaaagggggggccccgaaaaaaaaaataacaaatccctttcctggggctttgtgggcaga

SEQ ID NO: 95473 - protein, 111 aa, Zea mays
  misc_feature: Ceres CLONE 1585691
MGGGNGETTQLGEPLLAKKAKAYRPRCPGCRVDRLNAEREGVPPLKDLFLIWLVTITCTLPIQSLFPFLYFMIRDLHIAKQTQDIGFYAGFVGASYMCGEGSLLNSMGNRG

SEQ ID NO: 95474 - DNA, 840 bp, Zea mays
  misc_feature: Ceres CLONE 1585693
  misc_feature: Encodes the peptide sequence at SEQ ID NO. 95475
ccccgcggtggcggccgctctagaactagtggatcccccgggctgcaggaattcgtctcacccctagaaaaagccgccaaccccccaaacaaaaccctaggccaccattctgaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgcctttgaccagggctccagagccgcccttcatgccggcgtcgagaagctcgccgccgcggtcggcgtcaccctcggacccagagaaaggaatgtcgtcttggatgagtttggaacccccaaagtggtcaatgatggagtgaccattgcccgcgctattgagcttgctgatcccctggagaatgctggcgcttcctttgatcgtgaagttgctagcaagacaaatgactcggctggtgatggaaccacaactgcctctgttctcgctagggagatcatcaaattggggctggttgagcatttacttcgggggccaaatccagtgtcccgtaaagaagggcattggaaaagactgtttcagaaaattggtgggaggaaaccttggaaaaaaatcaaggcccggtccaaggggaagtgggggaatattaaaaggtggttggctggcccttatcagcctggggaaaatgaaagaaattttttttggggaacttatgaattcccccgaaaatgctatttggacaaagggtgttggcccctgtaaa

SEQ ID NO: 95475 - protein, 231 aa, Zea mays
  misc_feature: Ceres CLONE 1585693
MATIPTTDSGLVLSSSALLRRTRRAASSVTARLPAVARRRPQLLVRASAKEIAFDQGSRAALHAGVEKLAAAVGVTLGPRERNVVLDEFGTPKVVNDGVTIARAIELADPLENAGASFDREVASKTNDSAGDGTTTASVLAREIIKLGLVEHLLRGPNPVSRKEGHWKRLFQKIGGRKPWKKIKARSKGKWGNIKRWLAGPYQPGENERNFFWGTYEFPRKCYLDKGCWPL

SEQ ID NO: 95476 - DNA, 821 bp, Zea mays
  misc_feature: Ceres CLONE 1585694
  misc_feature: Encodes the peptide sequence at SEQ ID NO. 95477
  misc_feature (521)..(521): n is a, c, t, g, unknown, or other
  misc_feature (645)..(645): n is a, c, t, g, unknown, or other
  misc_feature (795)..(795): n is a, c, t, g, unknown, or other
acccgcggtggcggccgctctagaactagtggatcccccgggctgcaggaattcgtctcacccctagaaaaaattttccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaagttccccctgctctcgaaatgcatgctcctgcaagcgctgtgcgccgacgccggcgacgtcgtcgtcgagctcccggggttcccgggcggcgccgaggcgttcgaggcctgcgccaagtactgctacggcatcaccatcacggtgagcgcgcgcaacctggtcccgcntgcggtgcgcggcggcgcacctcggcatgtcggaggccgccgacaggggcaacctcgcggccaagctcgacgcgttcctcgcctcctgcctcctgcgccgctggaaggacgcgctgggcgtgcntcactccacgcgccaccacgcgccgctctgcgaggacctgggcctcacgtcccgctgcgtcgacgccgtggccgccctcgtcgccagccggacaacgccccgacgtcccacgtcgcggtcgccgtggttgggcgcacgacgtcgccgagnctcggggtcgaccttcttctggcgga

SEQ ID NO: 95477 - protein, 199 aa, Zea mays
  misc_feature: Ceres CLONE 1585694
  misc_feature (100)..(100): Xaa is any aa, unknown, or other
  misc_feature (191)..(191): Xaa is any aa, unknown, or other
MKFMRLGTRPDTFFTAADSVRSVCTEVATDLQILVDNCLYHLHKFPLLSKCMLLQALCADAGDVVVELPGFPGGAEAFEACAKYCYGITITVSARNLVPXAVRGGAPRHVGGRRQGQPRGQARRVPRLLPPAPLEGRAGRASLHAPPRAALRGPGPHVPLRRRRGRPRRQPDNAPTSHVAVAVVGRTTSPXLGVDLLLA

SEQ ID NO: 95478 - DNA, 1155 bp, Zea mays
  misc_feature: Ceres CLONE 1585695
  misc_feature: Encodes the peptide sequence at SEQ ID NO. 95479
  misc_feature (1)..(1): n is a, c, t, g, unknown, or other
  misc_feature (12)..(12): n is a, c, t, g, unknown, or other
  misc_feature (17)..(17): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (76)..(76): n is a, c, t, g, unknown, or other
  misc_feature (77)..(77): n is a, c, t, g, unknown, or other
  misc_feature (498)..(498): n is a, c, t, g, unknown, or other
  misc_feature (736)..(736): n is a, c, t, g, unknown, or other
  misc_feature (1155)..(1155): n is a, c, t, g, unknown, or other
nggtgcgggttnccatnccacacaaagaatatgtacacccaacaaaacaaaaaaaaataaaatataaaannnttanntgggactccccgcggtggcggccgctctagaactagtggatcccccgggctgcaggaattcgtctcacccctagaaaaaatttccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacagaggtggccacggacctgcagatcctcgtggataactgcctctaccatctccacaagttccccctgctctcgaaatgcatgctcctgcaagggctgtgtttccccccccccaacctcntcgtccaagctcccaggggttcccagggcggccaccaaggcgtttcgaggcctggcgccaagtaaactgctacaggcatccacccatcaccgggagaagcgcggggcaaacctgggatccccacctgccggttgcccccgggcgagcggccaaccttcaggccatggttctggaagggcccgcccccaacaaagggggggtcaaaacccctctccccggggacacaaatgccttcccnaatccaccggttttttcctctcgagaaccgtatacctctgggcgcgctcccactatggtgcgcccccacgccttgtgggaaaagagggaacccgccgccccttgggggagccccgtggtcttctctaaactcttcccaaaagtcgtggccccaacccaacaaatgggcccccgaaccttattgtgcgatagagggaaccccttgtggggaacactctagagcggtttccccagactgtgcggtatgaggtaaacacacccgggtggtgccacaccggctttgagtccgggcactagccccgggggaataccgcgcgcgccaccaaagtttcccacatgttcgcgtggatctcacaccagagggtgggggggggcacaaaaaaaatttcacccacaagcctccggggggacccgaatctn

SEQ ID NO: 95479 - protein, 85 aa, Zea mays
  misc_feature: Ceres CLONE 1585695
  misc_feature (65)..(65): Xaa is any aa, unknown, or other
MKFMRLGTRPDTFFTAADSVRSVCTEVATDLQILVDNCLYHLHKFPLLSKCMLLQGLCFPPPNLXVQAPRGSQGGHQGVSRPGAK

SEQ ID NO: 95480 - DNA, 823 bp, Zea mays
  misc_feature: Ceres CLONE 1585696
  misc_feature: Encodes the peptide sequence at SEQ ID NO. 95481
  misc_feature (626)..(626): n is a, c, t, g, unknown, or other
  misc_feature (750)..(750): n is a, c, t, g, unknown, or other
  misc_feature (752)..(752): n is a, c, t, g, unknown, or other
ctccccgcggtggcggccgctctagaactagtggatcccccgggctgcaggaattcgtctcacccctagaaaaacctccaaccaaacgagctgctagcccttctaaccttgctcgacccttgcccgccgcctgaactcgcctcccccgcggccggtcccctgcatctgttcgccgcgccgcaacccggaggagactacgactacgagcaccaccaggtagcagcaactgttttgctgcaatctgacaaagtggagggtttaagagtcgctgcttcttttatgtctgaacaatctttgctttatttgggattgctgggagagtattcttgcgcgacgaggaaaaggcacaagtttctgctccactgcatgcatcaagagcccatccggtttccttgttctgaggtgtcattcgctagtgctcagagccggcttggttttctcgaaagatcagcagccactcttgattcaggactttgtcacacctgatagcatctagttaatacatctttatccaagatggcactgcaaaacattggtgcttcaaacagggatgatgccttctacaggtacaagatgcccagaatgattaccaagatagaaggtcgtgggtatggtatcaagacaantattgtgaacatggttgacatagcaaaagcacttgccaggcctgcttcctatacaacaaatacttttggatgtgagcttggtgcacagtcccaatttgatgagaagacaggggatttcttgggntnatgggggctcatgatactgcaaagctggctggtcctccttggagggatcatcaagaagtatgtccagtgtt

SEQ ID NO: 95481 - protein, 102 aa, Zea mays
  misc_feature: Ceres CLONE 1585696
  misc_feature (1)..(102): Pfam Name: eIF-5_eIF-2B Pfam Description: Domain found in IF2B/IF5
  misc_feature (37)..(37): Xaa is any aa, unknown, or other
  misc_feature (79)..(79): Xaa is any aa, unknown, or other
MALQNIGASNRDDAFYRYKMPRMITKIEGRGYGIKTXIVNMVDIAKALARPASYTTNTFGCELGAQSQFDEKTGDFLGXWGLMILQSWLVLLGGIIKKYVQC

SEQ ID NO: 95482 - DNA, 1258 bp, Zea mays
  misc_feature: Ceres CLONE 1585697
  misc_feature (11)..(11): n is a, c, t, g, unknown, or other
  misc_feature (27)..(27): n is a, c, t, g, unknown, or other
  misc_feature (28)..(28): n is a, c, t, g, unknown, or other
  misc_feature (56)..(56): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (69)..(69): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (1088)..(1088): n is a, c, t, g, unknown, or other
  misc_feature (1090)..(1090): n is a, c, t, g, unknown, or other
  misc_feature (1168)..(1168): n is a, c, t, g, unknown, or other
  misc_feature (1188)..(1188): n is a, c, t, g, unknown, or other
aaaaaaaatancccgtccaaaaagacnnaaaaagaaacgagagcgaatgcaacagnannnnnggcaaanaaannngggtggaactccccgcggtggcggccgctctacaatagtggatcccccgggctgcatgaattcatctcacccctagaaaaactccaaccaaacgagctgctagctcttctaaccttgctcgacccttgcccgccgctctgaactcgcctcccccggggccggtcccctgcatctgatcgccgccccgcaaccgggaggagactacgactaagagcaccaccaggtaacagccactgttttgctgcaacccgaccaactggagggtttaagagtcgctgcttcgtgtaattccgaacaaacttagcgtgattctagaataccttcggaatgattgttgggggacaaaacaaagggcccagtctaccccgaggcgggatggtttttgggagtttaagacggtttagggggcccccccccgggggggggtttttcttagtgtgtacgaagaccgggctgtgggtttctccgctcaaaagataaaagaatcgcgagtgaggtaatttcaagaggacctttttgaagactcccctgagaaccgcctcaccgagtgaaaggaaccttctttttcaccccagacgaataggaggaccctccctcatgaaaacacttggtaagggctattccatttccaagaggaaaaggtgctggccccctctccctctcgaaaaataaccctacaggatttacacccccggtctaaattaggatatattcgctcgcataacatgataggtgaaaacgaagacctccctgtgcgtaaacataaggggatcaaccccgaataggggcacaaacaaatagtcgtgggtgagtaaagaaagatggcgtggttataaaagttggtgggacaacaaaaaaagggagacgtttattgtaacaaaagtgactcctactacatcctactgtcgtgggtacacacacacacgatagttgcaccgccctccgtaatggaaagagagggggcacattattctagagagcgctcacgcaaatggctacaaaggatgttctcncnattcacataagaacgcgcgaatacgctgacaaatgtgttgtaggaggtatggttttctaatacagagggaggggcgcngcgctgcattgtattataanaggccacacaagtcgcaggcgcacacacgagaagacgtcctccaaactcagacagacgaatggtctacaa

SEQ ID NO: 95483 - DNA, 935 bp, Zea mays
  misc_feature: Ceres CLONE 1585699
  misc_feature: Encodes the peptide sequence at SEQ ID NO. 95484
tccccgcggtggcggccgctctagaactagtggatcccccgggctgcaggaattcgtctcacccctagaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcctcaagaccctcactggaaagactatcaccctcgaagggggagtctttctgacaccatcggacaacgtcaagggccaagattcagggacaaggaaggggcatccctccgggaccagcaaggggcttcattttttggttgggcaagccagcctcgagggacagggcgccaaccgtgggccgaacttgcagacatttgaggaagggagaggcccccctccccccttgggggggtggggcctccccagggggggcgggccatggcaagaatctttttggttgaaggaacttcttgtacctggctaaggaacctgtgtacccccatgtggggggtcgaagttctttccttgaatagccattgggaaaaaggttgcaaaagggcccaggtatcgccgggtaccaagggaggggggattcgcccccctccggaaacaagagcgggggggggttccattttatttggccggggacaagaaatctctcgcagagaaagagagggatccacctcttatgccggaaatagacaaagaggtttcgaaaaa

SEQ ID NO: 95484 - protein, 180 aa, Zea mays
  misc_feature: Ceres CLONE 1585699
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFLKTLTGKTITLEGGVFLTPSDNVKGQDSGTRKGHPSGTSKGLHFLVGQASLEGQGANRGPNLQTFEEGRGPPPPLGGWGLPRGGGPWQESFWLKELLVPG

SEQ ID NO: 95485 - DNA, 1098 bp, Zea mays
  misc_feature: Ceres CLONE 1585703
  misc_feature: Encodes the peptide sequence at SEQ ID NO. 95486
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (63)..(63): n is a, c, t, g, unknown, or other
  misc_feature (864)..(864): n is a, c, t, g, unknown, or other
aaaaaagggggaaagagagncgccgccnnnnanannnagactgttgaggagggnnngccaggnggcggggatggggaaaaaatgaagtcaccgcggtggcggccgctctagactagtggatcccccgggctgcaggaattcgtctcacccctagaaaactccctccctcctccattggactgcttgctccctgttgaccattgggtattctgaaccatcgagccatggctgccaagctgactcgcctccacagtcttcgcgaacgccttggtgccatcttctcctcccatcccaatgaactgatagcactcttttccaggtatgttcaccaggggcaagggaatgcttcagcgccatcagctgcttgcggagtttgatgccctgtttgatagtgacaaggagaagtatgcacccttttgaagacattcttcgtgctgctcaggaaacaattgtgctcccccccttgggttgcactttgctacccccccccaaggcctgggtgtcttgggaattccacttcggggggaaatgtaaattaaaaccctgggcgtttttggaaaggaacccctgagttgttttcccgaaaaaaacctttggccttttttcaaggggaaacaccccctcggccgggggagatggggaaaacaatttcgccaaacgggggctaaaaccccctttggggggcgcccctttgtgagaaggccccctaagagaattttctttttaagaaaacgacccccgccatccttatagagtggagggacggcgcccgctctgcttgtttgttcccgcgccggcgcaatagagatcttgttgttacaaaggtggggtgtgaaacgaaaaggagaggtgactcactcgctncgtaaccacaaaaatatcggggggggtggacagaagccgggagtggagatattgggggtgggagtggagaggggagaaacaaatacgcgcggagcgcggcgcgcgggcgggcattgaggtgggtgatggaaggggtgtgtcttttgacgcgggtatagcgcggaggggggggggaggaaagggcgggggcctagtggtggctttgttgacgccggccatcgccagggagtaata

SEQ ID NO: 95486 - protein, 50 aa, Zea mays
  misc_feature: Ceres CLONE 1585703
  misc_feature: SWISSPROT Homolog: EC 2.4.1.13 Sucrose synthase
MAAKLTRLHSLRERLGAIFSSHPNELIALFSRYVHQGQGNASAPSAACGV

SEQ ID NO: 95487 - DNA, 804 bp, Zea mays
  misc_feature: Ceres CLONE 1585704
  misc_feature: Encodes the peptide sequence at SEQ ID NO. 95488
aagctggagctcaccgcggtggcggccgctctagaactagtggatcccccgggctgcaggaattcgtctcacccctagaaaaaaactcccatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagccggcggctggtatggatcccaatggcctcaaaactggaggccttttgctcccgaccatcgagaggcggtgcacgtcgccctcctcccgccttgtcatcggcggtgggcatctcgggcgttgcagctgcccgtgccctctccaattcttcatttaaggggactgttttggaatcgaaaagatcgtattgggcgggggcattcatacgggtaaacccgtttgggatgcccaatttgatatggggagcctcatgggcttaccgcggggtggtgcaagggagaaatccacctgggcaccctgttgattaaggctattccttggggt

SEQ ID NO: 95488 - protein, 94 aa, Zea mays
  misc_feature: Ceres CLONE 1585704
MASKLEAFCSRPSRGGARRPPPALSSAVGISGVAAARALSNSSFKGTVLESKRSYWAGAFIRVNPFGMPNLIWGASWAYRGVVQGRNPPGHPVD

SEQ ID NO: 95489 - DNA, 1234 bp, Zea mays
  misc_feature: Ceres CLONE 1585705
  misc_feature (32)..(32): n is a, c, t, g, unknown, or other
  misc_feature (33)..(33): n is a, c, t, g, unknown, or other
  misc_feature (63)..(63): n is a, c, t, g, unknown, or other
  misc_feature (65)..(65): n is a, c, t, g, unknown, or other
  misc_feature (832)..(832): n is a, c, t, g, unknown, or other
  misc_feature (835)..(835): n is a, c, t, g, unknown, or other
  misc_feature (1062)..(1062): n is a, c, t, g, unknown, or other
  misc_feature (1164)..(1164): n is a, c, t, g, unknown, or other
aaaggaaagggtttaatttgactggtaaaaannagaaagagggaggtgtgctcggtgggtgtntnttttcaaactggactccccgcggtggcggccgctctagaactagtggatcccccgggctgcaggaattcgtctcacccctagaaaaatcttcgcctcccaatttccaaacctctctcttgggagcacgtacacgcggaggaaaagcgatcggccccgcggcggcaagatgactgcggcggcgacgatgaagtggcacgaggacctgggcactctcatgggggacacagacgttcacctcacaggcggcggggggcaaaggccggcgccggcgaatgttgcggcgggcgggggccgggtgggtccgggaagaggaaaaagtagggcgggcagggaggctcgttacttttaggagttggacctgcacgcatcttggagcgggcggtggagtgtgggaggtagtgtgggagggtaagagggcccccccccagtgtcggcggctttttgtgcgggacggtggtgagggtgagggtcaataacatgagcacatcgatggtaggggtggggagagtggggaggtgagaaggacccagagggcgggggggggaggggggagaaagaagtggatggatgtagacctcacccataggctgggctttggctgttggagggtggtctcaatgggcgtgtgtgggtcggaatggagagtggtatgggtggaggtttgatgtagtgtagaataaggttgagatctatgaaacttggcttggggtataagaaaagtaatggatggggagcgtgaaaattgatgtggggcgtggcgtgcggnacnctctctcactacaatattctccttctattgttacaaaatatagctagtgctaatctgatacgtgtggtgagatttcacggggtgggtgttgagatctttactctccgaatagtcatgagaacgctcttatcgacgcatggtagttggagaggttactgcttagccctgtagcggtagaggagagggcaaggacggatcatggctgtgcccacggacgaagcaccggntcagctcggtgaagtaagaacgcaggtgcagatccgcacaacatattagagaaggctgacagataggatacttctcgtcgcacgttgtcgccgcaactgtantaatattgcacgggaaaggtgattcagcccggagcgctgtactcacgtacgcgggacgaccgaggtcgag

SEQ ID NO: 95490 - DNA, 834 bp, Zea mays
  misc_feature: Ceres CLONE 1585706
  misc_feature: Encodes the peptide sequence at SEQ ID NO. 95491
  misc_feature (780)..(780): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
ctggagctccccgcggtggcggccgctctagaactagtggatcccccgggctgcaggaattcgtctcacccctagaaaaaatttccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcgccgccgccgactccgtgaggtctgtctgcacggaggtggccacggacctgcagatcctcgtggataactgcctctaccatctccacaagttccccctgctctcgaaatgcatgctcctgcaagcgctgtgcgccgacgccggcgacgtcgtcgtcgagctcccggggttcccgggcggcgccgaggcgttcgaggcctgcgccaagtactgctacggcatcaccatcacggtgagcgcgcgcaacctggtccctgctgcggtgcgcggcggcgcacctcggcatgtcggaggccgccgacaggggcaacctcgcggccaagctcgacgcgttcctcgcctcctgcctcctgcgccgctggaaggacgcgctgggcgtgctccactccacgcgccaccacgccccgctctgcgaggacctggggctcacgtcccgctggcgtcgacgccgtggccgcccctcgtcgccagcccggacaccgccccgacgtccacgtcggcgttcccccngtgtggggcgcacgacgtcgcccgagctgtcgtnnnnnnnnnnnnnnnnnnnnt

SEQ ID NO: 95491 - protein, 195 aa, Zea mays
  misc_feature: Ceres CLONE 1585706
  misc_feature (184)..(184): Xaa is any aa, unknown, or other
MKFMRLGTRPDTFFAAADSVRSVCTEVATDLQILVDNCLYHLHKFPLLSKCMLLQALCADAGDVVVELPGFPGGAEAFEACAKYCYGITITVSARNLVPAAVRGGAPRHVGGRRQGQPRGQARRVPRLLPPAPLEGRAGRAPLHAPPRPALRGPGAHVPLASTPWPPLVASPDTAPTSTSAFPXCGAHDVARAVV

SEQ ID NO: 95492 - DNA, 1040 bp, Zea mays
  misc_feature: Ceres CLONE 1585707
  misc_feature: Encodes the peptide sequence at SEQ ID NO. 95493
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (62)..(62): n is a, c, t, g, unknown, or other
  misc_feature (78)..(78): n is a, c, t, g, unknown, or other
  misc_feature (79)..(79): n is a, c, t, g, unknown, or other
nttgtggtgannnnnnnnnnacacaccccattcttcatacaaagaccaaggaggagagcaanaaacaaaaaaaaatannggtgggactccccccggtggcggccgctctagaatagtggatcccccgggctgcaggaattcgtctcacccctagaaaaaagaaagcagtgcttcccctctccccggagcggagagccggcgggccggcctcccatcgcatggccaccgcactgacgtgactccgccgagggattgaggacccaagacctccaactggaggaatcgagagatgaaggaccggtcccgcacccttcgccacatcttgcgtcgtcggggggaccggtccttcgccgacgacgactagcacccgccaggtacgcccgacacctctccctccccttcatgccgcaccccaaaccctaatgttgctgaggaacagagatgtctgctaccggagaaatcctgatgtcggagctatcccccccacacccgccattccgtctgaggctatggattgtcactggggatctgcctatggggtgggaatcctgcttcatcatagggcttcctgtgccttcctggtccagtttaccgggaagaaagcccccagccacctccttcccttcgcacaggtagcccaatgactcttccccgggtgggtccacagaaatccccgggaagggtgtccccaaatgggagaatttcccaagggtgtgaaacaaaaaggttgtcccttgaaaacatacccttgggcccgcctggcaagaaacccctttcgcaatgggggcccccgcactaggggtgggtgggcctccagccttggcccggtgggccagggaaaaaaaccccccttctccaaaaaaaaaggaattcccggggggaaaaaatgtcttgtggggcgccaccttggtttaacgggaagcgaaggtccgccaccgcaaccccctaaaaaattctctgaaaacccggggcccagaactttttccaggagatataccatattcccagagaggggggtggcaaaaatttcgttcctcttg

SEQ ID NO: 95493 - protein, 73 aa, Zea mays
  misc_feature: Ceres CLONE 1585707
MLLRNRDVCYRRNPDVGAIPPTPAIPSEAMDCHWGSAYGVGILLHHRASCAFLVQFTGKKAPSHLLPFAQVAQ

SEQ ID NO: 95494 - DNA, 838 bp, Zea mays
  misc_feature: Ceres CLONE 1585709
  misc_feature: Encodes the peptide sequence at SEQ ID NO. 95495
  misc_feature (383)..(383): n is a, c, t, g, unknown, or other
ctccccgcggtggcggccgctctagaactagtggatcccccgggctgcaggaattcgtctcacccctagaaaaattccaccccttcgtcagccccttgaccaccgttccaaccctctcccatccgcgtcgcctcgaaggaagcgcggctgatcctgctccaagcctccaaccctagctcctccgctccccaccttcctccgtccggggctcatggcggagatcgaggtggtatccgaaggcggcaggcgagaggaggacgaagagcggcggcggcagcagcagcaaggcgcgggggagccggaccccgtggtggacgtgtactctgcggcggcgtatggggacctggagcggctccgcggcttcgtggagcaggggggagccngcaccgcgctcagggagcccgacggcaacggctaccacgcgctccaagtggggcgcggctcaaaaactaccccccacgtcgcgctcttacatcgtcgaagcaccggggggcaaacgttgaatggcaaccggacccaccccccggcaaaacggggcccctccccttggggcgggcccgtgccgtgggggtccacctttcccgtgggcttaaacttggccttatggggaacccccgaacccaaggggttccaaggcccccccccaacactccaattggggtttcccggggggaggggaccccgttttcccatcctcccaagttaggggccaaaaaaagaaattttttttgggatacaaactcctttcccaaaaaagaaacggggggcgaaaattttttgagggcttttggaaaactttgggtgggggggagaggggcccttttttcacccggggggg

SEQ ID NO: 95495 - protein, 164 aa, Zea mays
  misc_feature: Ceres CLONE 1585709
  misc_feature (58)..(58): Xaa is any aa, unknown, or other
MAEIEVVSEGGRREEDEERRRQQQQGAGEPDPVVDVYSAAAYGDLERLRGFVEQGGAXTALREPDGNGYHALQVGRGSKTTPHVALLHRRSTGGQTLNGNRTHPPAKRGPSPWGGPVPWGSTFPVGLNLALWGTPEPKGFQGPPPTLQLGFPGGRGPRFPILPS

SEQ ID NO: 95496 - DNA, 778 bp, Zea mays
  misc_feature: Ceres CLONE 1585710
  misc_feature: Encodes the peptide sequence at SEQ ID NO. 95497
ctccccgcggtggcggccgctctagaactagtggatcccccgggctgcaggaattcgtctcacccctagaaaaaagagagacagacacgcctcacccacaccacaagaacaccaaagccacatcccatccatctccacggtgaggcttgagcgacccgagcaaaaaaaaatcatccgcgaagcagcgacgcaggtttgttctctgatctctctggttcttcttttagcagcagggacgcacagcacaagaaaaggtccggttcaagaggctcttctgttgggttttttttttttagaatcctcaagagaagagtgttcttgggttaggatttttttctcacctcatcacacctctcctaggaggaacagagatccagagaaccttttttctcttctggatccttgccgccttttggccttcgaaagggggttgttttgcaataccctctctctctgtttttttttttatcttggcacaaacccacctcgtttctctacttttattgaggaacagagctggttttccaaaaaaaaaatctactttgattttccataaagaaaacctctcagcctctttcttctagctccatccaagctttagacctaatggccgcagccatcgacatgtacaagtactacaataccagcgcacaccagatcgcctcctcctcctcccccctgggatcagagctcgcgaaagcactcgagccttttataacgagtgcttcccttctcttcggtcctcctccccctacaaggggtactcgtccctctccat

SEQ ID NO: 95497 - protein, 57 aa, Zea mays
  misc_feature: Ceres CLONE 1585710
MAAAIDMYKYYNTSAHQIASSSSPLGSELAKALEPFITSASLLFGPPPPTRGTRPSP

SEQ ID NO: 95498 - DNA, 849 bp, Zea mays
  misc_feature: Ceres CLONE 1585711
ctggagctccccgcggtggcggccgctctagaactagtggatcccccgggctgcaggaattcgtctcacccctagaaaaattcctgacgaacaggaactccatgagatccgcggaatccgaccgtcccgttcatctgcacgaaaagagcgtaatccttctttttcctctcctccgcatccacggagtgtgaatcgtctatcggtagcgcgtacaatacaaaccctaaaccccgcctcatcccctctccggggtaggggctacaggtgtcaacgcccgccatggacgcattccggaagcaactggatgtgctcaggggcgctgaacgcaacaggaacgtcaaagaggtgagccgctactaatacaaccgggacgtgtgccggatgatcctcgccagcccttccccccacgacctctttcagatcacgaaaatggatcttggtccttgttctaagattcactcgcttcaaatgacgaaagattatgaagaagcgtaagcaaagggcacagagattgtgaccgagaactcgaggatatgatagaaaggctccttgggggaatgccacaggaaaattcagaggggcctgaaacgacttgcgggatgacgatgccaaggctgctattgcgatgtcccgtatcggaagttactctggacggatgaaatacggcagctgtcaaaaaagatcaaaggaaaaaaggggaggaagttgatggccctctaatttttgaaaggggagaactgaatgaaaaaaaaaaagaggccccggaaaggtagtgggaaaaaactccagaaacttaaaagaagcctgaaatttgcggggcgttacccccccttggggttggaatggctt

SEQ ID NO: 95499 - DNA, 1226 bp, Zea mays
  misc_feature: Ceres CLONE 1585716
  misc_feature (287)..(287): n is a, c, t, g, unknown, or other
  misc_feature (1120)..(1120): n is a, c, t, g, unknown, or other
aaagatggagttggaggattataattagtacgaagggagtgggtagatgggttgagtcccacctaaaaaaaattaaaaatggaactccccgcggtggcggccgctctagaactagtggatcccccgggctgcattgattcgtctcacccctagaaaaaagacggatctagtactttctagaatcttgacacggaaatgaagcccatgcctctcggttgcggttgaggttgcttcccggcggcggtagggtgattcagctgggcatggaagtggactccgaggacgcncgggtgaagtaagacatcaagggtgtcgcccaagtgctcacactcgggggcggaagcaggagcggaagagttggaggaacgcagtggttaggtgctgtacagacttgcggaactgcccaagactgggaacgggaattaaactgtagccgaccatccagaaaggtaagcttgtaggggggggcttaatgactttcatcaaaccttttaagggcttgtacccaaagtctaaattactccatgacttcccatcaaaagaatgtatattgttcagtataaatgattgaaaatatataacgtaattaaaattcagaatcaaaaaaaaatgtcatcgggaaaaaggtttcacaaagtacctttgaaatgaggttgggataaatacttcttgaaaaaaaaatctttcccatcgataccccggaaccgccccgccagccacagttgttagattgtttaatacatatcaaaccctgggtctatctagacattgttgaatgtacctctgttccgacataaagtagtcggttaaacaagactattcgacactaccatacagtagtatcaagagataaagaaatctgataatacaccactgttctatacagaatatgtcgttcgcaatttaatataagttaattttatgagcaggaaatggagtgtattaatcatttgataaagagtaatataatatctaaagatgcaacatcaattaattataggcatcttaatgcgtgattatgatgcgtacggtggacaacaatagtgaaggatacgaacatcaattagacgtatgtcatgaataggtcgccctgataccaccctatgatgtattagtacangatactcgaaattgtggtcgcacgagaatcatttcatagtaatcctgattatgtgctgtggggagaacataatataatgagtgtgttaatgatatgcctatttaaa

SEQ ID NO: 95500 - DNA, 1193 bp, Zea mays
  misc_feature: Ceres CLONE 1585718
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (286)..(286): n is a, c, t, g, unknown, or other
  misc_feature (1097)..(1097): n is a, c, t, g, unknown, or other
nnggggggggtnagaggaaaaaacttaaaataagaaaccaactaaatggatgggccgnnnnaannannnnaacaaaatggtactccccgcggtggcggccgctctagactagtggatcccccgggctgcaggaattcgtctcacccctagaaaaatcctctccatcttgaactcgcgcggtcgcgcctctcttcgtctctcccattcccacccgctgaagcttcaaggagcttctcgtctgagccctacctaacgagcttaccggggggaaggatggtggcagaanccaccaagggacggctctaggctggactctccgcacccctccttggcctccggtgctgcggccgcgggtctagcaacttccccgatgctgggctctgggatgctcccaggggcccggtttcgccgaaacggggaattaccacgtcgggcaaaacaccggccggctattagcttgaaggttcctcggggggagttcaaggccccccctcccccgtggaggcacacctgggggaaatcagagggcgttccaccccttccctggaaagtgagaatgcgcccggctggtctttgtagtctacctgggtctgttggagtgacgggggggcgggtcccctccaccagaacaccaaacatgtttgcttcccagaaaaggtgttcatcgcggggcggccccaaccgccggtgcgcaggggaagttttattgtgggtggggcagggaaggcccaagagatattacatggcttctataacacagtgtggacggggggcgttctggggtggcaaccacatttgtccgtgcaaacagaactgggtgtcccccccacgagacaataaggtgcgcccgccccccctgtttgtacttccaagcaccaatttatcccgggaataagacacatctcacgttgctccatggggatttgagtgtacgtcaaaacaagcagagaagtgaacccacccctcagtcccccgacgtgttacgccatcgtctcctctcgggtatgtgcgagtgtcgtcgttctttttcttggtgattgtatctccatgccactagttcctatattgtgttacacattgtgcaatcccttgaggcnacgggatttgttgtgtgaaggtgtaggtatgccgccgtggcgggcaagcgatactctaatgagctgggatccagcgtctaggtcacgagtatgaaa

SEQ ID NO: 95501 - DNA, 828 bp, Zea mays
  misc_feature: Ceres CLONE 1585720
  misc_feature: Encodes the peptide sequence at SEQ ID NO. 95502
  misc_feature (539)..(539): n is a, c, t, g, unknown, or other
ctccccgcggtggcggccgctctagaactagtggatcccccgggctgcaggaattcgtctcacccctagaaaagtctctgttgcccggttgcccctcgctgtgacgactgacgagcaaccaatccacccaaatcccagaccgagctccaatcctcagcgccgccagtcgcgccgcctccgatggccgcgcggcgcgggccccacgtcatcaagctccacgatcccaacccgcccctcctcggccgggcgccggggaccgcaccggccgccatccccgcgccgtcgcgcgatgagggcatcctcgcgcagcaccctcgcgccgccccctcgagcgcatccgcctcgcacccggccttcgcccttatcgaggagcgcctcgtagcccgggaccagcacatccaggagctcctcgtcgacaaccagcggttcgccgccacgcacgtcgcgcttcagcagcagcttatcgcggcgcagcacgagctccgggcggtctccgtcgctgccaccagggcgcgcgccaagcgggaggtcaaggtgcnagcgctggcccaccagggcggccacatagaggccgaggcgcgggccgtcgccgctgcgcgcgccgaagtcgaaccagttcacgcccgacctccaagtggctcgtcgccggcgcgcactgaacttggcaaaccgggctccaggggccctaagggaaaaagctcgcccaacaaagaagggcgtgaaggcgagttaagaacccgattccccgtcccgtggccccagaatttgaaacccctgccgcccccgggagagattccaaaaagagggcaggaagcccttccggggttg

SEQ ID NO: 95502 - protein, 216 aa, Zea mays
  misc_feature: Ceres CLONE 1585720
  misc_feature (120)..(120): Xaa is any aa, unknown, or other
MAARRGPHVIKLHDPNPPLLGRAPGTAPAAIPAPSRDEGILAQHPRAAPSSASASHPAFALIEERLVARDQHIQELLVDNQRFAATHVALQQQLIAAQHELRAVSVAATRARAKREVKVXALAHQGGHIEAEARAVAAARAEVEPVHARPPSGSSPARTELGKPGSRGPKGKSSPNKEGREGELRTRFPVPWPQNLKPLPPPGEIPKRGQEALPGL

SEQ ID NO: 95503 - DNA, 1020 bp, Zea mays
  misc_feature: Ceres CLONE 1585721
  misc_feature: Encodes the peptide sequence at SEQ ID NO. 95504
tggagctccccgcggtggcggccgctctagaactagtggatcccccgggctgcaggaattcgtctcacccctagaaaaaagcacagtcgcatccatcatggcgatgtccatcttcggcggctgcgtcggcggcgactccggtgcgctcatcgcgccgtccgcgtcctcgctccgcccgccgttccgtcttgtcgctggtcccaagggccatttttgtacttttcctcatggagcatctagcaatcacagccggctatgtgttcaacatcaaaggtgttctcgcagctcaacccagaactatgctctttctaaggaggatttttctcctataactcaagatgtggaaggcttcccttcacaatgttggttaaatggggttttcttgaccgtctgaaaatagccgccccccccaaaagttttcttgcaccacccacaaagggtaccctcccaatgcaaaacttcccaaaaacaaaagggttaagatggatccggttcctcccaaagggtggggaagcccgtgggatgagggcaaaaaaaaaaaaaatgggtgggaaaaaacctcctttggagggcacccggctccaggattttgtgtgaaagatagagactccgagggggattaaccccccccacgggggaatatttcctccaaacttgtatgtccgtgggccctttggggccaccccgggggacactccccgggggaaaaagttcccctggggggccccccccggtgttaaaaccccacaagtgtcccccgcggaaatcctttagaaaagcccggtcccccaagggggaaaaaattgtgttgggggggccccccccttctcgaggacgcccggtggaagaaacccctccgggggggggggggttcaccgcccccccctttataattctttttgtgagacccacaagaaaagaaaatatttccccggggaatttctatttaaaaaggggggggcccacacaatgtttatctccgtgttggaggagataaatttagcgcccctcccgggggaa

SEQ ID NO: 95504 - protein, 98 aa, Zea mays
  misc_feature: Ceres CLONE 1585721
MAMSIFGGCVGGDSGALIAPSASSLRPPFRLVAGPKGHFCTFPHGASSNHSRLCVQHQRCSRSSTQNYALSKEDFSPITQDVEGFPSQCWLNGVFLTV

SEQ ID NO: 95505 - DNA, 1263 bp, Zea mays
  misc_feature: Ceres CLONE 1585722
aataaaaacaggttgggagtaaggagagaaaaaaaggagaggcgaacgggaagatgatgataaagaggagaaaaaaaaatagctccccacggtggcggccgctctagaactagtggatcccccgggctgcaggaattcgtctcacccctagaaaaagcacaggcacagccacactgcccttctctccccttcctctctcctctgcgtcgcttccacctctcaatctcaccccacgcctgccccgagctccaaccctaaaggaacacacccctgcttgcggcggcggggagcggtcttgggcgtccgccgttgctgtggcccagccgtgacagatccgggccccgcgccgttaggtcggtgtttcttcggcgacggtgcagccgctggatgttaagtctggcggatcagggcccgttgtgcgcgtgattcaaactaaccggagttaagttgtaacatttgtatcacaatgaatgaactcacacccacccccgggggtaaaaatgggtgagcgatgattctattcccccccccttaaaaagcaaatagggggaagcctaaatggcctgccatttggctgtccaaaagggggagggaaccacaaacccctgaccaattttacttccacgtttagagaaaggtaattataagccgttaaccagagagaattatgtgggaagaaacaatttttcacacccagatgcggccggagagaaggacatttacacgcagtgttcgggggcgcataccaatatgtcccgtgcctcatcacaccgcgttggtagcgatggcgcggagcaaacagaaacaccatgtcttaattttggggggggaaaaaagactatagttacgcccaccttgtaaaacctacacctctggggatttttctcgcaccacctcaggcaaccatctcctattgtttcggagataatgtgcggggtgtaaagaacactgagtttttggagaggagcgcgttgggagaacctctcccaaaaaaaaagataagggggaggtgtagcaccgtgtcactagccaccacctccaataaatgtgtaatgacggggggatttgattctcacacataatgtagcgacaaataaagtctgagcttgcgtcgtgagaaaagctagggcccgcccccttcccaataataggtgattcgctccaggtgcgagagtagaaaaaggtgtggggtcgcagaatattatgtggaagaataaaaaagaaggtggtaaacacctccgtgcgggggttgcacagggagcg

SEQ ID NO: 95506 - DNA, 1270 bp, Zea mays
  misc_feature: Ceres CLONE 1585730
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (53)..(53): n is a, c, t, g, unknown, or other
  misc_feature (57)..(57): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (868)..(868): n is a, c, t, g, unknown, or other
  misc_feature (897)..(897): n is a, c, t, g, unknown, or other
  misc_feature (1154)..(1154): n is a, c, t, g, unknown, or other
  misc_feature (1227)..(1227): n is a, c, t, g, unknown, or other
  misc_feature (1228)..(1228): n is a, c, t, g, unknown, or other
  misc_feature (1235)..(1235): n is a, c, t, g, unknown, or other
  misc_feature (1237)..(1237): n is a, c, t, g, unknown, or other
  misc_feature (1238)..(1238): n is a, c, t, g, unknown, or other
  misc_feature (1240)..(1240): n is a, c, t, g, unknown, or other
agggagggggaaaaaaaaaancaccccccaanncnccccaacccccacaacantaantaanannnnnnnnnnnaaaggggctccccccggtggcggccgctctagaactagtggatcccccgggctgcaggaattcgtctcacccctagaaaaaacccgccgaaggccagagagaaattctcatcttctctccaccggatcggttcaatcgagagcgagggagaaagggaggtggtgcgtcgaggggggccgagattttgccggtttggagccagataggggtatgaactgcttcgcgcaccgccgccgctccgacgtcgcccgccgccaggacagcctcctcgtcttcgtcttcttcctctcgattcccatacgtaccagtagttttaatttaagtagtagtaattgtagtagcaatctcttgtaaactgcgctcgcctttgcctgttcatggccctttgcgctttatcccccccgcgcccccaatatctccttattcatctcctctccacgccaaaccgggcggctgggtatggatacccaatgggcctacaaaaatgggaagggctttttgcttccccaaccatatcaagaaggcgggtgcgaacttacccccttccattgcccgtgaatttggtcacccccgccggggtggggccattcctacgggggcgggtttgcaaaaggtgggcccccggttggcccccttctttcccaaatatttcctttttactttttgtaagggagggggaaccttccgtgtgtttcttgggaaaaaattctcctcaaagaaaaaatatttctcgaaaattttttgggaggccgaacgcgtgaggaggagagcatatttccacactataacccaagncgatggaaaaaaacccctctcacggatgngtgggggagaatgggtccgccctcagagacttttttgtgtagataacaattgggtgagaaaaacacccccctacctcttgtgtgatccttattcactccccgggcggtatggtttgtggtggcgcacacagtagaccgaagaatatgtccccccgcggtaggtgcggcgccccccgtctttgttggtataatagaagggctctctcttctcgttgtaggcatcgttcggcagggatttgtattttctcgctcccgcntctacgagtggccacgggtgtgtagtagagtacgtgcgagcggtcctcctttcgttctgtaggagcccctgcnnccggtgntnngnaaaaaagaccgttctgctctctctctcgtg

SEQ ID NO: 95507 - DNA, 803 bp, Zea mays
  misc_feature: Ceres CLONE 1585732
  misc_feature: Encodes the peptide sequence at SEQ ID NO. 95508
  misc_feature (397)..(397): n is a, c, t, g, unknown, or other
  misc_feature (415)..(415): n is a, c, t, g, unknown, or other
ctcaccgcggtggcggccgctctagaactagtggatcccccgggctgcaggaattcgtctcacccctagaaaaaaaaaatcctcctaaacctcccccctgtttgtcacaggcaacacgcgtctccgtcctcccacctcactctagtctagtcttctcccccagcagcaaaaatggtaaaaggtttgaggtctgcgtgacatgtgaagaagagagagtgctccagcattagcctttgctctcgtctgctcgctcaacggctacttcctgcgtcgccgtggtgctgggtttgggagactgggggaggcggattgtaggaagagctggtgtgtggtgcggtggtcaccaaagagcgccggaaccggagcggcgatgggctgctgccagtcccccccccancggctggaggcggtgtcncggtgcaaggctcgccggcggtacaccaagcacctggtgcaggctcggcgggacatggctgcggcgcacgcgctctacctgcgcgcgctccgggccaccggagcctcgcttctacacttcgccagcgccgaggccgaccacccgcaccccccattcctccgggggcccaccaggaggcggccggcgttccccaccgccagggaccttccccggcggccggttaagccccttccaaaaaaaccaagggtcctgggaagaacaaattccttcctcgaatatccggggtgccgggaatctttggctctctcttcccccggccgggcgaacaaaagggcgctcaaactgggccggtcccagccctggggaaaacttctctgggggaacccct

SEQ ID NO: 95508 - protein, 144 aa, Zea mays
  misc_feature: Ceres CLONE 1585732
  misc_feature (1)..(60): Pfam Name: DUF630 Pfam Description: Protein of unknown function (DUF630)
  misc_feature (9)..(9): Xaa is any aa, unknown, or other
MGCCQSPPXRLEAVSRCKARRRYTKHLVQARRDMAAAHALYLRALRATGASLLHFASAEADHPHPPFLRGPTRRRPAFPTARDLPRRPVKPLPKKPRVLGRTNSFLEYPGCRESLALSSPGRANKRALKLGRSQPWGKLLWGNP

SEQ ID NO: 95509 - DNA, 851 bp, Zea mays
  misc_feature: Ceres CLONE 1585733
  misc_feature: Encodes the peptide sequence at SEQ ID NO. 95510
  misc_feature (663)..(663): n is a, c, t, g, unknown, or other
tggagctcaccgcggtggcggccgctctagaactagtggatcccccgggctgcaggaattcgtctcacccctagaaaaaatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaaagtcaccgaaccgccttgtcgtcgacgaggccaccaacgacgataactccgtcgtcgctctgcaccctgacaccatggagaggctgcagctcttccgcggcgacaccgtgctcctcaagggtaagaagaggaaagacactatttgcatcctccttgcggacgaaacctgtgaggagccaaaggttcggatgaacaaggttgtccgccagaacctaagggtgaggcttggtgatgtggtttctgtccaccagtgccaggatgtgaaatatgggaagcgtgtccacattcttccaattgatgatacagttgaaggcattacagggaaactgtttgatgccttcttgaaaaccatattttctaaaacatacaggcccgttgaggaaaggtaacctttttccttgtcaganggaggaatgagaagtgtgggatttcaaatgggaaagagactgatccctgctgaaatattgtttccttggcgcccagaaacggaaataatttgggggtgggggagcctttttaaaaaggaaggtttaggacggtccttaaaggaaattggtttaatagaaaatttggggggggatattttaaaaaaaaa

SEQ ID NO: 95510 - protein, 157 aa, Zea mays
  misc_feature: Ceres CLONE 1585733
  misc_feature (30)..(116): Pfam Name: CDC48_N Pfam Description: Cell division protein 48 (CDC48), N-terminal domain
MASQGEPSASASDPKEKKDFSTAILERKKSPNRLVVDEATNDDNSVVALHPDTMERLQLFRGDTVLLKGKKRKDTICILLADETCEEPKVRMNKVVRQNLRVRLGDVVSVHQCQDVKYGKRVHILPIDDTVEGITGKLFDAFLKTIFSKTYRPVEER

SEQ ID NO: 95511 - DNA, 912 bp, Zea mays
  misc_feature: Ceres CLONE 1585735
  misc_feature: Encodes the peptide sequence at SEQ ID NO. 95512
  misc_feature (912)..(912): n is a, c, t, g, unknown, or other
ctggagctccccgcggtggcggccgctctagaactagtggatcccccgggctgcaggaattcgtctcacccctagaaaaaatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaaagtcaccgaaccgccttgtcgtcgacgaggccaccaacgacgataactccgtcgtcgctctgcaccctgacaccatggagaggctgcagctcttccgcggcgacaccgtgctcctcaagggtaagaagaggaaagacactatttgcattgtccttgcggacgaaacctgtgaggagccaaaggttcggatgaacaatgttgtccgccagaacctaagggtgaggcttgggtgatgtggtttctgtccaccagtgccaggatgtgaaatatgggaaagcgtgtccaaaatttcttccaattgaatgaaacagttgaagggatttacagggaaaccctgtttggatggcctttattgaaaacccatatttcccataaaacatacagggcccgtttgagggaaagggaaaccctttttcccttggtcagaaggagggaatggaggaattggggggaaatttcaaaggggaatagaagacctgaatccctgcgctgaataaattggtaaacccttcggggcccaagaataccggaaaagaatattgtggtgaaatggggggaagccctttttaaagaggggagaggatataatgggaccgttccttggtaaaaaagtggggtttatagattatatacgtttttataggctggtggaatn

SEQ ID NO: 95512 - protein, 105 aa, Zea mays
  misc_feature: Ceres CLONE 1585735
  misc_feature (30)..(106): Pfam Name: CDC48_N Pfam Description: Cell division protein 48 (CDC48), N-terminal domain
MASQGEPSASASDPKEKKDFSTAILERKKSPNRLVVDEATNDDNSVVALHPDTMERLQLFRGDTVLLKGKKRKDTICIVLADETCEEPKVRMNNVVRQNLRVRLG

SEQ ID NO: 95513 - DNA, 875 bp, Zea mays
  misc_feature: Ceres CLONE 1585739
  misc_feature: Encodes the peptide sequence at SEQ ID NO. 95514
tggagctccccgcggtggcggccgctctagaactagtggatcccccgggctgcaggaattcgtctcacccctagaaaaagcgctcaattccactgccaagattcgccactccgtccgttaccttcactcgctcactcacaatgcggcgccatggcgaggtacgcgtgatctttgctatggccgccgccgccgccgccgcgctcttggcgtcggcggccgtggccggacgagacggccggcagacctacatcgtccacatgtcccattccgccatgccggacgagttcgcggagcatgaggaatggtacgccgcgtcgcttcaggcggtgtcggatgccgccaccgtgctgtacacctacagcaccctcctccacggctactcggcgcggctgacgcgcgcggaagcccgcgcgctggagtcgcagcccggcgtgatcgtcgtcaaacccggagtgcggtacgagctgcacaccaccgggacgcccgagttcctggggctggacggcacggacgccctgttcccgcagtcgggcaccggggaccacgtccttctcggggtgctcaaaccgggcttctggccgggaaaggccaaactacaacaacccggggttgggccccctcccctgggggttgggaagggaaatgccaaaaaaggaaaaaatttttaaagccctcccgggggaaaaaaaaattcttcggggcgagggtttttcccaaaagggtttttagagggcccaaagggcccccggggaaaccaacaaaaaaacccccgccccccagggagaaaacacgggccccggggaccacacctcgacccccccgcggggggggggggggccccttaagggggggcacactctttttgtttttttttt

SEQ ID NO: 95514 - protein, 175 aa, Zea mays
  misc_feature: Ceres CLONE 1585739
  misc_feature (34)..(110): Pfam Name: Subtilisin_N Pfam Description: Subtilisin N-terminal Region
  misc_feature: SWISSPROT Homolog: EC 3.4.21.25 Cucumisin
MRRHGEVRVIFAMAAAAAAALLASAAVAGRDGRQTYIVHMSHSAMPDEFAEHEEWYAASLQAVSDAATVLYTYSTLLHGYSARLTRAEARALESQPGVIVVKPGVRYELHTTGTPEFLGLDGTDALFPQSGTGDHVLLGVLKPGFWPGKAKLQQPGVGPPPLGVGKGNAKKGKNF

SEQ ID NO: 95515 - DNA, 808 bp, Zea mays
  misc_feature: Ceres CLONE 1585750
  misc_feature: Encodes the peptide sequence at SEQ ID NO. 95516
  misc_feature (523)..(523): n is a, c, t, g, unknown, or other
  misc_feature (604)..(604): n is a, c, t, g, unknown, or other
  misc_feature (792)..(792): n is a, c, t, g, unknown, or other
ctccccgcggtggcggccgctctagaactagtggatcccccgggctgcaggaattcgtctcacccctagaaaaagcaaaaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtccacatcctctgctcggcgttcctggtcgtcttcgtcggcaccgtgtacgtgatgtcgcagcccaggccggtgtacctggtggactacngctgctacaagccccccgccagctgccgcgtgcccttcgccaccttcatggagcacacgcgcctcatcagcgacgacgacnagagcgtgcgcttcccagacaggatcctggagcgctcggggctcggcgaggacacgtgcctcccgccccgcaacactacatcccgcccaaccccaggatgggagcctcgcgcgccgaagcgcagctcgtcatcttctccggcatcgaagacctcgtccgccgcagggggctcaggccaaaggaaatcnacattcttcgtcgtac

SEQ ID NO: 95516 - protein, 187 aa, Zea mays
  misc_feature: Ceres CLONE 1585750
  misc_feature (79)..(182): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature (93)..(93): Xaa is any aa, unknown, or other
  misc_feature (120)..(120): Xaa is any aa, unknown, or other
MPSGSAFSGSVNLKHVKLGYQYLVNHFLTLLLVPVMAATALELARLGPGELLSLWRSLELDLVHILCSAFLVVFVGTVYVMSQPRPVYLVDYXCYKPPASCRVPFATFMEHTRLISDDDXSVRFPDRILERSGLGEDTCLPPRNTTSRPTPGWEPRAPKRSSSSSPASKTSSAAGGSGQRKSTFFVV

SEQ ID NO: 95517 - DNA, 794 bp, Zea mays
  misc_feature: Ceres CLONE 1585754
  misc_feature: Translation starting site: 149
  misc_feature: SWISSPROT Homolog: EC 2.1.1.14 5-methyltetrahydropteroyltriglutamate--homocysteine S-methyltransferase
ctggagctcaccgcggtggcggccgctctagaactagtggatcccccgggctgcaggaattcgtctcacccctagaaaaatgctcctctcctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggaccggaggagagattgggatttgacacctactttctcatggccaggggcaacgccactgttcctgctatggagatgacccaatgggttgaccccaactaccactttattgtccttgaatggggcccaaacccaagttcctcctatgcttctcccaaggctggttacccaatttaaggaagctaagggccctccggtgtttgataccggggccagtacttgttgggaccagtccccgtacctggttgctccaaaacccggccaagggggggtggagaaaggaatttcccctttttttttccctttcttttgcaaaatcctccccaggtttaaaaaggggggttctttttctaaatttaaaaggccccctggggcgctttcccgagatatcagttt

SEQ ID NO: 95518 - DNA, 950 bp, Zea mays
  misc_feature: Ceres CLONE 1585755
  misc_feature: Encodes the peptide sequence at SEQ ID NO. 95519
  misc_feature (404)..(404): n is a, c, t, g, unknown, or other
  misc_feature (405)..(405): n is a, c, t, g, unknown, or other
ctggagctcaccgcggtggcggccgctctagaactagtggatcccccgggctgcaggaattcgtctcacccctagaaaaaagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctggggggccccaccnncactcgtcggctacatgtcccgaacccatggccaggcagaagaaccctatctctgcacagcaccccatcaagtaatcaatttcgcccaactacctctggcgaaacttcatcttcctggggggaaaggggcaggaattccgggcttgcaggcttcattcaaacccagcggcttcccaaactttctcccctttcgcccccttcctttaacccgggggcgggccttccggcaaaacccccgaagggtttggaatctcgccggtgggtccggaaagccccactatttcgttttaaaaaaaacccccacaaggggcgcccccggttgtttccccccgcgccctctggggggccaagggggaacctttccccccccaaaccaaggatttgaaccgggggaaccgtggggaaccacggggggctttaccccaattcggttgtaagggcgttacccccgttttcgtggggaagtggggggcgccccccttgggttctcccccggggggggggggggccccggggtataaacccgggggcggggggccccggcg

SEQ ID NO: 95519 - protein, 234 aa, Zea mays
  misc_feature: Ceres CLONE 1585755
  misc_feature (90)..(90): Xaa is any aa, unknown, or other
MAVALLAALVASAAMLAGTASASPAEGIQPLSKIAVHRATVEMQPSAYVRATPSLLGEQGEDTEWVTVKFGWKEPSEDDWIGVFWGAPPXLVGYMSRTHGQAEEPYLCTAPHQVINFAQLPLAKLHLPGGKGAGIPGLQASFKPSGFPNFLPFRPLPLTRGRAFRQNPRRVWNLAGGSGKPHYFVLKKTPTRGAPGCFPPRPLGGQGGTFPPPNQGFEPGEPWGTTGGFTPIRL

SEQ ID NO: 95520 - DNA, 879 bp, Zea mays
  misc_feature: Ceres CLONE 1585757
  misc_feature: Encodes the peptide sequence at SEQ ID NO. 95521
ctggagctccccgcggtggcggccgctctagaactagtggatcccccgggctgcaggaattcgtctcacccctagaaaagaaggttcttgcctcgttgggaagggatggcgtcggaggtgggggacgaggcggcgacgccgctgctcgccaacggtgcagccgacgtccgccggaggagggaccaggcgaaggcaattctgtccacgcaggccgtcaggatcgccaccaaggccgagcagcatgagcgcttcatctttaaggtcacacacttgctgggtgttcttggatttgggggattttgctatctcttgggtgccagaccacaggatgtgccatatgtgtactgcctgttctatgtcatatttgttccgctccgctggatttactaccgctacaagaaatggcattactaccttctggacttctgctactatgccaacacctttctcccttgtaatgatttctcttctacccagaggatgaaaaactttttatggggttgccttctcgttggcagagggtcccgcttgcttgggcatttaattgggtgggcgttgcaacctgggttttcaggttcttttgacaaactttggtagggggcccgaacccatccctttccccggggaatggttctttcccccattcccggggggggggaacccccaaaaattttggcgggccctgcccccccaaaggggaaaaattctccaggtccccctgggccctttggggggaggaaaaatctattttggggggaaaaggggtttttttttttgttcccggggcgtgtttttccccccgggggggaaactttttggttttccccccaaaaaataatgcgcccgcgccccaccaagagtgtgtttaaggacgccccc

SEQ ID NO: 95521 - protein, 163 aa, Zea mays
  misc_feature: Ceres CLONE 1585757
MASEVGDEAATPLLANGAADVRRRRDQAKAILSTQAVRIATKAEQHERFIFKVTHLLGVLGFGGFCYLLGARPQDVPYVYCLFYVIFVPLRWIYYRYKKWHYYLLDFCYYANTFLPCNDFSSTQRMKNFLWGCLLVGRGSRLLGHLIGWALQPGFSGSFDKLW

SEQ ID NO: 95522 - DNA, 1018 bp, Zea mays
  misc_feature: Ceres CLONE 1585763
  misc_feature: Encodes the peptide sequence at SEQ ID NO. 95523
  misc_feature (606)..(606): n is a, c, t, g, unknown, or other
  misc_feature (1018)..(1018): n is a, c, t, g, unknown, or other
acccgcggtggcggccgctctagaactagtggatcccccgggctgcaggaattcgtctcacccctagaaaaaaaaccgcgcactccaaacgcgcacgcgctgttcgttcctcggccgctctgtccacccccgtccttctccgacctcaacagatctccgcctgccgtgcggttccttaattcgccttctccgggactgtcggatctccaccgcggctggggatgggcaaatgctgcgtgacgccgaaaacagccgacgactccggcggcggcaagaagcccagggagccgaagcagaagaagggtaagaagccgaaccccttctcgattgattaccaccgcctcagggcaggcgagccccccaaagctggtggtgcttgcaggatcccaaaaaaacccccccccccgccggcccggggtaagagccccccccccgaaagcttccggccgcgagcggagtttcgggggtttaccttaccctctggccccaaaacccggggcccacacagggggagaggcgcttgggccactgcaaaaagtctatattccccccaataataaaaaaaagtttttccgccaaacccgggccgttcgccaacccttccanaaagggatactcttgaccctctcccgggggaaggtggtgggagaaaaaaattctaaaatatagagtttctctttcccctgttgggggggaaagagggccaccacccccctatacccgttgggcgtgttctacaagggcgttgttaggaggggcaaccacacgttgtgaccgcaagaggtgacacccatacgcaaaatgtggccccacgggggacacaccccctgtgcgggtgcatttatttgtaaagatctcttatttatatcaacattgttgtgagagtatgtgagaaggggggatttatctcgataacagactgatatgtgtgtggggaggcaccctcagcgttggggacaagaaaaatattttcgccctaatgggaatgtgtgcgtttggtcgccccccggatctgtgn

SEQ ID NO: 95523 - protein, 111 aa, Zea mays
  misc_feature: Ceres CLONE 1585763
MGKCCVTPKTADDSGGGKKPREPKQKKGKKPNPFSIDYHRLRAGEPPKAGGACRIPKKPPPPPARGKSPPPESFRPRAEFRGFTLPSGPKTRGPHRGRGAWATAKSLYSPQ

SEQ ID NO: 95524 - DNA, 905 bp, Zea mays
  misc_feature: Ceres CLONE 1585764
  misc_feature: Encodes the peptide sequence at SEQ ID NO. 95525
tggagctccccgcggtggcggccgctctagaactagtggatcccccgggctgcaggtattcgtctcacccctagttatctgtcgttgctctccgccgccccagtgcccgtagcgctcgccgccgccgccgccaccaatggagagcctccggctcgccgtcacccaccgaccggctctccctctcccgacctcccatagccacctccgccgccgccatctgcacctccacctccactcttaccccaatcccctctccctctcaccccccatcgcctcccacctctcacctatccctcgccgccacctgcccccgctcctcgcctccgcatcggcctctcaagcgagctctaagccggcggcgtcggcggcatctggcggtgctaaaccgctgcccctctttctctcgcttgccgccgggctcgccctccgcttcctcgtgccgcggccgggtgtagtaaaccccaaaggcctggcagctccctctccatctttcctctccaaccatcgggggggctcgtcctccggcccggtcccccggtcgggggcgtgggggcgtttccttgggcctccacaggccaacggtgggccaacccggaaaggttcccccttttaacggccccggtttcgggggcggttcccctaaacgaaagtcatcctgggctccatccggaatattccctttctttttttccccggggcgggttttttttataaaaccgggaactcgggggaaacacggttttccccccccaaactttgggtaaaaagggggggggtgggccgcaaacactttttggggcccttctccctaatggggctttgcccctctaaggagagggttttttattttccccccctgtgcagtgtgcccaggaaaccacggtgccaaggggggcggggggtag

SEQ ID NO: 95525 - protein, 31 aa, Zea mays
  misc_feature: Ceres CLONE 1585764
MGLCPSKERVFYFPPLCSVPRKPRCQGGRGV

SEQ ID NO: 95526 - DNA, 908 bp, Zea mays
  misc_feature: Ceres CLONE 1585766
  misc_feature (390)..(390): n is a, c, t, g, unknown, or other
  misc_feature (421)..(421): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (590)..(590): n is a, c, t, g, unknown, or other
  misc_feature (644)..(644): n is a, c, t, g, unknown, or other
  misc_feature (645)..(645): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
gtccccgcggtggcggccgctctagaactagtggatcccccgggctgcaggaattcgtctcacccctcgaaaaaataaaacccacaagaacccgccagatctaaatgggcgcaagaaaaggtcaaacgattaaggaggaaaagcgaaactattaatcaaaggtctggcacgtgaattggacaatttcacccccttcctatccacggcgagatctttatcaatatttcactccttcaggtccctcttcacagcctctgtccacgtcaaagatggtcgacctctacctctcttcacattctcgggacgcctaattattccgatatgcattggtgcctcttcacggtcttccttggatatattcccaaacctctccaaacgatgttgcataancttctcctcaattggcgctaccttctaaaancctctctcgtatgaaatcaattcccggactcggggtccctccccccgtggtgtggcgcccctttcttnnnnnnnnnnnnnnnnnnnnnnnnnnnnnnnnctccccggccaacccactagttgggttgaactgtcaccaaacccccctattagttttttatttccaaggnaatttgggtggttccaagtctttaagcaacccttatccatgagataaaggggtnntggggtttggtatgaannnnnnnnnnnnnnnnnncggaatggttccttccccccttccaacaaggaatggcccagaaatttcccccggccgggtttccaagaaaaaaaaaaaaaaaaaacagtcctccattccccatttccctaaggaaatttccacccccccaggaaatagggaaaaggggatttaaattttaaaggattcccccttcccccctttcagcccagtgtgtacgccaatttctttccttggggccaaaattccc

SEQ ID NO: 95527 - DNA, 848 bp, Zea mays
  misc_feature: Ceres CLONE 1585767
  misc_feature: Encodes the peptide sequence at SEQ ID NO. 95528
  misc_feature (392)..(392): n is a, c, t, g, unknown, or other
ctggagctcaccgcggtggcggccgctctagaactagtggatcccccgggctgcaggaattcgtctcacccctagaaaaaaacgacaacctccacctcgccttcaactcctccacgctcccgtcctctccacctctcgctcccacctcccccgccgtcaccaccaccaccacagcctctcccccgcaacgcgttccttcccggtgcatgaaaccctaaacctataccccactcccctccccgagccatcctctccccccgcggcgatggccaaggcgctgctctactcctccctcctccccgggctgacccgcgctgtcgggagcagcctgagcgctgccgcgaggctgctgctgctcccgcctctccggctgcgccgcggtcggagcgccncccccccaagcgcggtgagggcggcccctgcaacgggctcgactccgtcggcgggccccatctccagggcgcgctggaagcgcgccgagagggagctctacacgctcggccaacacaacggtagcccgggggcggacacccccccggggcgccgggggacgaaaccgggccaaactgcggccagcggtcccaaaagaaacggcggttgggttcgggtttcatccaccaagggccctccgagtccgttcctcaagggggctcaaaggaatggcctccccaacaaattaatggggccgtaaccccctacggaattttcccagaattccttcctaacaaacaatgggtaaagggtgccaacttttgccttttacccaaaaagccgggggggaatcaaaccctgggccaagcaagaaatttccagccccccgctttaaaagcaaaccccggcggaaattt

SEQ ID NO: 95528 - protein, 141 aa, Zea mays
  misc_feature: Ceres CLONE 1585767
  misc_feature (43)..(43): Xaa is any aa, unknown, or other
MAKALLYSSLLPGLTRAVGSSLSAAARLLLLPPLRLRRGRSAXPPSAVRAAPATGSTPSAGPISRARWKRAERELYTLGQHNGSPGADTPPGRRGTKPGQTAASGPKRNGGWVRVSSTKGPPSPFLKGAQRNGLPNKLMGP

SEQ ID NO: 95529 - DNA, 756 bp, Zea mays
  misc_feature: Ceres CLONE 1585769
  misc_feature: Translation starting site: 159
  misc_feature: SWISSPROT Homolog: EC 1.4.1.2 Glutamate dehydrogenase
  misc_feature (367)..(367): n is a, c, t, g, unknown, or other
  misc_feature (497)..(497): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgntctttgaatgcccaaagcgtctcatcgggcaggaagttcagtgatgcgtctgtccagagtgatatcaagttgtggcccttcaagtcatttctgggcctggtgagagccaatgatttgtgtcagcacaggntgaggagagcagtttgcactgagagatctcctctatgttcctaccaaaaggcgtgaaatgctgaacctacccttggagcccgatcaaaaaggctgggggcacaggccccggccttttttaatgaaatcccaaaggcggccccaaaggatccttggggggaattgctggccttaaggggccggggttatattaaaggaagccaaaaggtggggctttttcccctttggtctttgacaaaaaaggctccccacagggtcgg

SEQ ID NO: 95530 - DNA, 989 bp, Zea mays
  misc_feature: Ceres CLONE 1585770
  misc_feature (860)..(860): n is a, c, t, g, unknown, or other
ggccgctctagaactagtggatcccccgggctgcaggaattcgtctcacccctagaaaaaaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgtttggccggagtgggggcgtagatttccggcggccatggggggcgccgtgatggtcgccatcgcggcctctatcggcaacttgctgcagggctggggaaattgcgacaattgcctgggagccggccctggttcataaaggaaggaaatccaaccctgcagaaggcgaagccctcctgaatccgaggggccccccaatcccgttggcgaccaagggtcccccccccagaaatttttggggggggggaaaaaacaaatttgtcccttataataaaaaacaggaaggagtgccattctcccggggggggggagtagaaagtgtccgagaccccaccctggggtaccgccccccgcggagggagagaagaacccccccctcctacggtggggcgaccagcaccctccgtgccggtgtgatccacaataaccttgaatcacatcgaaggtgggcggggttggtaggagggaggaagatatacataaaaaaagaaggagagccccgcggtagaacgagaaacaacatctatataccatcctgccgccccccgaaagtgacgagtaacgctctattatacagttttgatgctgacggcaacccgtctctgggaagtagggactnttttcgtgttgattatctcgaccacgaccacgcactctaggcttatggatattaaccctattgctcacactagagactgcccattggattggtttggtgtgattacttgtccaagatttgtctgtttaa

SEQ ID NO: 95531 - DNA, 871 bp, Zea mays
  misc_feature: Ceres CLONE 1585779
  misc_feature: Encodes the peptide sequence at SEQ ID NO. 95532
  misc_feature (411)..(411): n is a, c, t, g, unknown, or other
  misc_feature (416)..(416): n is a, c, t, g, unknown, or other
ctggagctccccgcggtggcggccgctctagaactagtggatcccccgggctgcaggaattcgtctcacccctagaaaaaaccttccccttcccactcggccactcctcatcagccatccccaaaaggccaaaacccgcgcacaccggcgacggccggagaacctcctgccggccgccgccatgccgccgcctctacaggcccaccgcctactcatctcccaccgccgcctacccactccagctcgccgccggttcaccgccgcctcttccgtccaatccgctcccaccacaaccttggccccgggccccgccacatcctccatcctctccatccgcgagtcgctcctctcaggagagaggaccgcggcggacatcacctccgagtacctctcccgcccccccgcgccccnacccnaccttgcgcagcttcatccacgtcccggacgccgccgccgagcgggaggcggaggaactcgacccggaggattgcctccggggagaaggatgccgtgggtccgctcgctggaatgcctggtgggagtgaaagacaatctttggccaacccaacatgcccctccacgggcggggtcccggatactggaacgggtacccggccgggcctacaaacccccactgcccttccgccggcttgctggaagccccggcgctttttttgtttgggggaaaacggaacctccaacaaaattccggaaagggggaacgcccccccccaaggggcctcccccggtttcaggggaaataccgaaaacccccggggggaggaatctccacggtggtccctggcgggggaacccccctggaggggtgttcgggtcccgcccgccagatttttgggcttaaggccatagg

SEQ ID NO: 95532 - protein, 226 aa, Zea mays
  misc_feature: Ceres CLONE 1585779
  misc_feature (77)..(77): Xaa is any aa, unknown, or other
  misc_feature (79)..(79): Xaa is any aa, unknown, or other
MPPPLQAHRLLISHRRLPTPARRRFTAASSVQSAPTTTLAPGPATSSILSIRESLLSGERTAADITSEYLSRPPAPXPXLAQLHPRPGRRRRAGGGGTRPGGLPPGRRMPWVRSLECLVGVKDNLWPTQHAPPRAGSRILERVPGRAYKPPLPFRRLAGSPGAFFVWGKTEPPTKFRKGGTPPPKGPPPVSGEIPKTPGGRNLHGGPWRGNPPGGVFGSRPPDFWA

SEQ ID NO: 95533 - DNA, 872 bp, Zea mays
  misc_feature: Ceres CLONE 1585780
  misc_feature (421)..(421): n is a, c, t, g, unknown, or other
ggagctccccgcggtggcggccgctctagaactagtggatcccccgggctgcaggaattcgtctcacccctagaaaaaagctcagctcgtgttcgacccatgctttccacgaagcatgggcaagaccaagacggcaggagcaggggagcagcagctgatgataagctagctagccagagtcccactccactttacctccttgtcagctgctcgcacttgcagcgtcccgttcccgcacttctcttccttctcgtttcgtcctgcacagcgcacgcaactgccaccggccaccgcgcaaactccattgcgcgcagatcaagaccgccacacccaccaccagcgcttcagcgggagacgtgacgactgacgagacgaagcctctccccacggtgccccccccctccacatggcctgggctcgncttgcctccccgctcccgtctgcgcccccggggctccgccgcccgggcgatcccgacacgcctcaacacggggtccgcctccgcctccgtccccacctaacacacggcagggtacctgcgggcacctttcgcggcaccggctccgggggtctccctcctggcttcggcggggaaccggtttgcggaagccacgcccctcaagcattcaaccgcgtggggtgcctccggggcccccttgggccccaggggcaacggcagggagggtgctttgcgaaggggccgccttacccgggggcaagggaacccccggggggaggcgtcctgaaaccgggggggatgggccccctgggggcaaaaatgggggaagggcatcccccgaaagggcaacctttttggcccttggttttcttcccccaaggggggacccaaagttgaatgaaattcccacccc

SEQ ID NO: 95534 - DNA, 824 bp, Zea mays
  misc_feature: Ceres CLONE 1585783
  misc_feature: Encodes the peptide sequence at SEQ ID NO. 95535
  misc_feature (561)..(561): n is a, c, t, g, unknown, or other
ctccccgcggtggcggccgctctagaactagtggatcccccgggctgcaggaattcgtctcacccctagaaaaacctcgttgatcgatgatcatgcgtgtcgtctgggctggtcgacgatgagctatagctgggtagtatcagtagctagtagctatccccatgcatggatcatatcactgctggccggccggccggtggtcgctgagcactaactacgtgcctcttgtagccatgtcaggaaagatttatctggtcggccgatcgagctcctctcctccgaagcactgaagctccagcggctgccctgcctgacagccactccgcacgacaaaattaaacgcgggcgatcaagatggcgcacgaccccagcctgggcttcgcggactacttctcggcggcggcggcggcgggcgccacggcgatggacgacgacgtcggggcgccggagctctatggcctgcatgccgacgacatggagttcctcggcatgcgtggcctggccgccatgccccccgccgcggcacaccaccagcaccaccaccatcacggccacagcaangccggtgcgctcctcgacgacgacgacgcggggggtggggccagacgtcagcggctccccggacgacgccaccatggcgctcctgagcgagcagcagcagcagcagcaccaggcgccgctgtcgctgtcgctgtgccggccggacgtggcgactacgttgcacgaacagcaccacttcgccgggcgggggctccccgtcccggtaccatcaggaacaccaaccgggcggcgggggggcaacaaaaacacaaactactcgccgt

SEQ ID NO: 95535 - protein, 156 aa, Zea mays
  misc_feature: Ceres CLONE 1585783
  misc_feature (69)..(69): Xaa is any aa, unknown, or other
MAHDPSLGFADYFSAAAAAGATAMDDDVGAPELYGLHADDMEFLGMRGLAAMPPAAAHHQHHHHHGHSXAGALLDDDDAGGGARRQRLPGRRHHGAPERAAAAAAPGAAVAVAVPAGRGDYVARTAPLRRAGAPRPGTIRNTNRAAGGQQKHKLLA

SEQ ID NO: 95536 - DNA, 803 bp, Zea mays
  misc_feature: Ceres CLONE 1585791
  misc_feature (783)..(783): n is a, c, t, g, unknown, or other
agctccccgcggtggcggccgctctagaactagtggatcccccgggctgcaggaattcgtctcacccctagaaaaaacaccccatgccttgcctcctcctcctgcctgcctgcctttccctcgccgctcgcggcaagatccacatgcagtagtaggagtaggagcagcaagcaacaagggagggagggagcgaggtcttgggctctcgctctcttgttagttcctgcgtgcttgccctgccctggatcggctttcaaatcgggaacaacgacagatccgaggctttctcgaatcgggcaggtccatcaaatcgcaagtttagccagccccagccccaggcacagccagctagccgtcaaatcactcacactcatcaaatcaaaggggaccaaaaggatatctcctggctcctgcccctctcccctctcctctcctagcgagctactcgtataaaattcccctttcgactctccccccacccacatacctgactctcctccgatctctcagcacgctcctcttctgctaccttgctttccctgctgcgatccgttccttgccctattagtattagctagccggccggccggatcgacgatcgagcaaggagaggcgccccagcagtcctcgtcggatcgatccatctcgtcgacagcgtcagcgcctcaggtggatcggagcggaggtggtggaccggggagctagtagctgccacacatttcggtcgtcgaaccacatatcatgatgtcgtcctcgtcctcgtcgtcagccgcctgctgcttnccgctggaccacctcgcgcc

SEQ ID NO: 95537 - DNA, 854 bp, Zea mays
  misc_feature: Ceres CLONE 1585795
  misc_feature: Translation starting site: 365
  misc_feature (854)..(854): n is a, c, t, g, unknown, or other
ctccccgcggtggcggccgctctagaactagtggatcccccgggctgcaggaattcgtctcacccctagaaaagtagcctcttcaatctcgccggccacctcacgtcctcacctcgcgtggcctcccgttctgacttcggagtccctcggtctcaacgactagttgagagctcgcggctccgttcgggcgaggggaggaggttcatgaggctgctgtaggctccgttgcagccgccgcgggcgggagtccgtgattttggacgccccaccgcggcaagatccggaagcgcgttggctgttgtgccgtgagtttcagtttcggtggtcgattgcttcagcctgctgagaagtaggaggggcggccatggcggggtcgaggttcgggtcgttcaagtcggagaagggcgactccgcctccgcagcggcggcagcgggtggagcggcgcataggagggacccgtacgaggtgctcgggggtgggccgcaccgccaccgaccaggagatcaagagtgcgttccgacgcatggcgctcaagtaccatccggacaagaatggcgatgaccctgttgcatcagacaggttccaggaagtcacattctcctataaacttcctgtcagatcccgataaaaaggcggcagtacgatacatcaggatttgatgccatccaattctgatagtcaggaacctggaagctggactttttcaagtctccaaccttgttaaacacgggggtttggcgcctcttttttagaaagccttgggggggcccaattaaaacaaccggtttcagcctacaggtttttagaaggagggcatttggaaggggttccgggttaatgggtttccccaacn

SEQ ID NO: 95538 - DNA, 818 bp, Zea mays
  misc_feature: Ceres CLONE 1585800
  misc_feature: Encodes the peptide sequence at SEQ ID NO. 95539
ctggagctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaaggagttcatggaagcccttgctgccggcgctgatgtgtccatgattggccagttcggcgtcggtttctactctgcctacctcgtcgccgatagagttgtcgtgaccaccaagcacaacgatgacgagcagtacgtgtgggagtcccaagcgggcggggcgttcactgttactcgtgacacctccgggggagcagcttggcagggggacctaagatcacactggttccccaaggacgatcaagctggaggacccttgaaggaggcggcccctccagggatctggggcaagaaagcaccctgtgattttttaggctaccccccatctccccggggggactgggaaaagaacaacacgagat

SEQ ID NO: 95539 - protein, 223 aa, Zea mays
  misc_feature: Ceres CLONE 1585800
  misc_feature (28)..(165): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHNDDEQYVWESQAGGAFTVTRDTSGGAAWQGDLRSHWFPKDDQAGGPLKEAAPPGIWGKKAPCDFLGYPPSPRGDWEKNNTR

SEQ ID NO: 95540 - DNA, 897 bp, Zea mays
  misc_feature: Ceres CLONE 1585802
  misc_feature: Encodes the peptide sequence at SEQ ID NO. 95541
  misc_feature (870)..(870): n is a, c, t, g, unknown, or other
tggagctccccgcggtggcggccgctctagaactagtggatcccccgggctgcaggaattcgtctcacccctagaaaaacccgccgccgccgcgcgccgctgcctagatccgccttccctcccccgctccccgccgccatggcgtcctcccgcacctcctgggccgacgtcgccgacgccgagcccgccccgcctcccccggtcgccgcccccgccgccgcatccaacggccccgcgcgttcctcctacgttccgccccacctccgcaaccgcccaccagccgccgccgccgccgcgcccgcctccgccgccccgccgccgcgctccaccgccggcctcctcacccgcaccggcggcggcagcagcttcggtgcgggcggcggcggaggattcggcgggggcccctcccgcggcggtgcccggtgggaccgcgaaccggacccgttcgcggactccgccgccgacgccgaggtcccgttcgacgagcaccagaacacggggatcaacttcgacgcgtacgaggacatcccggtcgagatgtccggccgcgacatcccgccccccgtctccaccttcgccgacattgacctcggcgacgcgctcaacgaaaaacatcgccgggggcaagtacgtgcgccccacccccggtgcagcggccaccgccatcccgatcttcgctcgccggccggcgaacctcatgggccttgcgcccacgaaggggctcccgggaagaaccgccgcctttccgggtttccccattcatcaggggggcttcttggaaaggcccccgttccccccggaaaaggccgccaaccgggggccggccgggccttggggggatttagggaaacggttttatccccccgttcngggggtttatttctctttcccccggaa

SEQ ID NO: 95541 - protein, 253 aa, Zea mays
  misc_feature: Ceres CLONE 1585802
MASSRTSWADVADAEPAPPPPVAAPAAASNGPARSSYVPPHLRNRPPAAAAAAPASAAPPPRSTAGLLTRTGGGSSFGAGGGGGFGGGPSRGGARWDREPDPFADSAADAEVPFDEHQNTGINFDAYEDIPVEMSGRDIPPPVSTFADIDLGDALNEKHRRGQVRAPHPRCSGHRHPDLRSPAGEPHGPCAHEGAPGKNRRLSGFPHSSGGLLGKAPVPPGKGRQPGAGRALGGFRETVLSPRSGGLFLFPPE

SEQ ID NO: 95542 - DNA, 918 bp, Zea mays
  misc_feature: Ceres CLONE 1585805
  misc_feature: Encodes the peptide sequence at SEQ ID NO. 95543
  misc_feature (361)..(361): n is a, c, t, g, unknown, or other
ctccccgcggtggcggccgctctagaactagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccanggtcgaagaggacatcaacacctgcaccggcgagttccaccaccgcttggagaggttccctccccctggctaaactgagcccgcccggcggccgggatccacgccccgttcctggcttgcctgcgtgcccttaatgtatgtcctgtggtttgaactggtttgtgccaggggccatcctaacttgggcctatcctaaaacgggcccgccacctcggcctctccttgtccgaattttccaaacacattaaggcccgcgggaccctggaaataaaaaaaagaaacccccccaaattcgcgggattaccattcgatttttgcgaaaaaaaacccccctgaaaggccaaagaaccattacctccctatccgggaaaagaatgtggataaagggcctatattttgggggggctccttttttggaccagggggccctttttttttgggccccaacaaacccaccggggccccgggggagtcccgcgtcgcaaggggaaaagcctaagagcccaaggggttctcccggggggggggtcttccccgcaaaaagccccctcggggaa

SEQ ID NO: 95543 - protein, 92 aa, Zea mays
  misc_feature: Ceres CLONE 1585805
  misc_feature (69)..(69): Xaa is any aa, unknown, or other
MAYYQEVDYCSEEVRSVAPAGFGRHGGGVQQHVVKEKFEEVDTVSRAGANHHHHHGHHGGHGFVVRETXVEEDINTCTGEFHHRLERFPPPG

SEQ ID NO: 95544 - DNA, 783 bp, Zea mays
  misc_feature: Ceres CLONE 1585806
  misc_feature: Encodes the peptide sequence at SEQ ID NO. 95545
tccccgcggtggcggccgctctagaactagtggatcccccgggctgcaggaattcgtctcacccctagaaaaacatcatggagccgccgcctggtgacgcctccaaccccgacatcacacgcgacgagatcatcgatagctatatcaagactctcgcccaagtcgtcgggagtgaggaagaagctaggcaaaagatatactctgtatcgactcgtcattactttggctttggtgctcttgtatctgaggaactttcttacaaactgaaaggtatttatgatctcattgagtaaaatataggagtaggaagtaaaacaatgttggatactctaaaatctgtccctggaatcttttccagaaattcccaaggtccgctgggttcttcctgattcatacttggatgtcaaaaacaaggactatggaggtaatgataacatgttctttatccagttatagactatgtgcattttcttggtcatgtacaaaaatcctgctcatgatactcgaattgccttttttcacattgtatttgttgtttgttaacactgttatatctttcttgcttttaacaatttattccagtttaattttgaacttgagtaatttaaaccttcattattttatatcagatgtgaaattgtgaatggctttttcaagtttattttctagtgtccaagcaattctatgaaaattgtgctcctttgctacttaattgacttgcctggcttttggggcccggaatttttccttttctatagggcttgagatgcaaggatatcactg

SEQ ID NO: 95545 - protein, 71 aa, Zea mays
  misc_feature: Ceres CLONE 1585806
MEPPPGDASNPDITRDEIIDSYIKTLAQVVGSEEEARQKIYSVSTRHYFGFGALVSEELSYKLKGIYDLIE

SEQ ID NO: 95546 - DNA, 1263 bp, Zea mays
  misc_feature: Ceres CLONE 1585808
  misc_feature: Encodes the peptide sequence at SEQ ID NO. 95547
  misc_feature (28)..(28): n is a, c, t, g, unknown, or other
  misc_feature (29)..(29): n is a, c, t, g, unknown, or other
gaggggtgttgaaaaaaaaaaaccgggnncttgtgccgctcggacggccgacccagggggaagataataaaataaaaactccccgcggtggcggccgctctttaatagtggatcccccgggctgcatgtattcgtctcacccctagaaaaaaacgcaagccgggcaagaaaactccgcatgccattctgcgagttggatggccttcttcttggccctcgtgtgcatcctcatcttgctagccatcgcctcctacgtccagtacagtcgctggcaaaaagggaaaggccacttcggcggccatgggaggtctgctcccttgaagctgcctcctggctccatgggctggccttaccttggcgagaccctccagctttactcccaggaccgcagcttcttcttctcttccaaccgaagaggttagtcgccgtaggcgactactaccactcatgcgggctgcgtgtttgttttttccccctctgtggcaccccttgttcacaacctgctaatgatttcaaacggaaccaaccctgcttgtccttgggttgccgggtaccggagaaaatctttcaagtacccaccttttccggggtttaccccgtaccgtttaattggttggcccaagtcccctaggaagggagacggcccggttttctggggcagtggtttgaaaccccatgggggcgcaccgggtgtgttctaagagccttataatccttatgctcctgctggtaaattgcaacgaagtgaggcgcctcctgtgattttctgtggtggtcccggttgcagggggcataccgccactttatatacttcttgcaatacactctatgggggcgcggtaaatcttttttcctgttaccattctttctccatggtgtctgtctccgacaaataaaatactagtcactattcttcatagtgggggctcgagtgcgtcactctcggtggtcgcaacgcgctaacagagtctacctcttgtgtcggacggcatggatctgagagaatatttcactgtcttactgtgcttgtcgcgagctcagcccccgctcgcgtttatcggaggtcacaccaagaatgtcgtgtaggagggatggcctgtcggtgaggtagtctgccctgggcgcgtctactttgtcaccaaagaaaggaagcgtgttttctctctaacgcgcactacttatgattattcacgcgccgtgtctgcttgttgtataggtggccgcgcgactatgatatgggcgtggcatatattacttctaggg

SEQ ID NO: 95547 - protein, 74 aa, Zea mays
  misc_feature: Ceres CLONE 1585808
  misc_feature: SWISSPROT Homolog: EC 1.14.13.93 (+)-abscisic acid 8'-hydroxylase
MAFFLALVCILILLAIASYVQYSRWQKGKGHFGGHGRSAPLKLPPGSMGWPYLGETLQLYSQDRSFFFSSNRRG

SEQ ID NO: 95548 - DNA, 853 bp, Zea mays
  misc_feature: Ceres CLONE 1585809
  misc_feature: Encodes the peptide sequence at SEQ ID NO. 95549
tccccgcggtggcggccgctctagaactagtggatcccccgggctgcaggaattcgtctcacccctagaaagtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatgggcatctccatgaacctggtgacgtacctcgtcggcgagctgcacctctccaactccaagtccgccaccgtggtgaccaacttcatgggcacgctcaacctgctcgccctcgtcggccccttcctcgccgacgccaagctcggccgctacctcaccatcgccatctccgccacaatcgccgccacgggcgtgagcttgctgacggtggacacgacggtgccgagcatgcgtccgccggcgtgcctggacgcccgcgggccgcgcgcgcacgagtgcgtgccggcgcgcggcgggcagctggcgctgctgtacgccgcgctgtacacggtggccggcggggggccggcgggctccaaggcgaacgttgcccggggttcggggtcgaaccaatttccaacgggcgccgaccccccggggaaggagccgcgcccaggggggtttctttcttcaacccgctttcttaatttttgggctaaaagccctgggggggtcccttgttttccccggtcacacccgggtggttggggggtaactgttcaagggacaaacactttgtgggggcccggggtcttttg

SEQ ID NO: 95549 - protein, 243 aa, Zea mays
  misc_feature: Ceres CLONE 1585809
MVSGAGHGGYGGGDDGQAVDFRGNPADKSRTGGWLGAGLILGTELAERVCVMGISMNLVTYLVGELHLSNSKSATVVTNFMGTLNLLALVGPFLADAKLGRYLTIAISATIAATGVSLLTVDTTVPSMRPPACLDARGPRAHECVPARGGQLALLYAALYTVAGGGPAGSKANVARGSGSNQFPTGADPPGKEPRPGGFLSSTRFLNFWAKSPGGVPCFPRSHPGGWGVTVQGTNTLWGPGVF

SEQ ID NO: 95550 - DNA, 1014 bp, Zea mays
  misc_feature: Ceres CLONE 1585814
  misc_feature: Encodes the peptide sequence at SEQ ID NO. 95551
ggccgctctagaatagtggatcccccgggctgcaggaattcgtctcacccctagaaaaaatctcccttccgttcccctattcgaaatcgaatcgggtccgacgggtcggtcttgccgtgcgtgcgtggctgcgcgagcgactcgactgcacccccgctcctcccagtccccacatactgcgcgccgccgccgggtcctcctagggtttcgccgcgatgtcgctccggccgagcgagcgggagcagatgccgaagggcaactacaagcagacggtagacgcggaggagagccgccgccgccgcgaggggccagatggtggacatccgcaaggccaagcgcgaggaaaagcccccaaaagaaacgccgcgaatggtttttctggggcccccgcccgcggtgccgccgaatggggccactccacccgcgcctccagcaaaaagctcctatgggtttgcgcggccaatgggggcaaggccggtgctactcccaaacgaaccccttccgtggcaagctttgaaggcccccccaccccaaattccaaggaaagcttgccttttccttaaaagagggggtaagtccccccccaattccgaaaaaaaggggggattcaggcccccccagggagtgggggggcccccgaccgaatacccaattggaggggttttgctttaccaccgcgggggagggaaaccattctcccccaaaagctcccacagtttttaggaaggcgctggcccagtggggctccctctccccccaaacatttgttgcacttcaggggggccaccctccgaagagaaaccctcttaggggctggggggagtctttaaaaataaggggggcgcctttacacccactcacctttgttggaaggaggactctaaaacgccaccccaagccaagggaaattttctcttaaaaaaagaggggtgagagggggcctcctaagagaaatgatatgcaccgagagaaacaccccagaaggtgcgctctggattcttgtggaaccttggg

SEQ ID NO: 95551 - protein, 115 aa, Zea mays
  misc_feature: Ceres CLONE 1585814
MSLRPSEREQMPKGNYKQTVDAEESRRRREGPDGGHPQGQARGKAPKRNAANGFSGAPARGAAEWGHSTRASSKKLLWVCAANGGKAGATPKRTPSVASFEGPPTPNSKESLPFP

SEQ ID NO: 95552 - DNA, 893 bp, Zea mays
  misc_feature: Ceres CLONE 1585818
  misc_feature: Encodes the peptide sequence at SEQ ID NO. 95553
ctccccgcggtggcggccgctctagaactagtggatcccccgggctgcaggaattcgtctcacccctagaaaaagccgtctagggtttcacagccgcaccccgatccactagagctatggagttcgacgaatacgagtacctggagaaggcggtggagccggctcccccgccggccaatggttccggctccggcgagaaggaccgcggctcgcgtcgccgctagggcgactagggccgcatatcgaagcgctcccgctcgggggaggaccgctagcggggccggcaccgcagcgttcgggaacaccgggatctggataaggatgacgggaaggagaaggagaggacccgcgatagccgcgggaaggacagagacagggaggggagagcaacggtgatatggagagggggagacaggccccggccgcctaaagaggaaggattgatccgtgagctgcaggactctgcagtcgctcgtgagccggggaccattattctggtaacaggaaatggctaatggagtgcatggaatttccaaccttcattcgcctgggcccaaaaacccatttttccgtaacccatgcaagggagggacgtagagtaaccctgtacaggggcatcatcctcccacctttgattctggtaaccggggtcgttcaccgaaaagtcattttggtttccccccagcccctccctggaaagcgggagaaggctgtcccaccaagctctttctttaattcgcattaagccggggggcagggggaaaatgatttctgggggaccgtacacagggtgtttaaaataagaccccttttaacccccggggagagccttcctcctcaatgacagataggcggagtgttacacgcggcggggagaaaagtcctcacgatgg

SEQ ID NO: 95553 - protein, 35 aa, Zea mays
  misc_feature: Ceres CLONE 1585818
MEFDEYEYLEKAVEPAPPPANGSGSGEKDRGSRRR

SEQ ID NO: 95554 - DNA, 990 bp, Zea mays
  misc_feature: Ceres CLONE 1585819
  misc_feature: Encodes the peptide sequence at SEQ ID NO. 95555
cacctcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgagtgatctctgaccgcgtcgacaactaccgcaggaccaagcaggtgatggcggccaccgtatcttcctgcctgagcctcgtccacaccgtgaaccaccgggccggcgggttccccaggagtgtggcactgacgaacacgcttcagcgccgtcttctttctcgacgctatccttgtcgtggcctcggcgacaagagcccaaccggaggccgccccttgtgacaatcaaggaacatggacctcagctctttttcagggcgcgggccgaaaaacggggagctccccccccccggagggcggggaggggccaagggcaggcaacaaattgggggagggtctggcggggaccccatttcaacgggtggtgggacccgccagggaagcgtgagcaccgcctaaaaggggaaagtttcggcgccaagaggcccaccttaaaggaaaaagggttttgcgaacttaaccaaaaccggcttttcttcccacacttattgtggggggagtggattatgccaattttatccccggggaggagagaaaccttgttctttccccggaggaggtgcgggccccccagggagggggaattcaggattagtgacgggtttttccctaccttagcattttagtgcccccccccggtgaaagacgaaccgttggtagtttctcccaaagatgtggggaatatttaagaaagtggcgcgcgaaacgtccaaaaatggggtgaaatccaagtatcgggggatcggttttattccgggaaatagaggggggcgttttccacccgggtcataag

SEQ ID NO: 95555 - protein, 57 aa, Zea mays
  misc_feature: Ceres CLONE 1585819
MAATVSSCLSLVHTVNHRAGGFPRSVALTNTLQRRLLSRRYPCRGLGDKSPTGGRPL

SEQ ID NO: 95556 - DNA, 627 bp, Zea mays
  misc_feature: Ceres CLONE 1585821
  misc_feature (211)..(211): n is a, c, t, g, unknown, or other
  misc_feature (513)..(513): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
tccccgcggtggcggccgctctagaactagtggatcccccgggctgcaggaattcgtctccccctagaaaaaacacacaacccaaagcagccacagcagcctccttcctggcttcctcctctcactctcgctcgtgctgcgctcgctacctcgcttcgcattccattcgaggaagagcgggtgagagggggaaggaaaggggcaagatgtncatcgaagagctttcccgcgttcgaagagcccccccaacgtgcgggtaaacgggccccaaacgggaaaaatcgaagtcccggaaaattcccccggggtacccaaaacccccaacggggaaaacctggggggtcacccccaaaagggggggccaaaagggaaaaagggggggggccccccctaaaaaaaaatttggggggggggggttttttcccccccccccccccccccaaaaaagaccccccccccccccccgggggtttcaaaaaattttttttcccgggggggaaccccagaaaaaanccccccgccgcggtttccccccccaaaaaaaaaattttttggggggggggggggggggggaaaaaaacccccccccttttggtttttnnnnggggggggtgtgtggggggagga

SEQ ID NO: 95557 - DNA, 865 bp, Zea mays
  misc_feature: Ceres CLONE 1585825
ctggagctccccgcggtggcggccgctctagaactagtggatcccccgggctgcaggaattcgtctcacccctagaaaaaaaaaaggtgagaagaaagaagccgtgtccgcgtgattttctgggtgaacttttcccggcctccgctccggccagatcggcgcgggtgaaccccagcccctaccgatccggatccgtccccatcgcctcgtgtgttttccgtcgagtattttagcgtgtgtgtttccccccctcttcgcttcggttggtgcgtgcggctgtctcgggtagatctggtggtttagttcgccttgaaggcgcgcggcggcggtgtcgcggcttgtagcttgcgatttcacggtggagcttgtcggctgttggggtcggatttggtgcgtggctgcttcggcgctaggcgatccttgtgctgtttccgtgggaatatttgtcgttgaatagataggtgaagttgctggaaacattgctttacgtggtaggggaccgtaaaaaatcgttcacgctcggggaggctgtgacaaattccctcgatgggtcgggctgatctctgagatgaccccgagctgaagtacccatttcaaaacgggccccgaccgtgaagcgactcatcatggggagggcttagcttggtccggttgttaagctgttgggggctttggccgggcctttttctgaaacctgatcgggtaaaagaatttgggctatcctccatgggtggttggggcactttcatccatctgcttggcttaacgggggggggaaatttttcttgaaacccaccttgtgacccgggtgggggcatttaggcccttttttttaaccgaaaaaaatttggggtatccgggcatc

SEQ ID NO: 95558 - DNA, 1091 bp, Zea mays
  misc_feature: Ceres CLONE 1585826
  misc_feature: Encodes the peptide sequence at SEQ ID NO. 95559
  misc_feature (1091)..(1091): n is a, c, t, g, unknown, or other
ctggagctccccgcggtggcggccgctctagaactagtggatcccccgggctgcaggaattcgtctcacccctagaaaaagatggccgccaccgcagcggatgagatggagaggatggtggaggcggagtgggaggacgcttctgctttccccccggaccccgacgagttctcaccctcgagagtaactgaccgacctaccggcatgtagatgaagctgaccatccggagggtgcccaccgtcgtctccgactaccaggaggacaccgacaagcctcgcgctggctgccggaagaactgcctcggaaactggtgtctgcctgctttccagcttcccctctacgcgttcaatttgattcccgcaaagggctccgatgaggaatgctgctttttacaaacccccccgggggaaatcctccctttattgattggggaacgacaagattgactccggggcctttatttccggttcaaattttcacctgcccccgtggaaaacccataggttttttttccttagccaaaccctttgggggtttttgtttgcctcccaccctccccaattcaaaaggggccgcccccccctttctaaaaaagaagccccccccctccgctccgaccattttgtcgcctctgtgggcaacacccgtttttttgttcctctcccagaggccccgttttttttttagccccccccgtgccccacataaatgttttcaacaaatttttttcacaactaaataagttttgtgtcgcccactgggtgaataaagagagtgtcttctctcttgtcgcacactttcttttaagaaaaataaaattggtgttggggggagatatataacacaatccttatattttcctccgtgagaaaacaaccgcctccccacactccctatttgttggtattgtaatcccggcgcgttccaaaaagtctgtatttgcggctttcctctggcacatacatcccacttttgagaatatcgggaatttcgtggcgtttttccttttttctcacacgttttcccggaaccaaccttgcttttaaagtgttatttattcccagcgtgtttttctttcctgagaggagcn

SEQ ID NO: 95559 - protein, 42 aa, Zea mays
  misc_feature: Ceres CLONE 1585826
MAATAADEMERMVEAEWEDASAFPPDPDEFSPSRVTDRPTGM

SEQ ID NO: 95560 - DNA, 2722 bp, Zea mays
  misc_feature: Ceres CLONE 1585827
  misc_feature: Encodes the peptide sequence at SEQ ID NO. 95561
cttcttgggccgagccctaattcttctgccccgccaccaagcaagccgagcccccggtttggttcgcctccgctgcgccccgcttcctccccggattcttggattctattggcttctatcttcagcatgggtgagccaaacagcaatgataatgcaatggtgcatgacaatgagatgatcgatggcaatggggtgatccatggtagcgagatgattcatggtagtgtgatgatacatggagatgagatgccccatggcaatgagatgatccatggaaatgagatgatccatgggactgagatggttgaaggcagtgagatgatccatggtcatgagatggttcaggttaatgatctcatccacggtaatgagatggttgccgttaacgtcatggttaatggtgatgagatgccccatgttaatgaattcatcaatactgaggtgaccccgcggagacgtcggaagaagaagtcgcttgtttgggagcacttcactatagaacccatgccaggggggaactcaagagcatgttgcaatttatgcaagcaaacctttgcgtatagttctggctcaaaaatcgcaggcacgagccatctgaagagacacatcacgctaggctcctgtcctgttatgaaagatcaagaccgcaggctaacactgccactagcagggggccatgccactgataatgatggtgagggtacagtagagcgtcctactaagaggcgttacagatacactggttatgcaaatgctacttttgatcaggaacggagctcctcttatttggcgaagatgataattttgcatgactacccacttcacattgttcagcagtcatcctttacgaagtttatcgagagtctgcagcctcgtttcagggttgtagatgtggatacaatggaaggagaggtgtatgctgttttccagaaagcaaaagaaaacctgttacaagcattcatcactatgccaggaaggatcagcctcactataggactctggacaaccagtcagactcttggctatgtttctcttgctgggcagtttattgactccaattggaaagtgcaccgaagaatgctcaacttcatgatggtgtcttctcctcattcagagaatgcacttagtgaagctattagctcgagccttttggagtggaatatgaaggacaggctattcactatcacattggataatgattgctcttcccatgatatttacagtgcaaatcttagggatcacctgtccaataagaacaacctcatgcttaagggacagctgtttgttgtgaggtgttatgcacatatcctcaatgtagttgctcaggatgtaattgcttcaattcatggtgtgatttacaacatccgtgagagtatcaagttcataaaagcttctccaaatcgtgaggagaagtttgctgagattgctctgcagctggagattcccagtaccaagactctctgtttagatgttacaacccagtggaacacaacttatttgatgctgctggctgccttggactataaacaggcgttttctacactggagatatgtgatgataattacaatgaatctccttcagcagaggactggaagaaagttgaggctacctgtaattacctgaaactgctatatgactctgcacatagtgtcatggcttcagcaaatcctactgcaaacatctttttccatgaagcttggaaaattcagcttgagctagccaatggcacagaacatgaaaatcccatcttcagcagtattgccaaggatatgcatgagagatttgacaaatactggaaagattgcagcctggtattagccattgctgttgtcatggatccacgtttcaagatgaagcttgttgagttcagttactctaaaatttatggtgctgaggctatgaaatatgttaaggttgtcaatgactctctgcatgagctgtataaggagtatgtggcacaaccactccccttgactcctgcttatgttgaagctaataatgtggctgctaacgcaagtgtgaaccagggaaatccttcttccactggtgatggtcttcttgactttgatatgtacctttctgagattcaaagtacccagcctgcaaaatgtgatctggagcagtacttggaggaatccctcactccacgtatccaagagtttgatatccttaattggtggaagcttaacacactcaagtttccaaccctgtcgaagatggcccgggatatcttggccatcccaatgtctatggttagcagtggcagctccatattctctgctggaactgggaaccgcatgctcgatgactacagaagctctcttcgtccggagactgtggaggcacttgtctgtgcaaaagactggctccagtattcaccgcctgcaactgaggtgctaggttctgagatgatcaaggcagaaacattgtagcttgccgatactgcttccatgatgaagcacaaataagattgtgttattttttagtgtagttaaccgtaggcatattttaggcagcaattgcagacatatatctcttctggcatcaatcttatagttgtaatttgtcatgtcgaactcagtttaactcatagtgtgtattgagtttagctgtggtctgagggatgtctaagggattgaggtggtaaacttatttccagattctggctattgttggctcaggcattcaggtgatacacttattcaaaaaaaaaaaaaaaaa

SEQ ID NO: 95561 - protein, 768 aa, Zea mays
  misc_feature: Ceres CLONE 1585827
  misc_feature (663)..(748): Pfam Name: hATC Pfam Description: hAT family dimerisation domain
  misc_feature (116)..(167): Pfam Name: zf-BED Pfam Description: BED zinc finger
MGEPNSNDNAMVHDNEMIDGNGVIHGSEMIHGSVMIHGDEMPHGNEMIHGNEMIHGTEMVEGSEMIHGHEMVQVNDLIHGNEMVAVNVMVNGDEMPHVNEFINTEVTPRRRRKKKSLVWEHFTIEPMPGGNSRACCNLCKQTFAYSSGSKIAGTSHLKRHITLGSCPVMKDQDRRLTLPLAGGHATDNDGEGTVERPTKRRYRYTGYANATFDQERSSSYLAKMIILHDYPLHIVQQSSFTKFIESLQPRFRVVDVDTMEGEVYAVFQKAKENLLQAFITMPGRISLTIGLWTTSQTLGYVSLAGQFIDSNWKVHRRMLNFMMVSSPHSENALSEAISSSLLEWNMKDRLFTITLDNDCSSHDIYSANLRDHLSNKNNLMLKGQLFVVRCYAHILNVVAQDVIASIHGVIYNIRESIKFIKASPNREEKFAEIALQLEIPSTKTLCLDVTTQWNTTYLMLLAALDYKQAFSTLEICDDNYNESPSAEDWKKVEATCNYLKLLYDSAHSVMASANPTANIFFHEAWKIQLELANGTEHENPIFSSIAKDMHERFDKYWKDCSLVLAIAVVMDPRFKMKLVEFSYSKIYGAEAMKYVKVVNDSLHELYKEYVAQPLPLTPAYVEANNVAANASVNQGNPSSTGDGLLDFDMYLSEIQSTQPAKCDLEQYLEESLTPRIQEFDILNWWKLNTLKFPTLSKMARDILAIPMSMVSSGSSIFSAGTGNRMLDDYRSSLRPETVEALVCAKDWLQYSPPATEVLGSEMIKAETL

SEQ ID NO: 95562 - DNA, 838 bp, Zea mays
  misc_feature: Ceres CLONE 1585828
  misc_feature: Encodes the peptide sequence at SEQ ID NO. 95563
ctccccgcggtggcggccgctctagaactagtggatcccccgggctgcaggaattcgtctcacccctagaaaaactgcgcagtactacgagctagcaggctagcagcaccaggaccaggagcctcttcccacacttccgctctccctctctctctttcctctcgagaatggttgtgtaggcgggcgcaggagggaggagagagaggggagctagctagggttttgcgtcgccgccttctgttacccttaggctctgaacccctccggtccagtgcggcggcggattaggctccgatggggaagtctccggcgaagtggatcaagtccgtgctcttcggtaaaaagtcgtcgtcgaggtccggctccaccaaggccaaggatttatcgaagggtaccactaacaaagcggcggctgctgctgctgccgggaaggagcctgcgttctctgagagctctccggtcatctcggagcctgtgcttgttagcgcccacaacaatgagaccgcgcgggaggccgctaagggtgagaattcagcgtgcaagaagtgccagtgactgatgttagtcaagacttggagaagcaggccactgttgggtctgatacgtctaatgatgctgagaggtttgagggaagagcaagcggccgtgaaggcacagcctgccttcctgggtatcctgcacgccgagcattccgtgcccttgaaaggatccatagactaccggccctgattcggggaacatcctgtaaggaggcaagctgtttcaaatctccgggctaccagggttggatggtgaattttcaggcccttaggccgtggaaggaaacgtaagactttca

SEQ ID NO: 95563 - protein, 86 aa, Zea mays
  misc_feature: Ceres CLONE 1585828
MGKSPAKWIKSVLFGKKSSSRSGSTKAKDLSKGTTNKAAAAAAAGKEPAFSESSPVISEPVLVSAHNNETAREAAKGENSACKKCQ

SEQ ID NO: 95564 - DNA, 797 bp, Zea mays
  misc_feature: Ceres CLONE 1585829
  misc_feature: Translation starting site: 162
ctccccgcggtggcggccgctctagaactagtggatcccccgggctgcaggaattcgtctcacccctagaaaaactccttcttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgagcgcctccgcctgtcctcgcgctcaccgcgcgtctggcccgacctcgcgttcaactggcgggtggtggtcgccacccccgtcgggttcctcggttccgcgtttggcaccatcggcggcgtcggcggaggcgggatcttcgtgcccatgctcaacctcgtcgtcggcttcgacacaaatccgccgccgcgctctccaaatgcatgatcatgggggcctcggcgtcatcagtttggtacaacctccaggtgtcgcaccgaaccaaggaggcgcccgtcatcgactacaagctcgcgttgctcttccgccccatgcttatgctcggcataaccatcggcgttgaggtcagcgtcatcttcccatactggccaatccctggccccccattataatccctctttggaagggaaccccgggcgaaaaccctttctaccaaggggaatttctttattttgggaggggaaggaagtcccgggg

SEQ ID NO: 95565 - DNA, 808 bp, Zea mays
  misc_feature: Ceres CLONE 1585830
  misc_feature: Encodes the peptide sequence at SEQ ID NO. 95566
  misc_feature (514)..(514): n is a, c, t, g, unknown, or other
tccccgcggtggcggccgctctagaactagtggatcccccgggctgcaggaattcgtctcacccctagaaaaaaaaaacagcaaatttctccggggtgactggttgattcgaatgcagccgtgccgagtccgccgcctccgcctccgccgccgccgccgccgtgaacgagagtgatgcgcctcgcgtcctatgcctttctacgccgcgccgccgccatgtcctccccctcctcctacagccgcacaggctacccccgccctcgccgcggctactcgggaaggccctcgccgccgccgccgccgccgcccccggacgcggcctccgagatcgtcagcagggattaccatctcagtgccgtgcacgccgccaacgaatccctgcgtcgtggcggcggcggcgacatccgctggcctccaccgccatacaggcaggggcctcaccctcaccaaccgcactatggctatggctatggctacggatacggatacggccaaacgtggcagccgggtccantcctatgggtttgtgccgtacaactacggccacccgcagcagcagccgccggggcctcagtacggctacggggctccgaacccgtacgttcacgggcacctgcagccgcagccgcatgtgcgtggggcagctagtcccagggtccgtccctggcgcgccccagctgaactcgaggcctgcagattacctcggacggtgggggcttgcaaagcagaggcggcccatcaaggctggggaggtttattatctatcatacaataaacttgcgggactatctggccaggagcaccgcta

SEQ ID NO: 95566 - protein, 157 aa, Zea mays
  misc_feature: Ceres CLONE 1585830
  misc_feature (114)..(114): Xaa is any aa, unknown, or other
MRLASYAFLRRAAAMSSPSSYSRTGYPRPRRGYSGRPSPPPPPPPPDAASEIVSRDYHLSAVHAANESLRRGGGGDIRWPPPPYRQGPHPHQPHYGYGYGYGYGYGQTWQPGPXLWVCAVQLRPPAAAAAGASVRLRGSEPVRSRAPAAAAACAWGS

SEQ ID NO: 95567 - DNA, 848 bp, Zea mays
  misc_feature: Ceres CLONE 1585832
  misc_feature: Encodes the peptide sequence at SEQ ID NO. 95568
  misc_feature (398)..(398): n is a, c, t, g, unknown, or other
  misc_feature (400)..(400): n is a, c, t, g, unknown, or other
ctccccgcggtggcggccgctctagaactagtggatcccccgggctgcaggaattcgtctcacccctagaaaaacccacccgcttcggcctctccctcctcctcgctcgctcgatcgctcccacgtcctcgcctccctccacaaaccaccaccaccatccaggatcgcagcgcggcgcgcgagagaggggtgagcaggtcgggcaagatgagggagatcctgcacatccagggcggccagtgcggcaaccagatcggcgccaagttctgggaggtgatctgcggcgagcactgcgtcgactccacgggccgctactcggggacctcctcgcagcagctcgagctcgagcggatcaacgtctactacaacgaggctgggggtggccgctatgtgccccncnccgtgctcatggacctggagcccggcaccatggaatccatccgcgccggccccttcggcggcatcttccgccccgacaactttgtctacggccagtccggcgccgggaacaactgggccaagggccactacaccgagggcgccgagctcatcgactccgtccttgacgtcgtgcgcaaggaggccgagaactgcgactgcctccaaggggttccaagtatgccactccctgggtgggcggcactgggtctggcatggggcaacgctgctcatttccaagatccgggaaggaggaccccggacgccatgatgcttcaccttctccgtgttccccgtcggcccaaggtggcccgaaaacggtcggggaagcccttaacacgccacggcggtccgtggcaccaacctcgggggaaaaacgcccaacaaatggcaggggcccttgaaaaaca

SEQ ID NO: 95568 - protein, 213 aa, Zea mays
  misc_feature: Ceres CLONE 1585832
  misc_feature (47)..(176): Pfam Name: Tubulin Pfam Description: Tubulin/FtsZ family, GTPase domain
  misc_feature (64)..(64): Xaa is any aa, unknown, or other
  misc_feature (65)..(65): Xaa is any aa, unknown, or other
MREILHIQGGQCGNQIGAKFWEVICGEHCVDSTGRYSGTSSQQLELERINVYYNEAGGGRYVPXXVLMDLEPGTMESIRAGPFGGIFRPDNFVYGQSGAGNNWAKGHYTEGAELIDSVLDVVRKEAENCDCLQGVPSMPLPGWAALGLAWGNAAHFQDPGRRTPDAMMLHLLRVPRRPKVARKRSGKPLTRHGGPWHQPRGKNAQQMAGALEK

SEQ ID NO: 95569 - DNA, 1204 bp, Zea mays
  misc_feature: Ceres CLONE 1585834
  misc_feature: Encodes the peptide sequence at SEQ ID NO. 95570
  misc_feature (1)..(1): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (38)..(38): n is a, c, t, g, unknown, or other
  misc_feature (55)..(55): n is a, c, t, g, unknown, or other
  misc_feature (56)..(56): n is a, c, t, g, unknown, or other
nggggggggggtggggtnnnccccccccccatctcccnccccaacagaggtcagnnggaaaggtagatttaaaaaaaaaaaactccccgcggtggcggccgctctagaactagtggatcccccgggctgcaggaattcgtctcacccctagaaaaattttgtcgcctcttcgggctctctcgctcagctcgatcttcattaagctcacgtcgttcctcccttcttcctcttcttcttcttatccgttgtccaattacttcagctagctggccagagatcgagtataatcatcatcatcgatcaattccgctcagatctttcgtcttctcctattctctgtcgtcttcttccccgaattagatcgaagccgctcgctgtgtgaccggtctctaccttgcttgatccagctcggagacataataatataatacaatgctacgatcgatggctattgcggttgttattcgtgaggaattaatggtggccacacccccccaaaacaaatatctgggagctacgattccacagaaacacgccccggcccggaatccttgccatgaactcgtcagaacccttgccacggtcctaaaaaacccgtcgggcagcaaacggaagaaagcacacatctggacgcggggacgccagtacggccttttaccgtggagcaacatcaccaattttgtgggcactacccccaaaagcatcttggacggacttggtccgtctgcctccattgttgtgtgctaaccgaacaagacccgatctctttttagagatcgacagattactagcccttctagtaacactatagtgaaaccggtggcaccccttgtcctcttctaaaagcttacttataaaggtgtgaaatatattacctgacagcccgcgagaattatttcaaagaaaagttcacgaccacccccaacctgggaagacctaccctttcggatccatgagaggattgtattatgtagtatatgagactgatacctgtcatggagatgtgataaccccgcagaatagcgaagagttgatagtctcactatatttatctgacttcgtactctaactctaaacaaaagatcaacatccgcgggcgtgttatcacttcattacactcaattgtgaatgtgtgcttctcctcatttcgactccagagcgatcggggtaagtagatgtgctcttgcttgatgatcacacccac

SEQ ID NO: 95570 - protein, 100 aa, Zea mays
  misc_feature: Ceres CLONE 1585834
MAIAVVIREELMVATPPQNKYLGATIPQKHAPARNPCHELVRTLATVLKNPSGSKRKKAHIWTRGRQYGLLPWSNITNFVGTTPKSILDGLGPSASIVVC

SEQ ID NO: 95571 - DNA, 787 bp, Zea mays
  misc_feature: Ceres CLONE 1585835
  misc_feature: Encodes the peptide sequence at SEQ ID NO. 95572
  misc_feature (721)..(721): n is a, c, t, g, unknown, or other
  misc_feature (736)..(736): n is a, c, t, g, unknown, or other
ctccccgcggtggcggccgctctagaactagtggatcccccgggctgcaggaattcgtctcacccctagaacatcgtataaggaaccctaacgctgagataacgctggtgtgcaagcaactgcaaactgtgcacaggataatcatgacaggtgcacctattcaaaataaactttctgagctctggtctcttttcgattttgtgttcccagggaaactaggtgtgctgcctgtatttgagactgaattttctgtgccaattactgttggtggttatgctaatgcgacaccattgcaagtgtcaacagcatacagatgcgctgttgttcttcgtgatcttatcatgccatatcttcttagacggatgaaagttgatgtcaatgcacagctccccaagaaaacagagcatgttcttttttgtagtctaactgcagggcagcgttctacttatcgtgcttttcttgctagttcagaggtggaacaaatatttgatggcaatagaaattcactgtatggtatagatgtcctaaggaaaatatgcaatcatcctgatctactcgagagagaacatgctgctcagaatcctgactatgggaatcctgaaagaagtggaaagatgaaagtagttgagcaagttctcaaagtctggaaggacaaggtcaccgagttcttctgttcactcaaactcaacagatgcttgacattttagagaacttcctgacngcctgtgactaccantaccgaagaatggatggactaacacctgcaaaacaaaggatgggcactata

SEQ ID NO: 95572 - protein, 234 aa, Zea mays
  misc_feature: Ceres CLONE 1585835
  misc_feature (1)..(185): Pfam Name: SNF2_N Pfam Description: SNF2 family N-terminal domain
PRGGGRSRTSGSPGLQEFVSPLEHRIRNPNAEITLVCKQLQTVHRIIMTGAPIQNKLSELWSLFDFVFPGKLGVLPVFETEFSVPITVGGYANATPLQVSTAYRCAVVLRDLIMPYLLRRMKVDVNAQLPKKTEHVLFCSLTAGQRSTYRAFLASSEVEQIFDGNRNSLYGIDVLRKICNHPDLLEREHAAQNPDYGNPERSGKMKVVEQVLKVWKDKVTEFFCSLKLNRCLTF

SEQ ID NO: 95573 - DNA, 975 bp, Zea mays
  misc_feature: Ceres CLONE 1585837
  misc_feature: Encodes the peptide sequence at SEQ ID NO. 95574
  misc_feature (877)..(877): n is a, c, t, g, unknown, or other
gcggtggcggccgctctagaactagtggatcccccgggctgcaggaattcgtctcacccctagaaaaaatccaccgaaccaaaccaacacacgtgaaagcagaaaacctcagaaaaccccaatatatcctcgtccaccactgcccccgctctgctgcaactccactcggcccggccgccctttccacccaacttgatcctccgatccgttggtgcttgaccgatccatggacacccacatcggatccgtgaacggggcggcgtctaaccagacggttggctgcccggcgtcggcgccagagtgcccgatggcgtccacgccggcgcagcccggggcgaccctgtcggccggggaggcgtccctagggcgccacctcgggcagggccaggtgcaccccggcttcaacgaacgcttcgcgggtcccgggggacttcaatcgacaggcttgctcgagcaccctgatcggccgagcaccggcccggggaactcgttcagactggcttgcaacaaagcttcaacccccggggtaacgcccgccctaccggggtatctcgaccagcgcccagccggggggtcgggggttccgtggggccactattaacttttgaaaaaatccggggggggggcccaatgtcgtggccccaaaccgcccatataagccggtgggggtcctaccacatggggagaaacacttgggcccacggtctatgtacacccattactccccggggagaggccacaaaaatctcccaaagagaagtaacggggaaaaacaaaaacgggaattccctccccacataaaacacaaattgtggggttcccccgcgaacatttctacgccgaggaagtctccccctttgctttcccagaaaacccnttcccctggttcattttgggcggggaggggggggaaaaacaactgagaagagagagccgacccaagatttaatatctccctcggcggattttccgaga

SEQ ID NO: 95574 - protein, 124 aa, Zea mays
  misc_feature: Ceres CLONE 1585837
  misc_feature: SWISSPROT Homolog: EC 4.1.1.1 Pyruvate decarboxylase
MDTHIGSVNGAASNQTVGCPASAPECPMASTPAQPGATLSAGEASLGRHLGQGQVHPGFNERFAGPGGLQSTGLLEHPDRPSTGPGNSFRLACNKASTPGVTPALPGYLDQRPAGGSGVPWGHY

SEQ ID NO: 95575 - DNA, 856 bp, Zea mays
  misc_feature: Ceres CLONE 1585844
  misc_feature: Translation starting site: 444
  misc_feature (377)..(377): n is a, c, t, g, unknown, or other
ctccccgcggtggcggccgctctagaactagtggatcccccgggctgcaggaattcgtctcacccctagaaaaaaccgcagtggtcaaacgtgggaaattgaagcggaggaagatagagagaaaaagaggagacgagagagggagagagtgctgcaggtggaggaggcgctggcggcggtgctgtccgcggcggcgggccacgcggaaccgcacgccgtgccgctgcagggcgcgctcgggctcgtcctcgcggaggacgtctgcgcgcccgatccgctccctcccttccgcgcctccatcaaggacggatacgccgtcgtggcctccgatgggccaggggagtatcctgtggtcacggagtcgagggcgggcgacnacgccctcggagtggttgtcctccccggcacggtcgcctacgtcaccaccggatggccggttcccgatggcgccgatgccgtcgtgcaggtggaggacaccgagcagctccctggcggagcggatgggtcccagagggttaggattcttgcgcgggccctcccaagacaggacatcccgcgtgtgggatgtgacctagagaaggattccattgggctcaagtctggtgagcatataggtcctgccgaaattggggcttcttgccaccggggggggtaacccctgtcaagggggaccccccgcccacaattcgctgttttctccccaaggggatgagcttaggggagccagccccttgccccccctcggccgggggtcaaattcggggtttcccatccgggccctgggttctaggcttggggccttttcccccaaaaatggccaacggggtggaaccccgggttttggccaaaagaaacc

SEQ ID NO: 95576 - DNA, 951 bp, Zea mays
  misc_feature: Ceres CLONE 1585845
  misc_feature: Encodes the peptide sequence at SEQ ID NO. 95577
  misc_feature (215)..(215): n is a, c, t, g, unknown, or other
ctccccgcggtggcggccgctctagaactagtggatcccccgggctgcaggaattcgtctcacccctagaaaaagggaccgacgggcgagagagcggaagcgacgactagctctgcggcctctgccccaagcgccgacgatgggtgccggtgctactgccagggacgaggaggctgctaccggccaccaccatggggaggagccgcatggcgcancggcggagtacgcgcaggacgggtccgtggacctgcgcggcaaccccgtgctccgctcccagcgcggcggctggacgcctgctccttcatcgtcgtgtacgagctgttcgagcggaggccttactacgggattctcgtcaaccttctcatttacctgacggaaaagctccccccccgcacccctcgaaggcctccaacaacgtcacccaaatgggtccggggaaccttctttcctcacccccgttggctcgggggccctaattttgcccaaaacccttccttcgggccggttactggggaccctttcttcgttcggggtccccccccatttaccctgcctggggggattggggggcccgcctggggggccttttccccttctccccggggccccgggcgcctttaaaaaccccccccccctctggcgggggggccccggggggggggggggtggcccccccacaggggggtttcgggcccttccaaaatttttggggggggtttatctttccggggggggggcctcctccctgtggggggggccccctgggggaaaaagggggggggcacacaaaagccccaaaatattttccccacccatttgggggggcgggaacaaaattttcccaccaaaatttgtacaccccccgcgggggagaggggggcgcccaaaaaagctgggtcctcttcttttccaaaggggggggggagaggtgttccccccactcttctcctg

SEQ ID NO: 95577 - protein, 77 aa, Zea mays
  misc_feature: Ceres CLONE 1585845
  misc_feature (26)..(26): Xaa is any aa, unknown, or other
MGAGATARDEEAATGHHHGEEPHGAXAEYAQDGSVDLRGNPVLRSQRGGWTPAPSSSCTSCSSGGLTTGFSSTFSFT

SEQ ID NO: 95578 - DNA, 892 bp, Zea mays
  misc_feature: Ceres CLONE 1585846
  misc_feature (365)..(365): n is a, c, t, g, unknown, or other
  misc_feature (424)..(424): n is a, c, t, g, unknown, or other
  misc_feature (451)..(451): n is a, c, t, g, unknown, or other
  misc_feature (496)..(496): n is a, c, t, g, unknown, or other
  misc_feature (535)..(535): n is a, c, t, g, unknown, or other
  misc_feature (595)..(595): n is a, c, t, g, unknown, or other
  misc_feature (596)..(596): n is a, c, t, g, unknown, or other
  misc_feature (641)..(641): n is a, c, t, g, unknown, or other
  misc_feature (664)..(664): n is a, c, t, g, unknown, or other
  misc_feature (680)..(680): n is a, c, t, g, unknown, or other
  misc_feature (683)..(683): n is a, c, t, g, unknown, or other
  misc_feature (698)..(698): n is a, c, t, g, unknown, or other
  misc_feature (700)..(700): n is a, c, t, g, unknown, or other
  misc_feature (713)..(713): n is a, c, t, g, unknown, or other
atggcggccgctctagaactagtggatcccccgggctgcaggaattcgtctcacccctagaaaaagtgtgacctccctcctgtcctgctggcgccctcgctttgcttccaatgggacggaaagggcgtaaacggtttgtgtttggcgtaaacggcgacgtggaaagctcgcccgtatactacagtagcagaataacgcaatgcgatggaatccatctactctcaccaatgcccaatcacatctcgacttgatgctgccaccttttcctaatccagctgctccagcctagctcacgtcgcttcccacagacgccaccagccaacgcgccatcgtctcagtggaaaagaaggaaggcgggctgccgncaaggggttaggtgctcccaacagcccgcgggatgaggggtttgcgatttgagaaaagncaagtccccccaaccccccgcgggagntttacgttaagccctccaaggaggacgggcggggagaccgtgcgncggttcgcagagggtccctgaaagcggaaaggcgcccgnctccggtcgccgggacccggtccccccaacataggtcccggggggaaagaagaggccgcnngcagaaagggtttaatccgcgagggtaaaagggaatccggaggcnggcggccagccccacgtttcccngggaaaaaaaggaggngtncttaagagaatctgncncgggggcgtcgcnagaagaggctttttaacgccaagggggagcctttcccgggagaaacgggggcgccaacgaggccttttctttttttagcaaaaccccttcgtatccgggagaaaggcgcccccccccctaatagggtgggccctcccatttttaaggggctttcccccaagggcgctcccaaggaaaaa

SEQ ID NO: 95579 - DNA, 1229 bp, Zea mays
  misc_feature: Ceres CLONE 1585849
  misc_feature (54)..(54): n is a, c, t, g, unknown, or other
  misc_feature (56)..(56): n is a, c, t, g, unknown, or other
  misc_feature (65)..(65): n is a, c, t, g, unknown, or other
  misc_feature (66)..(66): n is a, c, t, g, unknown, or other
  misc_feature (68)..(68): n is a, c, t, g, unknown, or other
  misc_feature (69)..(69): n is a, c, t, g, unknown, or other
  misc_feature (1149)..(1149): n is a, c, t, g, unknown, or other
gaggggggttttttttatttattaatgagaaacaggaaaaaaaatatattttantnaaacccccnncnncaaaactggaactccccgcggtggcggccgctctagaactagtggatcccccgggctgcaggaattcgtctcacccctagaaaaaacctgacgactctctttcccaaagagcgtcctttcccatcacctcacttgttgtctagcacatctacccgcatatctcggttctcgcgactccgaaacggcaaattgcccaaagattaggagatgtcattccggaattgggattgaaggcaagggcggcctcgcctccggctgtctccatcggaaggagctcgtgcttccgagctggatggggagacgggagcgacttctcttgtctatcaaaaagggggcgctgagcctcagtattccgccaccacctgagtgggccccatgacgggggaggccttattggcttggaacgaatcgcaccccccgagctcgaggagttcgctctcgatttgccttccactgcggatgaccttccgaaactggcccccaaggctaagaacccggggggcagcccaattccaggaggttggaagttcgatgtcgccccagggggactatggaacccaaggaacgggcgctcaaaacggcggctgggcaaaaaaaaagtgttcaacatgggaacccgatacagagtcagaggacggtccgggaggtagcctctcgaagcagaaatgtgggtgttgccctacacagcgggggcggcgaggggggaaaaataaccacgtgacccgagggaaaaaatgctgggatacatcatccatgtaagagaggggtggggagatgagtgcccaaatcccctatatttcgcgaagagcccgacaactgatcctcatatattgtgtgttgtaacagcatgagccattatatccccaagcgggagagcaccccaataggggagaatcacgaatataaaaaatttgtccctcggagagacacggacagaaggtggcgccgcgaccaacagttgtggggactcaatataatatttcagatggggtgcttccctttccggagggatgaaatagaaagggataattcatacctctctataacaccagataatgaacgcgagcgctgtgactaggntacgttacacacatgtgtagagaacactaaagattctatgccgctcgggctcccccgtctccacgaggaagggggggggg

SEQ ID NO: 95580 - DNA, 886 bp, Zea mays
  misc_feature: Ceres CLONE 1585852
  misc_feature: Encodes the peptide sequence at SEQ ID NO. 95581
ctccccgcggtggcggccgctctagaactagtggatcccccgggctgcaggaattcgtctcacccctagaaaaatcccccgcggaaggacgacgacgcaactggcagtcaccgacgcgacgcgggtcgtctcctcagccctcctgttcagcctcctcgccagcgatggcttcgggcgccgacgccgcggcgctggtgacctccggcgccgacgagtgggcagcggcgtgtccgccgctgcggcggaacctgcagctgctcgcgcctgacgaggttgagctagcaaaaatgctgttgaatgagggccagattcacctatttgaacactggcctgaaccaggcattgatgacgacaagaaaagaggcttgtttgatcaggttcgccgggcttaattcaagccaccctggaggtctggtatcttacatcaagaatgccaaaaaacttctttgcaaattcaaaggcaggaaaaaaacccatatgatgggttttcaccccttctgtggctttcagggggaaattttggaacttccggcgaatgaccattttggtttccctgggaagccgctggggattaaaagaagcccaccaatggctggcttttgttcctttgaacccgggaggggcttggtgaaagggcttggtttacaaagggatttaaggggagccccttccccccgggaaaaaacaaccgggaaaaagtgttccttcccacattaatataggagcccatcccgggtttttacaaaaaggccaccctcgcaaaacggtttgattgagggggggccaaaaaaaaaattccctttggggcattatgaacctcgggagggaaaacaagggccctaactttttaggcttttgggaagcaaaacctcttcttggggaaggg

SEQ ID NO: 95581 - protein, 75 aa, Zea mays
  misc_feature: Ceres CLONE 1585852
  misc_feature: SWISSPROT Homolog: EC 2.7.7.64 UTP-monosaccharide-1-phosphate uridylyltransferase
MASGADAAALVTSGADEWAAACPPLRRNLQLLAPDEVELAKMLLNEGQIHLFEHWPEPGIDDDKKRGLFDQVRRA

SEQ ID NO: 95582 - DNA, 855 bp, Zea mays
  misc_feature: Ceres CLONE 1585854
  misc_feature: Translation starting site: 194
ctccccgcggtggcggccgctctagaactagtggatcccccgggctgcaggaattcgtctcacccctagaaaaaacgcctcccaacctcctctgctctcccccacctcccggtccggcagcagagagcgggggtgcagagagatcgagatccggaggccgcgagtgggagcgccaccaccagcgactgcggcaatggcgggcacggtgacggtcccggggtcgtcgaccccctccacgccgctgctcaaggacgagctcgacatcgtgatcccgacgatccgcaacctcgacttcctggagatgtggcggcccttcttccagccctaccacctcatcatcgtgcaggacggcgacccgaccaagaccatcaaggtgcccgagggcttcgactacgagctctacaaccgcaacgacatcaaccgcatcctcgggcccaaggcctcctgcatctccttcaaggactccgcctgccgctgcttcggctacatggtctccaagaagaatacatctacaccatcgacgacgactgcttcgtttgcaaggacccatctggcaaggatatcaatgctcttgagcagcacatcaagaacctcctcagcccatccaccccgttcttcttcaacaccctgtacgaacccctaccgtgagggtgctgacttttgtgcggggataccccttcagcccccagggagggtggtcacacccgccgtcctcacacggcccttgtggcttgaaacttcccttgactttttgatggccccccaacacagctggggctaaggccccaagggagagggaaatggagagggttttgtttggaatgccttttcatttaaacaattcccccaaaggga

SEQ ID NO: 95583 - DNA, 980 bp, Zea mays
  misc_feature: Ceres CLONE 1585855
  misc_feature: Encodes the peptide sequence at SEQ ID NO. 95584
  misc_feature (913)..(913): n is a, c, t, g, unknown, or other
ctccccgcggtggcggccgctctagaactagtggatcccccgggctgcaggaattcgtctcacccctagaaaaaaggcggacgcgaacaaacccccttattccatagcgagcgcgagcagcggcgccgggaggacgaggactgctgcgatggggggagacgccagcaccatcgagggggggccgctcccgcatctcggcggccggccggcctcccgcgtgcccgacaccccgctggtgcgcacggcgggggacgccgcgcgcatggtctgggacgagtccaagcgcctctggggcatcgggctgcccatcgccgtgggcatgctgagcatgtacgccatcagctccatcacccagatattcatcgggccacctcggcaacctcccgctggccgcccccaccaccggccctctccgtggttcgccacctttcgcgctcgggcttcctccctgggaatggggcaggcgcgcttcgagaccgctctggcgggcaggggcttccggcgccccggggagggtcgccatggctccggcgttctacctggcagcgggtccttgggaatgatccctcgtccgcccgccttggcgttcttcattgaaccccccgttctttcgggtcttctgcccaaattcgcctgggctcccttggttcaatcggggccaaggaacgcccccaaccgtccccctcgggggaggtccccccccaggggttccgccagcctttaaattgtttgccccctcccattcctacgcccattgggggcatttaaaactttgccgccggcccaggcaaaggtttcccctcccagggctcgcctaaagcataggtgcccacattttcccccgccctggggaattccggcgctctcagagggggctctcccctccggcccggggggcccctccccgcaaaanaacccagtgtttcagactaacgaggtgtcccagggactgggggaggcctccccccggggacgcccct

SEQ ID NO: 95584 - protein, 191 aa, Zea mays
  misc_feature: Ceres CLONE 1585855
MGGDASTIEGGPLPHLGGRPASRVPDTPLVRTAGDAARMVWDESKRLWGIGLPIAVGMLSMYAISSITQIFIGPPRQPPAGRPHHRPSPWFATFRARASSLGMGQARFETALAGRGFRRPGEGRHGSGVLPGSGSLGMIPRPPALAFFIEPPVLSGLLPKFAWAPLVQSGPRNAPNRPPRGRSPPRGSASL

SEQ ID NO: 95585 - DNA, 846 bp, Zea mays
  misc_feature: Ceres CLONE 1585858
  misc_feature: Encodes the peptide sequence at SEQ ID NO. 95586
  misc_feature (743)..(743): n is a, c, t, g, unknown, or other
ctccccgcggtggcggccgctctagaactagtggatcccccgggctgcaggaattcgtctcacccctagaaaaaatcgacctcgatccattgaataattttactaatcaaattcttgttgggatatattcctccaattcccctcctcctcccaacaaggcaacaacaatctgttccggccgccaaacaaaacccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagcgcggccgacctggcctccgggggcaggaagtcgtccggcgtgccggtgttcgtcatgatgcccgctgacacccgtcaggagtgcggcaccgcgctgcaccgccgcaaagcggtgcaagccagcctctcggcgctcaagagcgcgggcgtcgagggcgtcatggtggaaacgtgtggtggggcatcgccgaaacgcgacggcccggggccgggtacacttccccgggctacncggaacttcatgggaaaatggcgcgcaaaggccgggctcaaggtccaaggcccgtcatgttccctccaccagtggcgggcagacaacgtcgggcgaattcgtt

SEQ ID NO: 95586 - protein, 180 aa, Zea mays
  misc_feature: Ceres CLONE 1585858
  misc_feature: SWISSPROT Homolog: EC 3.2.1.2 Beta-amylase
MACNLAQCATAAAATVAPRTPRPAASASVSFSARKPAGGSLRLQRQACCEPSVAPSRAVFACRAAASGSAADLASGGRKSSGVPVFVMMPADTRQECGTALHRRKAVQASLSALKSAGVEGVMVETCGGASPKRDGPGPGTLPRATRNFMGKWRAKAGLKVQGPSCSLHQWRADNVGRIR

SEQ ID NO: 95587 - DNA, 893 bp, Zea mays
  misc_feature: Ceres CLONE 1585861
  misc_feature: Encodes the peptide sequence at SEQ ID NO. 95588
acccgcggtggcggccgctctagaactagtggatcccccgggctgcaggaattcgtctcacccctagaaaaaacgcccctcccaacactcccagacccatttccctttccttcccctccggctccgcctcctcgaccactccgacaacccccagcgcctcctctccggcgagctccacctctccaccggcggcggcgagaagcgggggggctaactaagtctgtaggctgcggcggaggtgatcccggagccggagccgagtctagggcgatggggcagcagtcgctgatctacgcgttcgtggcgcgtggcaccgtggtgctggccgagtacaccgagttcaccggcaacttcaccaccatcgccgcccagtgcctgaagaagctccccgccagcaacaacaagttcacctacaactgcgagggccacaccttcaactacctcgtccaggacgggttgacgtattgggcagttgctggtgaaacaggtgggcgaaaaaatcccccttagctttcccgggacagagttaaaggaagacttcctccaaaaaagttgggagggggggaaaacagcttccgggtgcaagcgaaaaggcttgaaacaggggaaggttggggatccaaagcttaaaaaaaccacatgccaggtaccgggggggaaccccccccccaaggagggttaacaaggcctgcccaagggggaaaagccccaatgtccccccaagtccaaaggggggttttggaggggaaaacaattgagaaagggttcctggacccggggcccaaaaaaaattaaaccggtttggtcgaccaaaaaccgaaaaaatctgccggttcccaagggtaaaagggggtgggagaattcccttttttaaccaattttaattttggccg

SEQ ID NO: 95588 - protein, 79 aa, Zea mays
  misc_feature: Ceres CLONE 1585861
MGQQSLIYAFVARGTVVLAEYTEFTGNFTTIAAQCLKKLPASNNKFTYNCEGHTFNYLVQDGLTYWAVAGETGGRKNPP

SEQ ID NO: 95589 - DNA, 1194 bp, Zea mays
  misc_feature: Ceres CLONE 1585863
  misc_feature: Encodes the peptide sequence at SEQ ID NO. 95590
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (286)..(286): n is a, c, t, g, unknown, or other
  misc_feature (486)..(486): n is a, c, t, g, unknown, or other
  misc_feature (755)..(755): n is a, c, t, g, unknown, or other
  misc_feature (852)..(852): n is a, c, t, g, unknown, or other
  misc_feature (853)..(853): n is a, c, t, g, unknown, or other
  misc_feature (1136)..(1136): n is a, c, t, g, unknown, or other
cacaaggggaancccannncanaaacaaaaaaacaanccggnnnaacaataaaaacaaaaaccaacccacacacaaaacgggactccccacggtggcggccgctctagaatagtggatcccccgggctgcttgaattcgtctcacccctagaaaaaagaaactcttcgtctttctttcttcttcttctcttctccactgcacatcctcctttcttcttctcctcgtccatcggcaagctaaggaggcaccattgcttgtcgtctgatccccgccgggcgcgtgtcnctgcacaagatgacgacggcaacagcctttggcagcgtcgccgaccacatcatgccgcacctcctcaacatatatggatcgtctgcgacgggacgggacttcgagatttacgcgccaaatgccaccttttaggacccgctcttgcgaactccacgggtttaagcaaataaaatttgggtttttatacggcctagtccccnagtgggggaaatccaaaatccacccaaatacacccggacagcgaaaaatccccttggggggccctgggcaaaataaccaaaggcggggtgtattccccccaaacaaaaccccgctcccttctccagggtgtgtctttgggcacaaaccccccgcgggggcattttttttaagggaagacggctttcaatccaagggtttggacaagagcttctctaggagtacacaggcgaaatgaggggcggagggtaataagccccaccatataatngtaatcactcggcggagtggggcctaccgacgggggaataaattcccctacttccttttcaagaaaaaaacacccgtggtgataccactaccctggnngttgatgacgcgcggttttcccccacccatcacgcaagttgtgtgggcccagcaaagctcctcctccaacacaaagagggcccacacaccccgcgacccctgggtggcaggcacccgctgttgaattagtgactatgcctcccctaacgacaacaactcaattttgtggctccctccagacggtaataataaagccacataaccccagagaaacgcgtctttgccgctcaaccacctttcgggagaacccctgtttgaattacccgtcgccaggattccgtgngtggctgtgatatcatattccaatatggaaaacaagataaatcggtgtatgtgttttg

SEQ ID NO: 95590 - protein, 40 aa, Zea mays
  misc_feature: Ceres CLONE 1585863
MTTATAFGSVADHIMPHLLNIYGSSATGRDFEIYAPNATF

SEQ ID NO: 95591 - DNA, 837 bp, Zea mays
  misc_feature: Ceres CLONE 1585864
  misc_feature: Encodes the peptide sequence at SEQ ID NO. 95592
ggagctccccgcggtggcggccgctctagaactagtggatcccccgggctgcaggaattcgtctcacccctagaaaaaaccgtcgcattctgcagcgccagctcgctcctcgccccgcccccttctctcagcggcgacgcctcgggcgttcctaccctgccccctctccggaccccccacgccgtcggcgaagcagccgggcaagagcccgatccagaccccgcgagcaatccttgatatacctgatggctatgattgatgagcctctgtacccaattgctgtactgattgatgagcttaagaatgaggacatccagttgcgtctaaactccattagaagactttcgacaattgcacgggctcttggagaagaaagaaccaggaaggagctgattccctttcttagtgaaaacaatgacgatgaagatgaggtgcttcttgcaatggctgaggaattgggtgtgttcattccttatgttgggggtgtagaacatgctcatgttttgcttccccctttggaaacattgtgtacagtagaagaaacttgtgtccgtgataaggcagttgaatctctgtgccgtattggtgcacaaatgaaggaaactgacatagtcgactgggtcattccagtagtaaagaagctagcagctgggtgagtgggttacagctcgtgtatcatcctgtgggtctttccacatagcctatcccagtgcttgggacccattgaaaacggaattggaggacttcctatgggcagttttgtcaggatgacctgcctagggtcagaaaaactgctgcatcaaatctttggaaagttggcagccaacgttgaacaat

SEQ ID NO: 95592 - protein, 136 aa, Zea mays
  misc_feature: Ceres CLONE 1585864
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKETDIVDWVIPVVKKLAAG

SEQ ID NO: 95593 - DNA, 817 bp, Zea mays
  misc_feature: Ceres CLONE 1585865
  misc_feature: Encodes the peptide sequence at SEQ ID NO. 95594
ccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcacgcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatccgccccaccaagtccgaccttgtcaacaacctcggtaccatcgccaggtccgggaccaaggagttcatggaagcccttgctgccggcgctgatgtgtccatgattggccagttcggcgtcggtttctactctgcctacctcgtcgccgatagagttgtcgtgaccaccaaggcacacgatgacgagcagtacctgtgggagtcccaagcgggcggggcgtttcccggttacccctgacccccccacggggacccccttgggcaggcgcccctaagaaacaacccgggttccctccaaggaaccatccagctgggagctacccctggagggaaccgccccccctccaagggaatctggggacaaaaaaaagccactctgggagattttattacaggctatccacccaatcttcccccccggtttggga

SEQ ID NO: 95594 - protein, 162 aa, Zea mays
  misc_feature: Ceres CLONE 1585865
  misc_feature (28)..(152): Pfam Name: HATPase_c Pfam Description: Histidine kinase-, DNA gyrase B-, and HSP90-like ATPase
MASETETFAFQAEINQLLSRIINTFYSNKEIFLRELISNSSDALDKIRFESLTDKSKLDAQPELFIHLVPDKATNTLSIIDSGIRPTKSDLVNNLGTIARSGTKEFMEALAAGADVSMIGQFGVGFYSAYLVADRVVVTTKAHDDEQYLWESQAGGAFPGYP

SEQ ID NO: 95595 - DNA, 896 bp, Zea mays
  misc_feature: Ceres CLONE 1585866
  misc_feature (24)..(24): n is a, c, t, g, unknown, or other
  misc_feature (46)..(46): n is a, c, t, g, unknown, or other
  misc_feature (102)..(102): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
ctcacccgcggtggcggccgctcntagactagtggatcccccgggnctgcaggaaattcgtctcacccctgggaaaaaaaaaaaaaaaaaaaaaaaaaaaanannnnnnnnnnannncccttggggcgtgggcaacgtccaaaatccaaaccgctggtaggagtatctcgtaaacattgaacaacggctgcttggggagcgcctgcgccacctccttccccctcgtctcggcgccctctgcttgcccgtccaagaagaccaccgtcgccaggttccggcgccgcacggcgacttgcagggccagcaccggcggtggcggtggccggggcggcaaaaatgatggcctcctttggctgccccggcgggacgtgatgctcaacggcctgtccagtgtcgccgccgggctcgcctggtacccgggcgtcccgtccggcgcggatgcggtgtgcaccaggggccaacaaggtgaacgaaaaaaaccgtggcattgcacggacccgggccgggcaattttccgtgcccttttggggtcgccaacggaaccccgtggaatttaagcccgaaaagcaaggggacccccccttccgggaagccgggtgcattctcctggagcccgggggtccccgggaagaatttccaaggggggcccgcccccaaaaaataaagggccccccccggaaaaaaaacccccgtaagttttggggggcccaggggggccattcccccagggctttttggggagcccctttttaaattttttacccccacaaaccaaggagcccccccgtttcaaagggatgtcttctcgggggattttccccggccgtgggccccacatgtgaaactctctctttcaaaaagccgccccccttgggagaatttctttgggagacaag

SEQ ID NO: 95596 - DNA, 876 bp, Zea mays
  misc_feature: Ceres CLONE 1585867
  misc_feature: Encodes the peptide sequence at SEQ ID NO. 95597
  misc_feature (876)..(876): n is a, c, t, g, unknown, or other
ctccccgcggtggcggccgctctagaactagtggatcccccgggctgcaggaattcgtctcacccctagaaaaaggaagccaagtcgcctgacttgcgtcttcttgcttcctcctgtgccgtgtttcatttctttgacacaacgacgtccgggcagccgcctcctgtcgccagttcgccactctctggttgctgcacgcctctagtcggcggggccaagaggtggaaaagggcaggatgaagtccggcgagcggccgaagcagatgcggggcgtccggcaggaatctcggcggttccggcttctggtcatcgtcgccggcttcttcctcgtctccctgaccttcgtcgtcatctccaagcccgattccatcctgtccagcctgaacggcaagctgccggtggaccaggcgccgacgtccatcctgatccagcagaaggttaactcgccccccgccaccggacttgagacctccaccgacgcactgcgtggagaccctagagtgggcgatgacaaaaccgatccaagacccacgggggttcaagggcgaagaaggattaaacccgggtactgaacgagccggacgcgaccagcgggatgaccgaactgacccccgacaaggacggcaggcggccgtaaatccaaccagggaggtgctaggcgggcggaaggtgaccgccaaggggaaaaattaaggagggaccgcggcccacgggcccgaaaaaaccataaaaggaacgctccccaaccgtttcccaactacccttatttcatggaacccggagggaaaccccacaaaggcccaaggaaagaactattccaagttattggccccggcggggggaagcaagcgccccttggggggaacttctccaaan

SEQ ID NO: 95597 - protein, 111 aa, Zea mays
  misc_feature: Ceres CLONE 1585867
MKSGERPKQMRGVRQESRRFRLLVIVAGFFLVSLTFVVISKPDSILSSLNGKLPVDQAPTSILIQQKVNSPPATGLETSTDALRGDPRVGDDKTDPRPTGVQGRRRIKPGY

SEQ ID NO: 95598 - DNA, 889 bp, Zea mays
  misc_feature: Ceres CLONE 1585870
  misc_feature: Encodes the peptide sequence at SEQ ID NO. 95599
cgctctagaactagtggatcccccgggctgcaggaattcgtctcacccctagaaaaagcactgaccttttcctccacgtctcccgcaactgcaagcaaccactgatccagcccgttctatgtcccggcgaatggtgacgaaccaggacgcggaggcggcagcgccaggggcaggggcggcggtagatccgatgcggctagcatcgcggtggcggcgatcccggccagagtggaactgcgcgtcggcggagctggaggctgagccgtccgagctcaacaccgtcaacagctcgggactcttctccgtcgtctctaccgacaagttatcggtaaaatacctcggcagccatcaccacggccacgacgtcggtgtcgtgaagccccaccgggccgcgccgacgcgccgagcccgggtactacttcaagatgggccgtcaaggaatggctggattacaaggggggcagacttccctttggggttcaccagccgagagccttccaaaattaaggccgacaaccgggggtggggaaaaaaaaacgtttgggggataccccgggggggaacaaccggcccttccttttttccggggggccagggggaaaagggggaaatctttttggggcccaaaaaatttccactcctggggagacaaaaatttggggcgggggggaaataaacttcattttgtcaaaaagaattttttttttttcccccaacgaaaaggggaacccccgggggtgggggaccccctctcccaaaaaaaaatttataaaggggcccccctttatatcctctcccccttgtgggggttttaatagagggtgggaacgcggagaaaaacctttgggaagaaaaaaaacacccctttcgtgttctttaggacgggtag

SEQ ID NO: 95599 - protein, 181 aa, Zea mays
  misc_feature: Ceres CLONE 1585870
MVTNQDAEAAAPGAGAAVDPMRLASRWRRSRPEWNCASAELEAEPSELNTVNSSGLFSVVSTDKLSVKYLGSHHHGHDVGVVKPHRAAPTRRARVLLQDGPSRNGWITRGADFPLGFTSREPSKIKADNRGWGKKNVWGIPRGGTTGPSFFPGGQGEKGEIFLGPKKFPLLGRQKFGAGGK

SEQ ID NO: 95600 - DNA, 967 bp, Zea mays
  misc_feature: Ceres CLONE 1585871
  misc_feature (12)..(12): n is a, c, t, g, unknown, or other
  misc_feature (66)..(66): n is a, c, t, g, unknown, or other
  misc_feature (633)..(633): n is a, c, t, g, unknown, or other
ttttttatgggnggcgcccaaccacaatccagacgaggagcgggacggcggagacgggacgtgtanttcaaaactggactccccgcggggcggccctctgaactgtggacccccgggctgcagaattctctcacccctagaaaaaaccccacacccacccaccaccgccctcgcacccattgaccagacggcggcgctcatctcctcccccacggttctccccatcggcctgctggcttctccccggcgtccccgatactgaattcctcatcactcctggtctggcctgaagttgcctggaaggaaacccccttttttccccccccggggcaaactttgtggggttcaaaaaaacacggggcaaaaaaaaaatctccccagaaagaatttttttacccttcgggaaaaaacaacaggggggggaagaaaacacccctccagggaaaaaatgtttttttggtggggggcgcacaaaaaaaaaaaaagtgtgcgtggcgacgtggaaaacaaaacaatgtgggggtgggtggggggaagttttttcgtccccccccgtccaactgggtgttgcggggtgagtgaggggaacgcgtcggcgcaaggtacaagagaagtgagataatgtgctgcgcncccgagaaactacctctatcctcttgatggtcgaggtacggggcggcgcgcggcgcagcaggagggggggaagggaggagaccgcccgcgtcccctcatatgagaaagatggggggcgtagcttagtgtgggggagagtgggcggcgcgtcgcggagtggactgagagtgtacgaaggggcgcgcgggacagagcctaaaaataagacacacacgcccggattgtgtgacatgtgaacaaacatagaaggaccgcgccgcggcatccgggatttcgtctgacgccgagtcggtggggtgtggcgaccggtggatggatgtaactaacttcgccg

SEQ ID NO: 95601 - DNA, 846 bp, Zea mays
  misc_feature: Ceres CLONE 1585875
  misc_feature: Encodes the peptide sequence at SEQ ID NO. 95602
ctggagctccccgcggtggcggccgctctagaactagtggatcccccgggctgcaggaattcgtctcacccctagaaaaaccgcccagcgctcgcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatccccacccccctcgccgtgcggttcctcgcgccgcggcccgtcgaggttagcccgcaggcgtggcagctcctctccatcttcctctccaaatcgcggggctggtgcttggccctctccctgtcggcgcatgggccttcctcgggctcacagccgccgtcgccactcgaacgctccccttcaacgccgcctttctccgccttcaccaacgaagtcatctgggctcatcgtcattttccttcttcttcgacgcccggggttcgttaaaaacaggccctcgggcgacccgaatcgccaccctaccttcctccaaatggggctccgggaagcagaaacgcctgggggccctttctccaaacgggggctttaccccttcaaacagagaggccctggcaattcgccggcccaaccccattggccccaagacacccacacgggtaaaaaggggcccccg

SEQ ID NO: 95602 - protein, 181 aa, Zea mays
  misc_feature: Ceres CLONE 1585875
MELHLATIAHRPPLPVPARGHHLRRRLHHLPAPLSFQNTYSPSLSSPHHHRLSPTLRRHLRLPLLASQAPNSNPEPEPEPEPTGAKLLPLVISIPTPLAVRFLAPRPVEVSPQAWQLLSIFLSKSRGWCLALSLSAHGPSSGSQPPSPLERSPSTPPFSAFTNEVIWAHRHFPSSSTPGVR

SEQ ID NO: 95603 - DNA, 862 bp, Zea mays
  misc_feature: Ceres CLONE 1585876
  misc_feature: Encodes the peptide sequence at SEQ ID NO. 95604
  misc_feature (400)..(400): n is a, c, t, g, unknown, or other
ctccccgcggtggcggccgctctagaactagtggatcccccgggctgcaggaattcgtctcacccctagaaaaactccttcttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgagcgcctccgcctgtcctcgcgctcaccgcgcgtctggcccgacctcgcgttcaactggcgggtggtggtcgccacccncgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatggggggcctcggcgtcatcagtttggtacaacctcccaggtgtccaacccgaccaaggaggcggcccgtcatcgactacaagctcgcgttgctcttccagcccatgcttatggctcggcataaccatcggcggaagagctcagcgtcatcttcccatacggggttaatcacgggccctcattaaaaatccctcttccaaaggcacctccgtcaaagaccttcctacaaggggcattcctaattggggaagggaggaactcccgggaattctgaatggaagaccccccgggggcaaaaaaaaccaatcccaaggtttaccggggccgggga

SEQ ID NO: 95604 - protein, 186 aa, Zea mays
  misc_feature: Ceres CLONE 1585876
  misc_feature (82)..(82): Xaa is any aa, unknown, or other
MVMEGRTGSLYGRLNKSSTRGFLAYTAAGAACAAVLACFVLSAADSPASAARNDGERLRLSSRSPRVWPDLAFNWRVVVATXVGFLGSAFGTVGGVGGGGIFVPMLNLVVGFDTKSAAALSKCMIMGGLGVISLVQPPRCPTRPRRRPVIDYKLALLFQPMLMARHNHRRKSSASSSHTGLITGPH

SEQ ID NO: 95605 - DNA, 947 bp, Zea mays
  misc_feature: Ceres CLONE 1585879
  misc_feature: Encodes the peptide sequence at SEQ ID NO. 95606
  misc_feature (350)..(350): n is a, c, t, g, unknown, or other
  misc_feature (373)..(373): n is a, c, t, g, unknown, or other
  misc_feature (374)..(374): n is a, c, t, g, unknown, or other
  misc_feature (947)..(947): n is a, c, t, g, unknown, or other
ctggagctccccgcggtggcggccgctctagaactagtggatcccccgggctgcaggaattcgtctcacccctagaaaaactccttccgctcccctcttcacaacgaagccctagtgtcccgcgacatggcatctggtctggaggagaaactcgcggggctctcaacgggcggcgacgggcaaaatcctccgccggcgggtgagggcggagaggagccgcagctctcgaagaatgcgaagaagagagaggagaagaggaagaagctggaagaggagcggaggctcaaggaggaagagaagaagaacaaggctgcggctgccagtggaaaacctcagaaggcatctgctgnctgacgatgatggacatgggatnncccactcaataactatgaggaatagggctcaaagggctctttgacttcactggaaagggccacagggtggttaaacccccctttccccccattaaagtttcccccgggggtgggggggttttttttcgtggacccccccaaaaactctttttggggaaaagtcccaggggaccccttgggacgcgagagggggggaaaaaaaaaccttccccaaaaattttgtggcccaaaaaaggtgttttatccccgggggggggggggaacctctttgaacaaacaaaagaaaaaaccaccgcgccccctcgcaaaaaaaataatatttctttttttttataaaaacactttcttataggggggggggggggggccctaaaaaaaagagggccctccaaaagatgtagagggggtggagagagacaccaaaaccaccccccccgcgagaaatgttggggtggagaaaaaaacaccccaatatattttttttctttaagaagaccacaccccctcctccatggtgtggtgtaaataaaccacccgaggagggggattttttttctgtcgttgggggcgagn

SEQ ID NO: 95606 - protein, 74 aa, Zea mays
  misc_feature: Ceres CLONE 1585879
MASGLEEKLAGLSTGGDGQNPPPAGEGGEEPQLSKNAKKREEKRKKLEEERRLKEEEKKNKAAAASGKPQKASA

SEQ ID NO: 95607 - DNA, 819 bp, Zea mays
  misc_feature: Ceres CLONE 1585880
  misc_feature: Translation starting site: 266
  misc_feature (395)..(395): n is a, c, t, g, unknown, or other
  misc_feature (675)..(675): n is a, c, t, g, unknown, or other
ctccccgcggtggcggccgctctagaactagtggatcccccgggctgcaggaattcgtctcacccctagaaaaaagtcatgaacgtcaagcacattaattcgtcctctctccgctgcccctcctatctcctcgcgagcaccgctggcctcgcttaacggcctgatctcccagccgccgcttccgcctcgcgtcccaccggtctccatctacatgcagccgcgctcgccaccgccgtcggaggcgcctgcgccctccgacgccatcatgatgcccggcgtgggcggcgtggagccggccgtcacgttgggccaggtgccgcgctggagcgaccccgaccagcgcatcttcctcgcctccacgtccgaagaggcgtccgcggaggacgacggatccngcacgacctctgcgtctggcttcatctctttctccgacccgctcacggtcgacgacggcgccgtcgggggtggccacgccgggggtgcctcgcgcttccccgtcgaccaggagatcaactctaggatctatctctggcgtggccagccctggaaactcgaggtcgacgcggtcgtcaattctaccaacgagagcttggacgaagcgcacagtagcccggggttgcatgctgctgccgggtcagggctcgccgaggagtgcgccaccttggggagggtgcngaactgggatgggcaagatgacaaatgcctacgatctggctgcaaggaaaggcatccctaccgggggcccccaattatgcctgtcagtatcacacagctgcagaggatggcactaagtcactgcctatccggccctgcctggaa

SEQ ID NO: 95608 - DNA, 1048 bp, Zea mays
  misc_feature: Ceres CLONE 1585882
  misc_feature (6)..(6): n is a, c, t, g, unknown, or other
  misc_feature (97)..(97): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
ggcggnaagacggacagggccgagaccgacaaaccgaaaaaaaagcaaccacacaagacacacacagcaaaacacgaaccacaaaacaaaacgtttntnnnnnnnnnnnnnnnnnaaaactggtactccccgcggtggcggccgctctagaatagtggatcccccgggctgcaggaattcgtctcacccctagaaaaactctcgcgcaagggatctcgttctccgcggcagctggtgtttcgctcccttctcgccctccgacggctggttggcagccggcgccggcgccgccaaacgctaggtgctgaggccttcgccagtgtcttcgacggcgacgagcacgtaccaggtattcctatcccttctcttcccttgacctgctgagcgaagccgagcactcgaaccctaacctaaagctctttggctatttgatgcctcctaactccgaatttttttgagaagttatggggcgtacatgtgtacaccaatgtccctttgctaggtcctcccccggccatgccacattgccatgccccgaggatgcgtggtgttaaccggagtgttgttttaggtccataggaaggacatgaacttcgtcttaacagtgttattcaaccgccactgttaaatcattcgatcaatatgccggcttcatgttcctgtaatgatggatccgttttttttttacttcaccaagcatcatgtccaaaaaaaggtccccctggccgggacgaattgattggataaaccgcagcagagggtacccatgtaagccccctctaagttgaaggatccccagaaggccatccctgaaagtcccccctggaatggggggatccgggaaggggcctacccccggacatattcgtggggggttccaaacaaacgtcccgggggcctaccccctggacacccccattcttgctttggaggggaaaccctagagggggcttcccccccggggggggttcccggggggggccccaaaacccataagagggggggcttattcctcttggggacaggaccccgttgtgcgggtgttaaa

SEQ ID NO: 95609 - DNA, 810 bp, Zea mays
  misc_feature: Ceres CLONE 1585883
  misc_feature: SWISSPROT Homolog: EC 1.21.3.3 Reticuline oxidase
  misc_feature (632)..(632): n is a, c, t, g, unknown, or other
  misc_feature (635)..(635): n is a, c, t, g, unknown, or other
  misc_feature (702)..(702): n is a, c, t, g, unknown, or other
  misc_feature (703)..(703): n is a, c, t, g, unknown, or other
ctcaccgcggtggcggccgctctagaactagtggatcccccgggctgcaggaattcgtctcacccctagaaaaaaggccatcagcgtctcaagttactaactaatccacaaaagcacacccgaggcaaggcaagagagtaggtgtaaccgtgtaagtgcaagagatgatgagcaagacgaaggcggctgtgcgaccaagatcctggcacctccctttcctcttcctgctgctcctcgcccagacttgttccccgcaggagcaaggcggcggcggcgccctccacgggagcttcgtccgctgcgtcgcgcgcctctcgccggccaccaccgacacgtccaggctcgtccacgccccgtcggccgcttcgtacccttcccttctgaacgccacgatccagaacctcccgcttcgcgtccccgcggacgccgcgcccggcgctgctgctgaccccggcgaccgtcgccgaggcgcgggcctgcgtcacctgctgcaggcgccacggcctcacggtccgggcccgcagcggcggccacgactacgagggcctctcctacgatccccgtggcgggcgcccggcccctttcgccgtggtcgacgtcgccgcgctcccgcgacgtccgcgtggacgccnggncgcccgcgtggcgcggggccggcccggggcgccacggctcgggggaagctctactacgcccgtgacnncgcgaagagcggcgggggccgctccgggtcccccccgcggggaatctgcccccacgggtctggcgtcggcgggccaaccttcagccggccgggcggggttcggggcc

SEQ ID NO: 95610 - DNA, 850 bp, Zea mays
  misc_feature: Ceres CLONE 1585884
ggagctccccgcggtggcggccgctctagaactagtggatcccccgggctgcaggaattcgtctcacccctagaaaaaaaccgactgcgcgtcccctctcctcccaaacgcattccatcctctctcctccagtgacagcctccggcgcctcctcgggctgccatccagcccgtgccactgccactgccactgcacttgctgtgccgacccgagctgcggtcgagtgagcaatggagcggcggcggcggcggccaccgaggctgccgctccttgtgttcgtcttagttgccaccacttgccccctcgggagctcagcagggattggaagcttcggagtcggtgcggagagcaatggagcttcgtctagttttaggaccaggagtctgctgcagattggagacagaaacgaagatggcctatttcatctgccacatacacgggctctcacgcacaagagcagatctcatagaaaagttccaacacccgcaccagcaccagagtccgctccagcaccctcaccatccatgtctcccacggacagctcaccgtctccgtcaccacatggttcacacccaatgccacgccaatcaacttcacatcgtcatccatccataacacctccacatttgggcaggcctggggcctaggcaagatgggaaatggatcccttggtttataactccagctcattcctcggaaataaacattttttggaacaaccttagggtttaagttgcagcaagggaattggcggttttccccttttgggtatcaagcaggctaagtatttctccggccttccgaagccaaaaaaaaaaggggaacccgttaaagggccattggggccaat

SEQ ID NO: 95611 - DNA, 718 bp, Zea mays
  misc_feature: Ceres CLONE 1585887
  misc_feature (307)..(307): n is a, c, t, g, unknown, or other
  misc_feature (317)..(317): n is a, c, t, g, unknown, or other
ctccccgcggtggcggccgctctagaactagtggatcccccgggctgcaggaattcgtctcacccctagaaaaaaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcgtcctcttcctctaagcccacctccctttcccactccctcccctccaagcactcgctggccccaccccccgccgcatccgcatccntcccgtcgcngggtctcacccccggaacccggccttccggcctccgccggccgcggggtccagcggccggatccaatggccgggtccaggcaacgggcccccagcggccgcttccagaacgggccgcccccgccaatgaaaccccgcccttgaagggggggggccataaagccgcttcccgggcccccatttcgggaaagggggggcccccatttgggggtaaaacccgcccccccccgggggggggggcccccccaaaaaacgggggggggagaacctccatgaaaaaattttttttttctttcccaccaacaaatagggggggggggtttttatttcccccccgaaagggcggggggcgcccccccctggggggggggggggggggggccccccccccctccctgctgg

SEQ ID NO: 95612 - DNA, 836 bp, Zea mays
  misc_feature: Ceres CLONE 1585888
  misc_feature: Translation starting site: 177
ctccccgcggtggcggccgctctagaactagtggatcccccgggctgcaggaattcgtctcacccctagaaaaaagcagagcacgagacacccaagaaacacacagaagcgaggagcactacttgttggttggattctcttcagtctagcagctagtccagttaagtttcagacacatggggagcattggcagaggcacggccaactgcgccaccgtgccgcagccgccgccgtcgacagggaagctcatcacgatcctgagcatcgatggcggcggcatccgcggccttatcccggcgaccatcattgcgtacctcgaggccaagctccaggagctggacggcccggacgctcggatcgccgactacttcgatgtgattgccgggacgagcaccggcgccctgctcgcgtcgatgctggcggcgccggacgagaacaaccggccgctgttcgccgccaaggacctcaccacgttctacctcgagaacggcccaaagatcttcccacagaaaaaggctgggttgctgacgccgctgaggaacctgctgggcctggtgcggggccccaagtacgacggcgtgttcctgcacgacaagatcaagagcctgacgcacgacgtcagggtggcggacacggtgaccaaacgtcatcgtgccggcgttcgacgtcaagtccctgcagcccatcattcttctcgacgtacgaggccaagaccgacacccctcagaacgcgcacctctccgacatctgcatcagcacgtcgggcgcgcccacctactttccggcgcacttctttcagaccgaggcaccgaacgcggccccccccgcaagtaccc

SEQ ID NO: 95613 - DNA, 876 bp, Zea mays
  misc_feature: Ceres CLONE 1585889
  misc_feature (876)..(876): n is a, c, t, g, unknown, or other
ctccccgcggtggcggccgctctagaactagtggatcccccgggctgcaggaattcgtctcacccctagaaaaatagcctcttcaatctcgccggccacctcacgtcctcacctcgcgtggcctcccgttctgacttcggagtccctcggtctcaacgactagttgagagctcgcggctccgttcgggcgaggggaggaggttcatgaggctgctgtaggctccgttgcagccgccgcgggcgggagtccgtgattttggacgccccaccgcggcaagatccggaagcgcgttggctgttgtgccgtgagtttcagtttcggtggtcgattgcttcagcctgctgagaagtaggaggggcggccatggcggggtcgaggttcgggtcgttcaacccccacaagggcgactccacctccgcagcggcggcagcgggtggaccggcgcaaagaagggacccgtacgaggtgctcggggttgggccgcaccgccaccgaccaggaagatcaaggaatgcgttcccgacccatggcgcccccaagaacatcccggaacaagaattgggaaggacccctggttgcattcaaagaggggttcccgggaaagcccatttcctccctataaaatcccctgtcaaaaccccgaaaaaaaggggggcgagtccccaataccttccggggttttggtggccaactcaattcttggaatatcaagggaaccgggaagccttggacctttgtccaattgccctccacctggtgaaaacacggggggttttgcgggccctttttttttaaaaaaaccctgggggtggggcgccatatttaagaacacacggtgtgttagaccttaccgggtgttttaggggagagcgctn

SEQ ID NO: 95614 - DNA, 881 bp, Zea mays
  misc_feature: Ceres CLONE 1585890
  misc_feature: Encodes the peptide sequence at SEQ ID NO. 95615
ctccccgcggtggcggccgctctagaactagtggatcccccgggctgcaggaattcgtctcacccctagaaaaaaaatcacaacctcgcatcctcttctgtcccgtccccagctcttcgttcgttcccctctcgccgcccgtctcccccgcggtcgaggagccgccaatagcaaggagagggtttcctcctccctccacggctccaccgagccccccgatccctccgccccaaatcccacacacccggttggccaccgcctcgccatggatttggatctgtggatctccaaggtcaaggagggtcagcacctcgccgagcacgagcttcagtccctctgcgaatatgtgaaggagatcctcatcgaagagtcgaacgtgcaaccagtgaacagccccgtgacggtttgcggtgatatccatgggcagttccatgacctaatgaagctcttcgcgacggggggccacgtcccagagacgaactatattttgctgggtgattttgtggaccggggcttcaataatctagaggttttcaccatcctgatgctactaaaagcgaggtatcctggcaacatttcccttctgcgggggaaatcatgaaaaggaggcagttgaaacagggggtatggggtcctaagaaggaggggcagaaaaaagtttgggcaaccgccattggcttgggagggacctgaacgtgatgggtgtttggaattacccttacgcccttttcaggaaatcaatttttggggcccaggccccccgggggggtacaggggggggatacttttccctccgggatggggttcccccccccttttgggcccaggatctcgaaaacgaatgttgtttcaccaaatattgggtgaaaatgttcccccca

SEQ ID NO: 95615 - protein, 111 aa, Zea mays
  misc_feature: Ceres CLONE 1585890
  misc_feature: SWISSPROT Homolog: EC 3.1.3.16 Phosphoprotein phosphatase
MDLDLWISKVKEGQHLAEHELQSLCEYVKEILIEESNVQPVNSPVTVCGDIHGQFHDLMKLFATGGHVPETNYILLGDFVDRGFNNLEVFTILMLLKARYPGNISLLRGKS

SEQ ID NO: 95616 - DNA, 932 bp, Zea mays
  misc_feature: Ceres CLONE 1585892
gcggtggcggccgctctagaactagtggatcccccgggctgcaggaattcgtctcacccctagaaaaagggccctgcagcggcggcagctggcgggagagaggcttgggactgggccgcccggccgcgaggaataaactcactcctgtcttcatacgtatccatagccggcaggcggcagtacctgtatgtggttttagctatacgcgacctcagttcgggcgcaaggttagtcttcgatttaagcatagattttattttatcttcttggctccaccaaataacactaacaaaatcgctttggcttctatgggttcaaattaagcactggatcgtaccattttcttgttcatttatagttggtcagccaatccacaccgattaatttctccccccccacaacccataaagttttcattttctgggaaaaagcatgtatttatttttatcccctaattcgatctttttggtgagacgcaggaaaaaaaataagggcatgcccaacgaaaatctagaaaaggggccccgattttaggtgggccccctttttcctgttgccgggggctaaataaaaaaccttaaacgcacgctgggggcccttgaaaaaaagagcctttcccccctacactttttttggacccagagtgcgggtgagttgtcttttttaccagaatttggggggataaaaaaaggtgctctctcggaaacaagatataaaatctttccagggccggggggggtgcgcagggagttatactgggggatatacgggggagacaagatttgaactaatatagcggccccccccatatctggcgctgtgcccctcacgttaaaagcagagggctgtgttatggtggttgccgtcactttataaagaccgattctccgaggggaaaaagggcgcgcgttgaatgtttggggaacggtgct

SEQ ID NO: 95617 - DNA, 855 bp, Zea mays
  misc_feature: Ceres CLONE 1585893
  misc_feature: Encodes the peptide sequence at SEQ ID NO. 95618
  misc_feature (423)..(423): n is a, c, t, g, unknown, or other
  misc_feature (440)..(440): n is a, c, t, g, unknown, or other
ctggagctccccgcggtggcggccgctctagaactagtggatcccccgggctgcaggaattcgtctcacccctagaaaaatgcgccggttccgcgagcgaccaccccgccatccgcggagcctgccctgcgctgcccaccgctcctccgcctactccggcctcagctaataacgatgggtggtgggagccgagccctttccctctcctccctctgcgccaccaccctcgccgccgccaagcccccacagcaccccgtccccttcgccccggctcaccgcgcgctcccccaccgcctcgccgccgccatgtcctcctcttcctccccgacccccgccgcatcggtggacgccggtgccccggccccttcggcgtccaacgccatcgacttcctcacgcgcccccaccccctcaagacgaccaanaagggcgggggtgggtngaagcgcggggtgcaggcgccccgagtcggtggggcgaccccatgtaccggatggggcgtcattggcgctccgtcgcggcccgatctaccccggcgtcaacccgcgacagggtgtgtcaagatgggcgatttgtgccaccaacatttgaagaagcaattggttggtggaacatcccccctttctggataatggtccccaaggaaaaaagaagaacccccaggggagaaaagaagcatttggacccttttgtgccaaacctgcttgggggggtggttccaaaaaacacaaaaaaattccgtgaaactttgggatgggggttttgaaggaaaattccgtcctcttggaaaccaaaggtgtttcaaaaaatttttaacaagggttgaaaaataaaaccctccaaccccgggggagatt

SEQ ID NO: 95618 - protein, 151 aa, Zea mays
  misc_feature: Ceres CLONE 1585893
  misc_feature (83)..(83): Xaa is any aa, unknown, or other
  misc_feature (89)..(89): Xaa is any aa, unknown, or other
MGGGSRALSLSSLCATTLAAAKPPQHPVPFAPAHRALPHRLAAAMSSSSSPTPAASVDAGAPAPSASNAIDFLTRPHPLKTTXKGGGGXKRGVQAPRVGGATPCTGWGVIGAPSRPDLPRRQPATGCVKMGDLCHQHLKKQLVGGTSPLSG

SEQ ID NO: 95619 - DNA, 1277 bp, Zea mays
  misc_feature: Ceres CLONE 1585895
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (817)..(817): n is a, c, t, g, unknown, or other
  misc_feature (858)..(858): n is a, c, t, g, unknown, or other
  misc_feature (1043)..(1043): n is a, c, t, g, unknown, or other
  misc_feature (1048)..(1048): n is a, c, t, g, unknown, or other
  misc_feature (1068)..(1068): n is a, c, t, g, unknown, or other
  misc_feature (1152)..(1152): n is a, c, t, g, unknown, or other
tcggcacgccagccgcggacacacccgaccaaaagcgaaaaaatatcagagaaacacagactaaacctcaaaggggggtttnnnttatggaactccccgcggtggcggccgctctagaactagtggatcccccgggctgcaggaattcgtctcacccctagaaaaaggcacccaccgaatccgcccctccctctttccgttccgcctcgttgcgctcgctctcgctgcgccgcccgccccacctcacggagctcacggcaacaccggctgggacggaaaaggaaagccgaggaggcgaggagagagatatacaaggcaggcagccaggcacaggcagcccgcggctggctacggggccaaaacccttacgcgcgaggcggccccctcctcttcttctctctcccaccaccgccctccccttgccagttttgccgcaggagccgcccccatccgatccggaagagggatgagggggggaaggggaattttttccccccccttttccaccaaaataaagaagggggtgggggctaatgcatatagaaagttaagatgtgtgggaatatcacgcgaccgagagagaggagatacataccaccgggagaggagagatccatccatatatagataaattgtgagggaaaaggagaccgaaacgaacaaatataaacgctggtggtctgcttcgcagcctgggaagaggatgacgagggtagcacgacacttcgcgtcgtgaggacgcgccgcgacgtgggcgcctcagtatggcgcgctggagagctcgccgagcagaggcggcggcggggggtaaagatanattaaacagtgatgaacggacggcgaaataagagtgagtanggagcggacgaggagcatgctgcggagtttaacacgatcatgagggggatagaagagagaagctcgcgccacacgggtggtggctgatcgttgtcgcatcacagggcgggatcatatcataagagggcgccggggggtataactatatggcgggctggaagacacatgcactgcgcgtattttgngtagnaggacacacacggcgcttcnaggcgctgagacgtcgcgctcgagagaacgagaaagtgtgctccgcgaataaaagagatgaaactctctctatggcgtcgagtnatggcggtgcgcgtgagatcgattgctgagatcctccgtgcgcccgaaacgtagacagcgatagacggagcggctaagaggcacaacgaatgttaggcgtggggcggtagctgaaggatgacaat

SEQ ID NO: 95620 - DNA, 1180 bp, Zea mays
  misc_feature: Ceres CLONE 1585896
  misc_feature: Encodes the peptide sequence at SEQ ID NO. 95621
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (1124)..(1124): n is a, c, t, g, unknown, or other
gggagggggggnnnaaaattatagaaaagacgcaaactactggggagtcatttgggtagaaatttttcaaaactggactccccgcggtggcggccgctctagaactagtggatcccccgggctgcaggaattcgtctcacccctagaaaaatgcgcaaacatcgaatcgtctcactcgtgtctgccctgctcatactgcttgccctcgccgtatcgtccacccgcaacgcacaggaggattccatggccaacaacaccggagacgttggtggggcggcatccagggacgtgcccggggtagcgagaacgaccttcacctccaggagctcgccccgcttcgccgtcgatgagcacaacaagaaggccaatgctcttctggggttcgagaaacttgtgaaggccaaaacacaagtggttgctggcacgaaggactatctcactattgaagtgaagggaggggaaattccaaaaagcttcttacaaaccctaaaggcctggggaaaaaaccctgtggggaaaaacccttctaagggggggctgccacggaaatttccaaaggcccttgtttttgaaaaaaaaggggggggtgtaaggcgcggcccctttaagagggaggtgggtcgcaccccccgttctgcgcccccgaagaggggttggccgtcgaaaagccccccctgttgaaaaagcgcgcgcctcccactaagagcccggcaacagtgagactctgtgttggcgcggctctcgttatacattttatatatttgggtggcgaagtatgatccccaccccaccatagcgaggtggcgaggatggtcccacgatgcgctgctgggtgtttgttgagtggtggggggtgcgtagaaaagagtgtgtaatcacggagcccctgcaagtgtcatagagacgaaggaatagtacgagcatcgaatggagacaagggagagcacggaggaattaagataatcaatgatgtgacactatacttgatgaaaaggatgaataaattctagagtaaggacactgcgggaccgagaacgtccgacccacattcatccatataaagttggtggtgatgtctgcctcgccgagacgtcgatccagaggggggcgtcattgtaagggtnaattagatgagagtcgttggactaatgaactctcgtccgtgttatgcttcattgtt

SEQ ID NO: 95621 - protein, 176 aa, Zea mays
  misc_feature: Ceres CLONE 1585896
  misc_feature (40)..(144): Pfam Name: Cystatin Pfam Description: Cystatin domain
MRKHRIVSLVSALLILLALAVSSTRNAQEDSMANNTGDVGGAASRDVPGVARTTFTSRSSPRFAVDEHNKKANALLGFEKLVKAKTQVVAGTKDYLTIEVKGGEIPKSFLQTLKAWGKNPVGKNPSKGGLPRKFPKALVFEKKGGGVRRGPFKREVGRTPRSAPPKRGWPSKSPPC

SEQ ID NO: 95622 - DNA, 1232 bp, Zea mays
  misc_feature: Ceres CLONE 1585897
  misc_feature: Encodes the peptide sequence at SEQ ID NO. 95623
  misc_feature (1)..(1): n is a, c, t, g, unknown, or other
  misc_feature (2)..(2): n is a, c, t, g, unknown, or other
  misc_feature (1184)..(1184): n is a, c, t, g, unknown, or other
  misc_feature (1195)..(1195): n is a, c, t, g, unknown, or other
  misc_feature (1197)..(1197): n is a, c, t, g, unknown, or other
  misc_feature (1199)..(1199): n is a, c, t, g, unknown, or other
  misc_feature (1205)..(1205): n is a, c, t, g, unknown, or other
nnggagattgaggggtgggataaacaaattgaatagagagaggggaagggaaatttcggttgggggcaaactggactccccgcggtggcggccgctctagaactagtggatcccccgggctgcaggaattcgtctcacccctagaaaaagcctctcgtcgacacgaatgcgcaaagcaaacaccacgcgggccaggccaggcgcgcacgcactggacgggggcatccgaacaccaccgcccagcacccaccgggtcgggcgaaaaaaagaaggaaaattttagataccctgccgcactcagcgaccttcggccccgtctccggtctcagccttcccccacctattggggagcgctcctgattcgcgggagccagcgggcgagacaaagagaattccccggctccggcgccggccgggatcagcgccgtcggccgatcggaggatctttggttcccccggggggggggggggtggccccaccattggacggcggggacggggcccgtggcaccggaaggaaaggaaacggctcatgggcccgcccggatatcaacgggggaagggttccgtgccccgagcaggaaaccggggataaggcctttgaaacaaccgccagcgggcctgtccaaggggggggcctggcgggtgtggcggtcgtgccggacgggggtgagcccccccggtgcaagcgggaaacgggagggggggggaggggtcaggggggaaaaaaaggcatggcaagggccaggaacccccaagggatcccaacagacgcgtagtccggaggagggtgatagagcccatggaagctaggagaacaagcaggagagggataggggcgcagtcaggagggattgtgtctgtgtgccggcgtgatggggtgtgtgggagagccctcagacgggcctgcggatataagtgagaagaataagacatgaaggatggggtgagctagcggcagtggtgggggtgtgcgttgcacacttccggcggacgggcgacaaagcttagacactgactactcgcagagcgagggcataaccagcgagacgacacaccaatagtattctccgaacgtggtggcttcgggaaataacaatcgccgtgcgcatggtactatcaagaggggtggattgtaaggtaaggcgccgcgagatgtacgtcgcggttcgtcagggatgagnaaggtgcctcngngngcgaanaaacatcacctgtgctcaagtgtaggt

SEQ ID NO: 95623 - protein, 31 aa, Zea mays
  misc_feature: Ceres CLONE 1585897
RLRGGINKLNRERGREISVGGKLDSPRWRPL

SEQ ID NO: 95624 - DNA, 1086 bp, Zea mays
  misc_feature: Ceres CLONE 1585899
  misc_feature (18)..(18): n is a, c, t, g, unknown, or other
  misc_feature (25)..(25): n is a, c, t, g, unknown, or other
  misc_feature (36)..(36): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (76)..(76): n is a, c, t, g, unknown, or other
  misc_feature (77)..(77): n is a, c, t, g, unknown, or other
aaaaaaaggactttttcnagacggnaaacaaacaanaaaatacggctatgggggggacannnnaaaaacttaaaannaagaattcacaatcccgcggtggcggccgctctagactactggatcccccgggctgcaggaattcgtctcacccctagaaaaagtctgagctcggctgagaagaccctgacagtccgacccttgccagccacaaagtgcagcctccgttgctacaggactgctgacaaatgtatgaccttgctgtgacagcgtaatctgctcagtggcagcaactgggaccgcaagcacgtctaggactggtaggttcatctgtctcgccgccgggttttcaggtaaagtcaggtcaggccaactctgtcgaagaaggaacatccaagaaacgaaggaggtgggcggcaatggaggatgcgatggctgctgactggaacaccgtgctgcatggggggtacaagctggggcggtgtcttccccccgggaacttctggcggggtcctcgcccccacggggatctgccccacggggccgcaaacatctccggttaaaggggggtgggcccaaaggaccaaagcttcgaaaacggcggcggggaaatggggcgggaaccctgaaatccaaggaggggaaagaacccgccccagtccaatgaaaaaaaatggggtgggttcccccaacctacacaatctccttcagtgtggggaataacttggaacaaccttaacagggtgtagaattgggaaacctattttgccaaggcttttcccacaaagaaatttctttacccccttccggatggcctttctgaaaggcttccagagttcccactccctcgcggggggggaaaaaatctttcgttttcttctccctcagcaatttagatgtggggaacctctcgggagagcgcgggcggtccccagggggtaatagaaaccctatgggggacaaaccttggtttttatattcccatgggggaattctctgtttcgcaccctgtggcataccgatattttttctttacccccgggaccctcactggggagctttctcagcgccttattaacatcaaaaagg

SEQ ID NO: 95625 - DNA, 2218 bp, Zea mays
  misc_feature: Ceres CLONE 1585900
  misc_feature: Encodes the peptide sequence at SEQ ID NO. 95626
aaccggctcacttccaagcactgcagaaccgtttggcgcttgctttgctttgctctgctgtagtaaccagaacacgcaccgcgaaaacaggcaccgtgtttccttcttgtcctcgacacaggcacaggcagggaagtcgcgcgatcgatggaggtggaggcggcggcgtcgggacggtggtgcacgtggaacctcgcggcggtggccgcggtgggtgcgtgtctgctcctggtgcacgtggcggcgcgggtggcggacgcgctctggtggcgcccgcgccggctggaggcgcacttcgcgcgacagggcgtgcgggggccaccgtaccgcttcctcctgggctgcgtcagggagatggtcgcgctcatggcggaggccgccgcgaaacccatgtcaccgccggactcgcacgacgcgctcccgcgggtgctcgggttctaccactactggaggaagatctacggaccgatgttcttgatatggttcgggccgacgccgcggctcacggtggcggacccggagctggtcagcgaggtcctcctgacacgcgctgacgcgttcgaccgctacgaggcgcaccccgtcgtccggaagctcgagggagacggcctcgtcagtcttcacgacgacaagtgggcgctccaccgccgcgtcctcaccccggccttctaccccgacaacctcaaccggctggcaccgcacgtcgccaggtcggtggtggcgctggcggagaggtggcgggccatggcgtccgccgcgggaggcgaggtggaggtggacgtcgcggagtggtaccaggccgtcgccgaggaggccatcacgcgcgctacgttcggcagcagctacgactccggccgcgtcgtgttccgcatgcaggcgcgcctcatggccttcgcctccgaggccttccgcaaggtcttcgtccccgggtacaggttcttgccgaccaagaagaaccggctgcagtggagcctggacagggagatcaggcggggactcgtcacgctcatcggccaccgcaacgacgaggccgcgcaagacgatgactcggagccgaacgacaagggaagcagcaacggcttccgggacctgctggggctcatgatcaatgccagcgacaagaagaagaagcaggaggaggcgcgggcgatgcccgtggaggacatgctggaggagtgcaagacgttcttcttcgccggcaagcagacgacaaccaacctgctcacctgggccacagtgctcctggccatgcacccggactggcaggagcgtgctcgccaggaggtcctcgccgtgtgcggcgccgacgagctcccgtccaaggagcacctccccaagctcaaaacgctggggatgatcctgaacgagacgctccgcctgtacccgccggcggtggccacgatccgccgcgcgaagcgcgacgtgacgctcggcggcgtgtccatcccgcgggacaccgagctgctgatcccgatcatggcgatgcaccacgacggcgcgctctggggccccgacgccacgcagttcaaccccgcccggttcggcggcggcgcggccaaggcggcggcccacccgctggcgttcatccccttcgggctcggcccgcggatgtgcatcgggcagaacctggcgctgctcgaggcgaagctcacgctggcggtcgtgctccagcggttccggctcgcacggtcgcccagctacgtgcacgcgccgacggtcctgatgctgctctacccgcagtacggcgcgccggtgatctttcggccggtgtcgtcgcagctatccgtttcagaccggacggagacgacgagaccaccacggcactgatgtgatcgatatccatacgtccgctagtgaatactagtgtgctagggaacgaatagaagacgcaatgaaaccagtaaaagaaaagcttgtgttgtcctgtcgtggcagggccggtggcggtgggcgggcccggacctccctgctttctggggccggccggtcgggtcagttgccggaaatgcccccgtggtagactagtagactgtagtccgtagcagagttttggacttgacgatggcgtggaagaacaccaagaaaccaaccccacatctgctgtcgtgtcgggtcggttccatctgcggctactacctgcgtccagctatgcatatgtacgtgtacaggtttatttatttacatacaacagttttggcagtaaaaaaaaaaaaaaaaa

SEQ ID NO: 95626 - protein, 559 aa, Zea mays
  misc_feature: Ceres CLONE 1585900
  misc_feature (84)..(538): Pfam Name: p450 Pfam Description: Cytochrome P450
  misc_feature: SWISSPROT Homolog: EC 1.3.3.9 Secologanin synthase
  misc_feature: The sequence is a functional homolog of SEQ ID NO 2 in US patent 7034205
MEVEAAASGRWCTWNLAAVAAVGACLLLVHVAARVADALWWRPRRLEAHFARQGVRGPPYRFLLGCVREMVALMAEAAAKPMSPPDSHDALPRVLGFYHYWRKIYGPMFLIWFGPTPRLTVADPELVSEVLLTRADAFDRYEAHPVVRKLEGDGLVSLHDDKWALHRRVLTPAFYPDNLNRLAPHVARSVVALAERWRAMASAAGGEVEVDVAEWYQAVAEEAITRATFGSSYDSGRVVFRMQARLMAFASEAFRKVFVPGYRFLPTKKNRLQWSLDREIRRGLVTLIGHRNDEAAQDDDSEPNDKGSSNGFRDLLGLMINASDKKKKQEEARAMPVEDMLEECKTFFFAGKQTTTNLLTWATVLLAMHPDWQERARQEVLAVCGADELPSKEHLPKLKTLGMILNETLRLYPPAVATIRRAKRDVTLGGVSIPRDTELLIPIMAMHHDGALWGPDATQFNPARFGGGAAKAAAHPLAFIPFGLGPRMCIGQNLALLEAKLTLAVVLQRFRLARSPSYVHAPTVLMLLYPQYGAPVIFRPVSSQLSVSDRTETTRPPRH

SEQ ID NO: 95627 - DNA, 835 bp, Zea mays
  misc_feature: Ceres CLONE 1585901
  misc_feature: Encodes the peptide sequence at SEQ ID NO. 95628
  misc_feature (389)..(389): n is a, c, t, g, unknown, or other
ctggagctcaccgcggtggcggccgctctagaactagtggatcccccgggctgcaggaattcgtctcacccctagaaaaaagcgtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacnagctggggcgggtgctggggcacggcaacttcgggcgggtgcacgcggcgcgggacctgcgcacgggccgcagcgtcgcggtcaaggtggtggccaaggacaagctggagcgcgcgggcatggcggatcatatcaagcgggagatcgccgtcatgaagatggtgtcccaccccaacttcgtggagctgcccgaggtgatggccacccgctcccagatctacctcgcgctcgagctcgtccgcgggggggagctcctctcccgcatccggccgcccgggggcgggtcccgggaggacgtgggcccccctttttatttccgggcagctccgttccccccggtgcaaatttttttgcccacgggccccgggggtgtgttcccccccgaaaaccctgaaagccccgagaaaaccctggcccccctcgaacgaaagggtggggcgaacccc

SEQ ID NO: 95628 - protein, 166 aa, Zea mays
  misc_feature: Ceres CLONE 1585901
  misc_feature: SWISSPROT Homolog: EC 2.7.11.1 Non-specific serine/threonine protein kinase
  misc_feature (18)..(18): Xaa is any aa, unknown, or other
MEDAMAADGKSVLQGRYXLGRVLGHGNFGRVHAARDLRTGRSVAVKVVAKDKLERAGMADHIKREIAVMKMVSHPNFVELPEVMATRSQIYLALELVRGGELLSRIRPPGGGSREDVGPPFYFRAAPFPPVQIFLPTGPGGVFPPENPESPEKTLAPLERKGGANP

SEQ ID NO: 95629 - DNA, 1008 bp, Zea mays
  misc_feature: Ceres CLONE 1585902
  misc_feature: Encodes the peptide sequence at SEQ ID NO. 95630
  misc_feature (43)..(43): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (110)..(110): n is a, c, t, g, unknown, or other
  misc_feature (111)..(111): n is a, c, t, g, unknown, or other
ctccacctcggtggcggccgctctagaactagtggatcccccngggctgcaggaattcgtctcacccctagaaaaaaaaaaaaaaaaaaaaaaaaaaannnnaaaattannaaaaccccggctcaacaaaggagcgcgggggcccctcattccttcctcccacttctctcgcgctgcgctcgcttacctcgcttcgcattccgttcgagcaggggagcggccgtgaaaagggaagggagggaattaaggcaagatgttcatcgagagcttccgcgtcaagagcccccacgtgcggtacggcccgacggagatcgagtcggagtaccggtacgacacgacggagctggtgcacgaggccaaggacggcgcctcccgctgggtcgcccgccccaagtccgtaaagtacaacttccgggacaacaccgcccgtccccaagctcgggggtcatgcttgggggggggggggaggcaaaaaacgggccccaccgctgaagggtggggggccattggccaaaaggggaagggggggtttcattggggcgaaacaaagggaaaaaggggggaaaaaaaaagccaaaatatatttatgggggtttcccccctcaaacccagagggttttttcccccccgatttaaaaaaagaagaggcgcgcacttcacccaagagggggggagagagaaaaaaaatatatagccgcgccccgcgtttaaaaaaaagagaccccccctcttccgcacaggtgtgggggtacaaacaccccaaaaaacaacacacttctgtgttttttttagtaaagagaggcgggggggaaaaactctgccccttggaacatgggaacaacaccgggagagaaaaagtagcccaagcttgaaaaagcgggagacccacaaagggggcgtgtgagggaacatttagtgtgacacctggtccgataaaatagaaacagacttttgcagtgtgtcccctcataaatatggtgaggagctcctcgcggtgtgttgcgccct

SEQ ID NO: 95630 - protein, 146 aa, Zea mays
  misc_feature: Ceres CLONE 1585902
  misc_feature: SWISSPROT Homolog: EC 5.5.1.4 Inositol-3-phosphate synthase
MFIESFRVKSPHVRYGPTEIESEYRYDTTELVHEAKDGASRWVARPKSVKYNFRDNTARPQARGSCLGGGGRQKTGPTAEGWGAIGQKGKGGFHWGETKGKRGEKKSQNIFMGVSPLKPRGFFPPRFKKRRGAHFTQEGGREKKNI

SEQ ID NO: 95631 - DNA, 890 bp, Zea mays
  misc_feature: Ceres CLONE 1585903
  misc_feature: Encodes the peptide sequence at SEQ ID NO. 95632
ctccccgcggtggcggccgctctagaactagtggatcccccgggctgcaggaattcgtctcacccctagaaaaatttttttcttgcattcactgtgagtaccaatttagatgcctcatgaaataggaactagcaaattgtagcaggaatctgatttttagattacatggaagacttatgtttcatgtttcctggtttacaaaacagctactaattgtgtgtaccctttgtccagatcataacattgtatgtgactggagcactaaacactgtcttgtcattggaacaccagaaggagatccgccggtatctttataatcaccagaatgaagatggcggctggggcttgcacattgagggtccaagcaccatgttcggctcagcactgacctatgttattttgagattgcttggagagggaccagatagtggagatggagccatggagaaaggtcgaaactggatattagaccatggtggagcaacatatataacatcattggggggaagttttggctttcgggtactaggtgtattttgaaatgttctggtaacaaccccgtgcccaccagaagtatgggctactgccatatcctcctcccatttcaccccagggaaggattgtggtgtcattggtcgaatggttgtaatttggcaaggtgctacattttatggggaaaaaggttttgttggcccaaatcaacaccacttcctgttggggatttaagggaaggaattttttcaaaaaaccctttaccccaaaaattgattggggaaaagggccccccaacccattgggtcccagggaaaaaacttttcttccccaacccccatttcttttaaaaaaggggtgggggggcccccccccccaaaatattcttggaaaccagt

SEQ ID NO: 95632 - protein, 56 aa, Zea mays
  misc_feature: Ceres CLONE 1585903
  misc_feature: SWISSPROT Homolog: EC 5.4.99.8 Cycloartenol synthase
MFGSALTYVILRLLGEGPDSGDGAMEKGRNWILDHGGATYITSLGGSFGFRVLGVF

SEQ ID NO: 95633 - DNA, 775 bp, Zea mays
  misc_feature: Ceres CLONE 1585905
ctcaccgcggtggcggccgctctagaactagtggatcccccgggctgcaggaattcgtctcacccctagaaaaggaactcctctctgctcacgagtaaagcctgccgctagcccgcgctctggacgtcgcctcctcccccaccccaccggctgtcgccgcccccgccgacgttacctccttacccgccgcaccccccccccccctgcccccccgtccttgccttggcggatctgcctgcctgtgccgcctggcgctgcctcttatcccgccggccgccgctgcctcacgttagctcctcccccatcgtatccggacctccgcgccgcccccacgcctccctgacttggtggatctgtccaccattcaccggaaacagttggtcgctgcctacccacccacctaccccctaggcgaggcggtaccccgtcgcccagcgcataagcgcgcccaggcgagcacggaatagctccttttcgaatacactcgggcgaagcttagatctgatctcaacgaacctgcagcttgctgcagccactcctcgccggggatggatttcatgaagggtttcgatcagactggggcgtgaaataaagagggagggcaaatctgaaggtactcaagggcccccgagatcgagcaaaagggacttgatgccaccaggtggtgaaaccgtgggggccccccatgggaagtgctcttttcagaaactggcacaccgctaccaaagaagtttcgctgaatggccaaaagggggaaaggaatggccccaatggg

SEQ ID NO: 95634 - DNA, 893 bp, Zea mays
  misc_feature: Ceres CLONE 1585907
  misc_feature: Encodes the peptide sequence at SEQ ID NO. 95635
ctcaccgcggtggcggccgctctagaactagtggatcccccgggctgcaggaattcgtctcacccctagaaaaactctttccagccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgacccccccccgagggatctcatgcgcgatgacaagaccaagctcgcggaagaaactaagggaatagtggcttatatcgaggcgcggcgccggaagggatatcaaatcaccctgggagctttagacctccgcctcctgggtgagggtttgaggtacaagaaaccgaccaattagggacgttaagcgccacacggggctcagaaaaaaaatcggttaaaaaagccccctcgacaggggtgtctacttatggggacactgggaggggactccgcggggggtcgcaactgtggggaagggaaaggtcagcactcggggcctgagaaaccctttacccgggctcttttctaagaatgggaggattggggcgccttacagtgagtgggagactaagaacccccagggtcaccgggccatgggaaccgagtttggcccctacccgggataacaaagagggcccaaagacttttgtttgtgtcaaaaggcaaggggcatttgtttgggg

SEQ ID NO: 95635 - protein, 112 aa, Zea mays
  misc_feature: Ceres CLONE 1585907
  misc_feature: SWISSPROT Homolog: EC 1.1.1.86 Ketol-acid reductoisomerase
MAAATSSSTYLAIGRKTLSPAPSVATAATSVSFPATQHPCLVAASADRRRAVAAKVSSPSVIGTAMPSLDFETSVFKKEKVSLAGHEEYIVTPPRGISCAMTRPSSRKKLRE

SEQ ID NO: 95636 - DNA, 967 bp, Zea mays
  misc_feature: Ceres CLONE 1585909
acccgcggtggcggccgctctagaactagtggatcccccgggctgcaggaattcgtctcacccctagaaaaagtactagctggtggcgctagctggtctcacactctcactagatctctctcacatgcatatgcatgcattagcttttccccaccagcatgcactagctgactagcatctgtgtaatcggtgaccgctcttgacttgttggctcctcgctcccacggtagctaaagctagctaggtgggtggtagcaccaccatggcctcgcccaagcattctcatcgccatcatcgtgcggcggcgacgaagcatcgtcggccgctggcgctgcggcgtgcgatgctgcattcgtgcgtgtgcttcctggtgggtctaatgaccggactgaccccccccgactggacggacgccgcctcgcgggcggaccgtgcacgcgaacgggggcggccacggcgcaagggtttccgcggcgctgcatcgccattaaaccaaacgggcggccggcgggggggccttgggcccaagcttgctgggcgctggaagccacttagcagccagccaggcccaatgggttgggaagaaagggaggaaagggagaacagggtgaaagccccctccgggaaaactgtgggggggtggggtggggtgaaacacaatttacccaaaaaaaccttccaaaagggggggcctggtccgggaagccgccgatgccctgcgggtttcggtcagaggttctttaaagaatgatactggaggaaaagacaggatgagggttctgggggaggccaccccttcccctgaggagggggggttgtggagcgaggagagattccccccccgggggagggcatggtggccacacagcccaggtttgctagccgagaccaccggggggggggtgtgcaacgacaccgcggaaatacacgccggagaaagtacacccttgggaaggacttggaaggg

SEQ ID NO: 95637 - DNA, 1333 bp, Zea mays
  misc_feature: Ceres CLONE 1585914
  misc_feature (1017)..(1017): n is a, c, t, g, unknown, or other
ggaaagggaggggggggggatattaaaaatataaatagataaagtgaagaagggcagagcacctgtggtgggcgaagctcccgcggtggcggccgctctagaacagtggatcccccgggctgcatgaattcgtctcacccctagaaaagcttcgttatctatacaaacaaaactcgtgctccagaccacagctcacctgcgacctgtgcgcattcacagccgccggctcctctcgtgcccgcgcgatgggcgccacctctgtcgcatacacggtccaccagccttcctctcccgggccgggcggcgcccctcaaatggctgccaccttcaccgtggccgcccgcctcccgctagatgggccccgaggcgcgctaccatccccggaagggatgttggctgcgtggaaacccagactccaaatcgggtatgaagagcggagagggccgaacctgtggataggggcggagagggggacacggcccggaggttaggggcccccacaaccttcctaacggtaggcgggaaggcaataggggctagaaagggtagcccgaattgggcgccgcggctttggcaagttgtcggttcattggcctgggggttcgggtcgaaaaaggcgggtagtgggagaaggggctgtaggggcgacaggaaaaagtttgtgcgtggccgaggaggggggggatataaaacggtgctagggataggggtggagtggcgtgaagaagtcgagacgttggataaggtgagggtaacataatgtctgcggagtgggtgcagcggcgcggagcgaaagtggcagagcggggcatgagacaggaggggagtccgagtgagcggaaggctgaaaacagagtagagggggagaggaaaagaatcgaatcctcacacgggtgcggaagctggctcatgagagagagaatgtgtggcggagcaacgcggatattggccgcctgtaatggcgcctcttacgcgtggttcggagtgtacggaatgtgggaagtggcggtggtctgntgtgatgaaagaggcgagagacacgccaatttggacgcctaatgtattgtgttaagactgtgattttggataggacggcgtacgcagggagtaagtggagtaggcgcggaattgtgcaatggagaggtgcagtgtgtaatcactgctcaggcagaggtatagtgataattcgacgatctacaccgaaggtcgtgtgcggaacgaaccaacagtgcacaatagacaacaactagtgtatgcgaatacacatgcagcggcatcagtgacagtagcttacctcggtacatatgcacacgcctcgttgcgccgagcggaa

SEQ ID NO: 95638 - DNA, 1051 bp, Zea mays
  misc_feature: Ceres CLONE 1585917
  misc_feature: Encodes the peptide sequence at SEQ ID NO. 95639
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (20)..(20): n is a, c, t, g, unknown, or other
  misc_feature (45)..(45): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (85)..(85): n is a, c, t, g, unknown, or other
gtggtgggggnnnnnggngnggggacttttttgatcctcgctcanactttaggggggggggggggaaaaaaaaaannnnnnaaanaacaccccgcggtggcggccgctctagactagtggatcccccgggctgcaggaattcgtctcacccctagaaaaaacggcgtgacgaaaccaagcaacaattgagcgatcgatccatcgcctctctctctctcagcaatctatccgcgacaactaagcattcgattctccgacaacaacaagcagggcaatggcgtctgcggacatgcacatggctggcggtgcggagacggagaccttcgcattccaggccgagatcaaccagctgctctccctcatcatcaacaccttctactcgaacaaggagatcttcctcagagagctcatctccaacgcatcggatgcgcttgacaagatccgcttcgagagcctgacggacaagtcgaagctgtgattccccccccccaactcttcatccggcttcgtcccggacaagggccagcaaagaacgctggtccatcaatcggactccgggggtggggcaatgaccaaaatcccgaaccttggtcaaacaaacctccgggcaccaatccgcggcgggttcggggccacccacagggaaagttcaatggggagggccgcctttgccccgccggggagcgccccacccagaaacgatggttccaaattgaattcgggggcacaaagtttaccggggcggttcccggagcttttccttaacattaccgggcccctaaacccttccggtttcggagggggaaacaagggaggtccaatgtgggtccccccccaaccccagagcgccaccaatacgtaacccaaaaccaaagcgcaactttacccgttggggtgggagaaaagttcccccaagaggccgcggagcgggggagtccctctttcccccggggcacaacggaaaagggaacaacccccacggggggggaaaacacagccttccggggatcgggggggcccacacaagaaatatcaccaccttcttttgccc

SEQ ID NO: 95639 - protein, 67 aa, Zea mays
  misc_feature: Ceres CLONE 1585917
MASADMHMAGGAETETFAFQAEINQLLSLIINTFYSNKEIFLRELISNASDALDKIRFESLTDKSKL

SEQ ID NO: 95640 - DNA, 1170 bp, Zea mays
  misc_feature: Ceres CLONE 1585919
  misc_feature: Encodes the peptide sequence at SEQ ID NO. 95641
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (20)..(20): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (323)..(323): n is a, c, t, g, unknown, or other
nnnnaaaaaaattggtgggnacttattaaccccaacggaggagagcgggtggtgataacaagaaannannaaaaacctcggaaaacaagcctagaaaaaaacaaatgtgacgggcgctcctaaactagtggatcccccgggctgcaggaattcgtctcacccctagaaaaacccctccggacgaaatctgacctgggccacactccgctgctccgccatggcgatccgctccaaggcctggatctcgctgctgctcgcgctggccgtcgcgctctccgcccgggcggaggaggagcccgccgccgcggcggagggcgaggccntgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagccagcatgacccaccgattgttctcgctaagccccatgcttaacgaggagaaaaaaaggccggcttggttaccaagtaccaagattccagggggttcccaaaccattcaaggaaccttcccggggacccaggggggaaagaaaacatttcaggggaaataaaaaaggggcccccttagggggaaggcctggaaatgggccaattttggggggaatttaccctttggaaaaaaaaaagacacgggggttttgggggcccccttgtgcgctgtctccccaaaggggggagagaaatctccaaaaggtggccccccccccccaaaaaaagaaaaataggcggcgaaacacggggggccccccctttttaatatcggggagggtggtgacccccagagggagaaggagattcctcttcaccaccttttgggttttggggggtaaaatcccgtttcaccccctctggaaaatattttaaagagacgaggccgcacaccccgaaaatatatttttgagacaaaaacattttcttacttggtgggagagggcgctcccccaaaaaaaaaaaaaccccggagagaggcctcctgggaaccatccctaatcgtttgtggggcccacacccctgtgtggggagtgggcccaaaaaacaacccgtctccgcagacggggggggtggatatggcacagcctattggggaaaacccggcgcctt

SEQ ID NO: 95641 - protein, 94 aa, Zea mays
  misc_feature: Ceres CLONE 1585919
  misc_feature (35)..(93): Pfam Name: Thioredoxin Pfam Description: Thioredoxin
  misc_feature: SWISSPROT Homolog: EC 5.3.4.1 Protein disulfide-isomerase
  misc_feature (36)..(36): Xaa is any aa, unknown, or other
MAIRSKAWISLLLALAVALSARAEEEPAAAAEGEAXLTLDVDSFDEAVAKHPFMVVEFYAPWCGHCKKLAPEYENAAKALSQHDPPIVLAKPHA

SEQ ID NO: 95642 - DNA, 1229 bp, Zea mays
  misc_feature: Ceres CLONE 1585920
  misc_feature: Encodes the peptide sequence at SEQ ID NO. 95643
  misc_feature (52)..(52): n is a, c, t, g, unknown, or other
  misc_feature (60)..(60): n is a, c, t, g, unknown, or other
  misc_feature (61)..(61): n is a, c, t, g, unknown, or other
aaaaatataaaagaaatgaaaatttcctcgccggcgcagaggaacaaaagangatttttnngggacgaaatctatatacctggaactcaccacggtggcggccgctctagaatagtggatcccccgggctgcaggaattcgtctcacccctagaaaaagaagcttcaagagctcgattcgatcggaaccctcgccatggccgacgaggcgaaggcgaagggtaacgcggcgttctcggccggccgcttcgaggaggcggcgcggcacttcacggacgccatctcgcttgccccagaaaaccacgtcctctactccaaccggtcgggggggctcgcctcgctccaccgctactccaatgctctcagcgaaccgccgaagaccgtcgagctcaagcccgactgggccaagggctacccccgccttcgctactcgcaccttcggcctggggcgacgcggccgggggccgtcggccgccgtgccaccaagccctccaaaatcaaaccccaataaactaggtgggccctcaaagacggggccttcctgggatacccaatgaaagcccgtgtggcggaccccttccctaggacggtagggggtgtccttcccgggacaccgctaagcgccatgcaggcgcaagaagtgaggccacgtggggcgccccctaactctttagtgaaggaccatattatttgactgtatgtgataaacccgcctctcctaatagaaaatagagtcgtatactcatttatggtcgagaaagagccacacgagtaaagtgtcataagagggctgataatacgtagatagatacgacacatcaatataacgtggctcgtgaaaggcgtaacccccccgcccatataaagtaaaaataccctgcgtataagaattaagattacctcactcccatgtaatacccctctgtatatctatataataaaccgagagctatggatactttcagaccaatagatacaagggagctggataatatttgtgtgaaaattagcttttccgaaggatatgtcgtcctccgaaggcggtccttgccagaaaggttcacgatgcgttgtgttgtattattatcactaatgcgggacgagcgcggaacggtaaacaatacggcgtagtcttgtgtgatgaagtgtatttgaagtagccaccatacgccagcgctcctcggttggaacgtcaatagtgagcgcacacagcacatgtccctactctcc

SEQ ID NO: 95643 - protein, 104 aa, Zea mays
  misc_feature: Ceres CLONE 1585920
  misc_feature (2)..(35): Pfam Name: TPR_2 Pfam Description: Tetratricopeptide repeat
  misc_feature: SWISSPROT Homolog: EC 3.1.3.16 Phosphoprotein phosphatase
MADEAKAKGNAAFSAGRFEEAARHFTDAISLAPENHVLYSNRSGGLASLHRYSNALSEPPKTVELKPDWAKGYPRLRYSHLRPGATRPGAVGRRATKPSKIKPQ

SEQ ID NO: 95644 - DNA, 871 bp, Zea mays
  misc_feature: Ceres CLONE 1585924
  misc_feature: Translation starting site: 326
  misc_feature: SWISSPROT Homolog: EC 2.7.11.1 Non-specific serine/threonine protein kinase
gcggtggcggccgctctagaactagtggatcccccgggctgcaggaattcgtctcacccctagaaaaaagcgtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaacaaaggaaggaggtgggcggcaatggaggatgctatggccgcggacgggaagagcgtgctgcaagggcggtacgagctggggcggccccccccccacagcaacttcgggcgggtgcacgcggcgcgggacctgcgcacgggccgcagcgtcacggtcaaggtggtggccaaggacaagctggagcgcgcgggcatgggcggaccatatcaagcgggagatcgccttcctgaaaatggtggtcccaccccacatcgtggagctgcacgaggtgatggccacccggctccaagatctacctcgcggttcgacctcgtccgcggggggagagctcttctccccgcatcacgccccccggggcgtgttcccgggaggaattgggcacgctttttacttttcgggcagcttcttcgcccgggggtggaacttcctgcccccgggccgccgggggtgggttcctcccaagaacctggaaacctccaaaaaacctgggctcctccccagcaagggaggggcaccctcccaaagtgggccgggattcttggggggtccggcggggcgcttgggcgg

SEQ ID NO: 95645 - DNA, 869 bp, Zea mays
  misc_feature: Ceres CLONE 1585927
tggagctccccgcggtggcggccgctctagaactagtggatcccccgggctgcaggaattcgtctcacccctagaaaaacccccagcgtgcgcgctgcactccctccctgcccctgttctctctctcgtggcgacggcgacggcgacgactgggcggccgttgctgccgccctactcgccaggcgcccaggtattcttcggccccttcgccggcgacgagtgtcaccaggttcctcgtctccggaacgcagtgcaaagcagatcgatctcggcccagcaggggcctcacgacttgactcccaagactccagggctggatcgtgtttcttccagtgtgcaagcttggatctcgtaggtctggtttagaaaggggacgtgctgctctttgctgccgcatcatgcagagtgggggcgacatgaggcctgtgcacacagtgtccatacagttacgctgctggtgttgcctcgtcacccgcggaagccggacaagcctcctgttaaaaaaaaaagaaatgggctgaccggttgaccctgacctctggctttgaataacaaaaaaaggccggggcatggggttaaaccttggcccaattttcccaaaaaccgccccccaaaggaaaaaatcccccccccacaaaatttttaaaacccccccccccccccggggtgcccccctgtggggaccccccccccccccgggggtttttttcccaaaaaaaaacccccttttttttttaatcccacggggggggggggccccttttttttcccccccccccaaaaataaccccccggggggggggggccctctcttttttttttttgggggggcgaaaaaaaaaaaaaaaaaaacctcccccccgggggtg

SEQ ID NO: 95646 - DNA, 947 bp, Zea mays
  misc_feature: Ceres CLONE 1585930
ggagctccccgcggtggcggccgctctagaactagtggatcccccgggctgcaggaattcgtctcacccctagaaaaactctcgtgcaagggatctcgttctccgcggcagctggtgtttcaatcctttctcgccctgcgacaggtggttggaaacctgcgccggcgccgccaaacactaagagatgatgccttctccagtgtcttcgatggggacgaccacatacagagtattcttatcccttctctttgcttgacgtgctgagggaagccgatcattccaaccttaacctaaagctctttggctgtttgatccctcctaaatgcgaatttttctgacaacttttggggcctaaatgggcacacgaaggtcgtgttgttaggtcctcccgcggccacgcccccttcccatagcccgaagatgctcggtggttagcgagataaatgttttaggaccatgggatcggacatcagcctcgtcaataaaagtgttatgtcaaccgggcacctgtgaacatcattgggatcaacatatccgggattacagtgggcctagcaagggattggcagccctggcttttctttaacaacacccaaaacttatagtgttataaaaaaaaggtgcgccccgcgcgggggaaaaaaaaaaaatgcgtcaaccgaaacccaaaaatggtacccctggtggagcccccctctaactgtgaaggaataccccgatggtggctcccccggacatcccctctcccgcaatgggggtatctggaaggggacgcggttctgtgcccttatggtgggaggatagaaaaagaagtatcgggggctttaaccacggtcaacccgtataagctttcgcgaaaaagtaaggtagaaatcttattgtgcaagtatgatgttgcatgacaacaatgtgatcggtcttttcgtatgtgattataatggcgtgtc

SEQ ID NO: 95647 - DNA, 674 bp, Zea mays
  misc_feature: Ceres CLONE 1585931
  misc_feature: Encodes the peptide sequence at SEQ ID NO. 95648
  misc_feature (467)..(467): n is a, c, t, g, unknown, or other
ctcaccgcggtggcggccgctctagaactagtggatcccccgggctgcaggaattcgtctcacccctagaaaaagttccccaagtgcgctccctctctcgccatccatctcgtgcacgactgggcaaccgttgccgctgtcgaggtgcccaggtcttcatcggtccctcgtcagttcttctccggcccttcgccgccgacaagctcccccagctactgaagagacaggagcaaagagttaacaggagatgaatgcccctgaccgttatgagcgtttcgtcgtgccagagggcaccaagaaagtgtcctatgagagggatacaaagattgtgaatgctgcatcattcactgtcgaacgcgagggatcacactggtagggcaaatatccttccggcatggcaggttgcccccaaaaaaaccccaaagggtttttttttttggccggggggataaaaaattccctttttnccccaattttcccaaaaaaaaaaaaaaaatttttggtggggggggggcccccccccccaaaagggggggggggggtttttttccctccccccccaaaaaaaaaaaggggggggttcttttaccccccccccgggggggggggagagtttttaaagaggggggggtgtttgccaaaaaaaaaaaaaaaaaaaaaaaaaagagctgttt

SEQ ID NO: 95648 - protein, 42 aa, Zea mays
  misc_feature: Ceres CLONE 1585931
MNAPDRYERFVVPEGTKKVSYERDTKIVNAASFTVEREGSHW

SEQ ID NO: 95649 - DNA, 1045 bp, Zea mays
  misc_feature: Ceres CLONE 1585932
  misc_feature: Encodes the peptide sequence at SEQ ID NO. 95650
ctccccgcggtggcggccgctctagaactagtggatcccccgggctgcaggaattcgtctcacccctagaaaaaaagccaaccgaaaccgatggcgtcgggctccggcagcgggagcgacttctccgtggtcgtggtgggatccgacttcgcggtcgacgccggcgccgcgctcctcgcccccgccgaccacgaggtgtggcacgactgcctccccgtcctcgctgaggcggacgcctgcttctccgacctcgaggagcgccaggtcgtgcgcatccagggcacggatagggcaggccgaaccatcgtccgcgtcgtcggcaagtttttcccgggtgcgctaatcgaccacgtagttttcggttgatgcccccccccccccaccttttgttattgcccccccccctttgaacttgcagtttgttagttctgtgtgttagctttagtagggcctcccttctctctgtgacattccggctttcgggtcactcttgacttctcctttgtgcccctggttagtgggcattgcgtgtggggcccgatgccctgcggcgggaattatgggggaatattgtggttctctcactttgtttgtctgcgtccgtggcccccccgtctgtcccccgcgtgtggtgggggccgcgaggtgtctacttgcctttgggcagcaccttgcgtgtgtgtagttcctggggtagtggccagagtggggcccaatatgcgtgcctgtccacggcttactccctctctgttgcctctttagttgtggtgtacgccattgtcgttacgcctcacagttgtcactgaaatctcttgtattaccccctttttgcttggccgcgggtctggggtgtcccaccgggtgcgtatgtggcctcggcgccggtcttgcttccggaggttgtggtgacggcgtgtgctggtggccaatggtctcggtgtttccgtggtggatagacggtgtgcccactggtctcacttcctggtcgtgtgtgtcatgctgtctgcgtgtggacataggtgatggacacccgccctcctgccaa

SEQ ID NO: 95650 - protein, 91 aa, Zea mays
  misc_feature: Ceres CLONE 1585932
MASGSGSGSDFSVVVVGSDFAVDAGAALLAPADHEVWHDCLPVLAEADACFSDLEERQVVRIQGTDRAGRTIVRVVGKFFPGALIDHVVFG

SEQ ID NO: 95651 - DNA, 1333 bp, Zea mays
  misc_feature: Ceres CLONE 1585936
  misc_feature (11)..(11): n is a, c, t, g, unknown, or other
  misc_feature (17)..(17): n is a, c, t, g, unknown, or other
  misc_feature (49)..(49): n is a, c, t, g, unknown, or other
  misc_feature (54)..(54): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (1035)..(1035): n is a, c, t, g, unknown, or other
  misc_feature (1219)..(1219): n is a, c, t, g, unknown, or other
  misc_feature (1322)..(1322): n is a, c, t, g, unknown, or other
ggggggggttnccacgnccccccacaaaaaataaacaaaataaaaaccncgcanaaaaaaaannnnnnnaactggagctccccgcggtggcggccgctctataatagtggatcccccgggctgcaggaattcgtctcacccctagaaaaagtgctcctgacccggtctcggcgcctcgcaccacagccacctcctaccccttctcttcttcttctccccccttgcgaatcgtagaccaagtgcaattgcccaccctagccccgaaaccgggggccaagagcattacagggggttggtttctgcgacggctaggacgcaaagcggattcggatcgcgccgccatgccgctcgacgagctcccccacaaaaggacgtcgtcctccgaggaagttcagctcgcgccgacggattccaagtgccagagcctcaggccttcgcctattcggctcccaactcttgcaagtgtttgcgcccccccccccactctgtttcctgacgaaaatagtaaatagtagatggtcgcgggcctcaccatcaaaattgaaaatgggaatcttaccccctaactggttaatttccaccttaaaaaatccaaagaaaggggcagctactaatgtaaattttccttaggcctcaaaaccgtcccctgtgtccagggtgcgcaacttggaattgccaacgaatcacattttcatttaaaagtattatttcccgggggaggaggcctcttttaaaaaataaacactgtctctgtcgccgaaagaaacgatcccacttttataacggcacaaccgaaaaaatattaggggtcctttctaaaaaaaaggggggggaaataacacgggggctcttagttcttgtggcgcactcctcacaatagcgctcaccgaaaaggagggccccatatcaccggcctgatgaagttgtcgcggacaaaaaacccagctcttatgatatttggcttcgagaaacattattttaaagagaaagagagccatgtctctgctcaaaaagaaagtgtgcattattcccgtntgtggcggctttcgaataagatcttcgttaatatgggggcgcgtaccccagtgacgcgctgtgcggggttcgcttcgctcacatgttatatgtgtgcactctctgtgggtatatacaagtaatatgttgggtgatctctagaccgcgcatcgcgcataaaccctctctggggggaatataacanacctcagtatacacacactagtgacatgtacactatatcaaaggaaacttgttttttgtctataatgaaaaatatattatgggggaatgtattgtgctgctcnccacccccacg

SEQ ID NO: 95652 - DNA, 833 bp, Zea mays
  misc_feature: Ceres CLONE 1585939
  misc_feature: Translation starting site: 179
  misc_feature: SWISSPROT Homolog: EC 3.6.3.14 H(+)-transporting two-sector ATPase
ctccccgcggtggcggccgctctagaactagtggatcccccgggctgcaggaattcgtctcacccctagaaaagtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtacaggactgtatctggtgtggccgggcctctggttatcttggataaagtaaagggcccaaagtaccaagaaattgtaaacatccgacttggagatggcaccactcgccgtggtcaagtccttgaagttgatggagaaaaagctgttgtgcaggtttttgaaggaacttctggaatagacaacaaatacacaaccgtgcagtttacaggcgaggttttgaaaactcctgtctcactcgatatgcttgggcgcatttttaatggttctggaaaacctattgacaatggccccccgatattacctgaagcctacttggatatctctggaagttctattaatcccagtgagagaaccttccagaagagatgatccaaactgggatatccaccattgatgtgatgaactccattgctcgtgggcaaaaaatccccttattttctgctgctggactccctcacaataaatttgctgctcagatctgtcgtcaggctgggcctggtgaaaacatggaaaaaaggaaagcatgcaaagggtggtgaagatgacacctttgctattgggtttgctgctatggaagggaaatggaaaccagctc

SEQ ID NO: 95653 - DNA, 1179 bp, Zea mays
  misc_feature: Ceres CLONE 1585941
  misc_feature: Encodes the peptide sequence at SEQ ID NO. 95654
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (31)..(31): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (1107)..(1107): n is a, c, t, g, unknown, or other
  misc_feature (1179)..(1179): n is a, c, t, g, unknown, or other
aaaagagaataannnctttcccccaaacccnaaaaaaaaaaaaatacacaaaacaannnnnnnnnnnttttnnnnnnaaaactggagctcaccgcggtggcggccgctctagactagtggatcccccgggctgcaggaattcgtctcacccctagaaaaagaagccgcagccacgccccacgcccccacaccaagccgtatcgtcttctccctcttgtccggttcgggtggtccgcggtcggggtgagtgagtgagcagctttgcttctccatctccccattcccttccctcccaagcccccccggcccggcggcggtacgtgaccctgacgccgcaacgctagctagctcgccggaacggcaggtggcggcgcgcgacctgagagcacagcagcaccggaccgggtcagggcggccaccggcagataaaatgggccgggacaacatctgtggagaagggggcccgcgcggggggtggctgctccccccgggggacaaaaaagcgtgcctcccacgccccccaaggggccccgggtaccccaccccccgctgggaagggcattggaagaaaggggcccccgggggagaaagctccgtcctaaggtacagcctgccgttcttgcgaacggggccagcggggaaagttaaaacaaaggccggggatttaaccctctggcctcaccggcgagtaatattttgaggaaactccccaggcgttccccccgttgtacatttacccgcgcgccgggggggtggaatttcgccaagtggagaggccctccgccacgggggtcgcgcgacccgccacatattttgtggtagcaagcagacaaggcgtcggccacgccggccaggccttactaaggaggtgggggctaagacttcacctggggggcgggctcttcactggaggtccggatggggtagaaatggccctctttggaggggcgccaaagagtctgaccgacagcgtatgtcctgtgagatacacgagcgaactgttcctccacttggggcgtatatggagagggcagcctggagatgtgaatgtgtgatggaatctaagaacaagcatcgtcgagtacatgacaccgctgggtggagganccatgtgaccccttatttacccaatagaggatgggtgattgtgtaagccctctcctgcatagccacgatatn

SEQ ID NO: 95654 - protein, 89 aa, Zea mays
  misc_feature: Ceres CLONE 1585941
MGRDNICGEGGPRGGWLLPPGDKKACLPRPPRGPGYPTPRWEGHWKKGAPGGESSVLRYSLPFLRTGPAGKVKTKAGDLTLWPHRRVIF

SEQ ID NO: 95655 - DNA, 828 bp, Zea mays
  misc_feature: Ceres CLONE 1585942
  misc_feature: Translation starting site: 367
  misc_feature (592)..(592): n is a, c, t, g, unknown, or other
ctccccgcggtggcggccgctctagaactagtggatcccccgggctgcaggaattcgtctcacccctagaaaaactcgcccccccgtgccctcccccgtcccactgacggtggcccccaccgcccggccccgctcgtcggcgagcgccccttccccacgctgcaccgctgtcctgggcttcctgcccaagagatccgcccgactccggtcgctcggaggccggcgagccgcgcgtgctgggcgccgggatgcaggcggccggcgccagccggtggcccggatctcgctggcggcgcgtctcggcgagaggagacctctgaactttctgacctcaagtcctcgattttgtcatagatcagacaaataatggaagagttacaagattgcaactcaagaagcctggttgcccttccgggctctttggttctgcgtctctttaggctgtttggccagcaggatcagagttcatggcagaagtacatactagcttactttctgttggtcaggaatgagtacttctctggggagtcgaagaacactcagatgtgttctgtgatatttcagaattagatttctttctatatgctacagnattggatagtgaagaactttggactgaggagcagaaacccattacgaaggctcaatcaggaggtgatttcagtggcacagatccgatgattgctacttccccggccttcatgatgatctgtctcaagactgccttgcttggggcagcagatcagactacccttcccctttctgtctgaacaaaagattcaatttgttaattacaagtggatatttgtccagactgcggaagaaatt

SEQ ID NO: 95656 - DNA, 863 bp, Zea mays
  misc_feature: Ceres CLONE 1585945
  misc_feature: Encodes the peptide sequence at SEQ ID NO. 95657
  misc_feature (664)..(664): n is a, c, t, g, unknown, or other
  misc_feature (679)..(679): n is a, c, t, g, unknown, or other
  misc_feature (682)..(682): n is a, c, t, g, unknown, or other
  misc_feature (686)..(686): n is a, c, t, g, unknown, or other
  misc_feature (687)..(687): n is a, c, t, g, unknown, or other
  misc_feature (689)..(689): n is a, c, t, g, unknown, or other
  misc_feature (691)..(691): n is a, c, t, g, unknown, or other
  misc_feature (697)..(697): n is a, c, t, g, unknown, or other
  misc_feature (698)..(698): n is a, c, t, g, unknown, or other
ctggagctccccgcggtggcggccgctctagaactagtggatcccccgggctgcaggaattcgtctcacccctagaaaaagacactgcttccgttccgtcgcctcgccgccgcgacgagacgaccccgcccctacaaatacaccgccactttggccgcgtcagccgccgccacttcccagatcccgatgtcccgcgcccagattccactcccttgttgcatcgctactctgttcccagctcggggcctctgacgaggcccgaggcgcaggcgccaacctcccggcccgccctagggtttggggctgatcgatccggctaggtcttggcgggagctgctccaatgggggatcgggaggaggacgaggagctccagatggcgctccgcatgagcctccagggctccccgccggcgcagcctgagcccaagcgcagcaagcccccgccccccgctgcggagtctccggaggcagaggcgcgccggaagcagcgcgagctcatggccgccgccgccgagaagcgccgccgcggtgcagcctcaccggcctccgtctcggtggcgcggtctcctctgcagccagtggtggtggagccagcccccgccccggaagtcaccaaagagcaggtggaggagccggaacaagctggcgtatctatggaagaacnaaggaggtggtggangangaannananaaaaannggggggggattggcctccagaaggtcctgagaatctatgggcaatggggggtttggggaaagggggtttaaaaaggcgggcttgggccccatgggagtaatccagggccataggggtttagcctccgaaccccgaaaacacccttggggaactttggaaaaaaga

SEQ ID NO: 95657 - protein, 128 aa, Zea mays
  misc_feature: Ceres CLONE 1585945
  misc_feature (108)..(108): Xaa is any aa, unknown, or other
  misc_feature (113)..(113): Xaa is any aa, unknown, or other
  misc_feature (114)..(114): Xaa is any aa, unknown, or other
  misc_feature (115)..(115): Xaa is any aa, unknown, or other
  misc_feature (116)..(116): Xaa is any aa, unknown, or other
  misc_feature (117)..(117): Xaa is any aa, unknown, or other
  misc_feature (119)..(119): Xaa is any aa, unknown, or other
MGDREEDEELQMALRMSLQGSPPAQPEPKRSKPPPPAAESPEAEARRKQRELMAAAAEKRRRGAASPASVSVARSPLQPVVVEPAPAPEVTKEQVEEPEQAGVSMEEXRRWWXXXXXKXGGGLASRRS

SEQ ID NO: 95658 - DNA, 1183 bp, Zea mays
  misc_feature: Ceres CLONE 1585946
  misc_feature (49)..(49): n is a, c, t, g, unknown, or other
  misc_feature (57)..(57): n is a, c, t, g, unknown, or other
  misc_feature (75)..(75): n is a, c, t, g, unknown, or other
  misc_feature (92)..(92): n is a, c, t, g, unknown, or other
  misc_feature (93)..(93): n is a, c, t, g, unknown, or other
aaaatatattaaaaaacaaaccaccaccctcccccatttcatttttctntttatccncaaaacaacaaaaaaaanaaaaaaacacaccaaannacaatcaaactccactcggtggcggccgctctagaatagtggatcccccgggctgcaggaattcgtctcacccctagaaaaagtgctcctcacaccggacctcggcgcctcgcaccacaaccacctcctaccccttctcttcttcttctcccccccttgcgaatcggaaaacaaatgcaatttgcccaccccaagccccagaacccgggggcccaagaacattaaaagggggttgggtttcctgccaaccgccaaaaaacccaaaacggaattccgaattcccccccccctattccgtatctaaaaaagacccccccaaaaaaaagggcccccccttcccttccaaaaaaaatttcaaactccccccccccgccagaattctcaaaattttccgaaaacccctaattccttttttggtggcggacggccgggggggggggggggggtgggggggggtgcccccaaccctgtgggtggtgtgccccccccccccctaaaaaagaaaaccaaatattatgtgttaaaccccccccccccccccccctttggtgtgtgggaaaactattgtctttttttgttgccccccccccatattcttttgttgcaaaataaacataacaacagggggcggacgcaccataataataatttttttattccataaataaactaacctcttctgtggagccatccaatgagaaaagaaaaacacattcttttcttatacattattacccccaacaagtatatataaaagaataaaaatccattcgaaagaacattattccctattttccgacacgcccggccacctctaattaaatagagattcacttggtgttttgttcaacaatagcagaatgatagacaacgagtgagagttggatagaagggaaacatcaccccacacatattatatgaaaaacaatatcgccacgcttgatgtttgagccgttacccctcatacaaataacaggtaatgctgtgccgcatacaactaccacaatgattattgtgtaacaactaactagtacactatccacactctcaatattaaatgtcgttgaatctagatataacagaacatcaa

SEQ ID NO: 95659 - DNA, 946 bp, Zea mays
  misc_feature: Ceres CLONE 1585947
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
nnnggtgtggnnncnnnnntctatttccccgcgagcataatttcccccaccgcacaatactaaaaaaaannnnnnnnnnnnnnaactggaactccccccggtggcggccgctctagaatagtggatcccccgggctgcaggaattcgtctcacccctagaaaaaagctagcagtcgtcttgcattgtagctagtccattgctctcatcttctcttcttcctccagtcctcccccctttcccctcttcggcctctctcgctcagctcgctcttcattaagctcacgtcgttcctcccttcttcctcttcttcttcttatccgttgttcaattcgttcagctagccggccagagatcgagcatcatctccatcatcgatcgatccatctcatctctttctcttcttctattctatgtcgtcgtcgtcccagattagatcgaagctgctagcagtctatccagtctctagctagctagatcaagccccccgacgatataatataatacaagctagctacgtgcttattgctttattagtctagaagaataatctagatatatacgatcgaacatatatctcgatctccgatccaccgatacacacccggccctatccatgcttgaggtgtcgacgctgcgcggcccctactagcagcggcaagcaagggcggaagcaccactgcagccggcgggcagccagccttcgtccggcgaaccaaccattgtggtggttcccccaaagtcccggggaaatggcttccgccaaggatgggaacgaacaaccctccctggaactacaatgcagactttcaagctggcgaaaggttgcccctttcttttcaaacccctgaaagggggaaaaaatcccctccccccgaaacactggggagggttatgaaacacccaccgggagaacctcccctctccgcccaaagagttctctccgga

SEQ ID NO: 95660 - DNA, 1062 bp, Zea mays
  misc_feature: Ceres CLONE 1585956
  misc_feature: Encodes the peptide sequence at SEQ ID NO. 95661
  misc_feature (54)..(54): n is a, c, t, g, unknown, or other
  misc_feature (58)..(58): n is a, c, t, g, unknown, or other
  misc_feature (61)..(61): n is a, c, t, g, unknown, or other
  misc_feature (71)..(71): n is a, c, t, g, unknown, or other
gagggtggggtgatgggttaaaaaaaattggaaggatgggccagtggggtgaanaaanaangagtaaaatntaaaactggtgctccccgcggtggcggccgctctagaacagtggatcccccgggctgcaggaattcgtctcacccctagaaaaaaaccgcggtcggcggagctctcgctctcgcttcgttgaaggctcccctcttcctccaagtataaaggagcctccttttcctttgccggtgctgtgccgcgtgcctgccattctcctcccgagccttcttccttcacgcctctttgccgcagcgcgggtgggtcgtcgtttgctgtttgttccgagatcaccggagccagccagccagccacagccagccagagtcagagatgaggtggtcggcgttcctgtgggaggccacgtccggccgccgcccgggggtttccaacctcctcctcgtcgtcgcagccgccagtagcccacgtctcgtcgcgtacgccgactccggatcagatgctgctgtccagcagccgcagtgttcctccgaggaagaagggtcgtgggtgcttggggactgggttgggggcggccactacctttccctgaggaaacctccgattagcccgacctggtattgatgttgccgggtttatattcctccttcgggaacctacctttcggggtgtgcaacggcccgcttgctgccccagaaattgttcaaccttccctgggagaaccaagtttgtgaaccctcttagggagaagaacttgtggtgggaaagaccctgactcccacaaaagggggtctttactggatgaaaagaagaggtgttgggaaggatatgtgcaacgtttctttggggaaaactcgggaaagtgggtttccccaaggattgtggtccccggcccgagggctaaaaaaaaaccccatttgcagcggtaccagagaaagggtgtgcgggaaaaaaatccttatgaggggggatatgggcccgaacttcctttggacttggagttattgaactttcttgtgtgtgtattacaattgttcgggggcttagggacaa

SEQ ID NO: 95661 - protein, 82 aa, Zea mays
  misc_feature: Ceres CLONE 1585956
MRWSAFLWEATSGRRPGVSNLLLVVAAASSPRLVAYADSGSDAAVQQPQCSSEEEGSWVLGDWVGGGHYLSLRKPPISPTWY

SEQ ID NO: 95662 - DNA, 853 bp, Zea mays
  misc_feature: Ceres CLONE 1585974
  misc_feature: Encodes the peptide sequence at SEQ ID NO. 95663
ggagctccccgcggtggcggccgctctagaactagtggatcccccgggctgcaggaattcgtctcacccctagaaaaatccgcatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaaagtcaccgaaccgccttgtcgtcgacgaggccaccaacgacgataactccgtcgtcgctctgcaccctgacaccatggagaggctgcagctcttccgcggcgacaccgtgctcctcaagggtaagaagaggaaagacactatttgcattgtccttgcggacgaaacctgtgaggagccaaaggttcggatgaacaaggttgtccgccagaacctaagggtgaggcttggtgatgtggtttctgtccaccagtgccaggatgtgaaatatgggaagcgtgtccacattcttccaattgatgatacagtttgaagcattacagggaaacctgtttgatgccttccttgaaaccatatttccctagaagcatacaggcccgttgaagaaaaggagacctttttccttgtcaaaggagggattgagaaagtgtggaaattcaaaggtgatagaagaccggatcccggctgaaatattggtatccggtggcgcccagaataacggaaaatatttttggggaggggggaacctatttaaaaagggagggaataagggaacccccctggaataaaattggggtataaaataaaggttggg

SEQ ID NO: 95663 - protein, 131 aa, Zea mays
  misc_feature: Ceres CLONE 1585974
  misc_feature (30)..(116): Pfam Name: CDC48_N Pfam Description: Cell division protein 48 (CDC48), N-terminal domain
MASQGEPSASASDPKEKKDFSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTV

SEQ ID NO: 95664 - DNA, 839 bp, Zea mays
  misc_feature: Ceres CLONE 1585975
  misc_feature: Encodes the peptide sequence at SEQ ID NO. 95665
ctccccgcggtggcggccgctctagaactagtggatcccccgggctgcaggaattcgtctcacccctagaaaaatccgcatctctctctctcgcgcgcgccgcccttcccagcgccgtcggctgccgctcctcccctccaccgccgcctctgctccgcccgtcctcgcgccgtcgcgaccgctgcggcttcgtctctccccattgtctgtcccctctcaacgcactctacgacggaccgatgacttgacggatctgggggtttgtctagggtgggtgaacggaaggggatggagttcacggagtcgttcaagcagacgggcccgtgctccttctcccccgactcgcgcttccttgctattgccgtagactaccgcctcgtcgtccgcgacgtactctcactgaaggtggtacaattattttcatgcgtggacaagataagctctgtagaatgggcaccagattcagaatatattttatgtggactttacaagcgacccatggtgcaagctgggtcattgagccaaccctgatgggaccctgcagatggatgaaggtccagcagggattgcatatgctcgctgggagtctgacagtcgtcatatattaactacatctgagtttcaactccgtctcaccggggggtctctccgaaaaacaaggatgcgtcactgtccaggggccaaaaacagggtttctaaaggggtttccttttaccaaaaaaggggaaagttggcttgcaatttggaccaaaaggggattgggaagggatacaccccatttttcctttccgggggccccccttggggaaaaaaaggaacggcgctttggcctttggaca

SEQ ID NO: 95665 - protein, 80 aa, Zea mays
  misc_feature: Ceres CLONE 1585975
MEFTESFKQTGPCSFSPDSRFLAIAVDYRLVVRDVLSLKVVQLFSCVDKISSVEWAPDSEYILCGLYKRPMVQAGSLSQP

SEQ ID NO: 95666 - DNA, 1307 bp, Zea mays
  misc_feature: Ceres CLONE 1585976
  misc_feature: Encodes the peptide sequence at SEQ ID NO. 95667
  misc_feature (1)..(1): n is a, c, t, g, unknown, or other
  misc_feature (74)..(74): n is a, c, t, g, unknown, or other
  misc_feature (75)..(75): n is a, c, t, g, unknown, or other
  misc_feature (1046)..(1046): n is a, c, t, g, unknown, or other
nttttttggtggtttttttaccttttaaaaaaaaaaaaaaagtataaacaatagggtgtgtgggtgaggaaaannaaaaatggacctctccgcggtggcggccgctctagaactagtggatcccccgggctgcaggaattcgtctcacccctagaaaaacggcagtccgcaccgcacacacacgcacaggcagcagcacagcgatctgccttctgctgtgccccgcccccatccagcccagagcagcagcgcgcggtgccgggcggtaacagcagctggtcggtcatcaggtctctgggcctccacctcctccttccccctctcaaccctccccgtgtcgcctcctcccgaatcctcacacgtagccccgcgcgccacctcgctgccggccgccggcacacagatttagagagagacagagagagactgagagagaaagagggaggggaagggaaaaagaccagaacgagaggggaagatgggtgcccccccccccccccaaaacaaatggcgggggggggaaaaccggaagtccctccctcgaagccctggggaaatttaaaggggccggggccggggacccggtgttggcccaaccaacccggggccggcttggggggagcgccgcccggcccaatgaattcccttaaggtgggcccggaaagtttttaaaacagaaaaccggggacttggattagtaacccctcttgaggaactgtaggccccccccccagaagagagaaaccgtcgggggtgaagaaagagaccttaaacacctccgtgggaacacggggggtggcacacccacgtacgatagtgccgccaatctttcttggtgggggaacggggaaataaaacacgtcacccctggggagagatgacaacagagtcgctcaccaaaacacggcgaatggtggggttacaaaaccccaaaagagacacgtttttgtaataggggggacgggaagaagccccagcacgcgctcgtttagcaaagtgagcgacgcagacgtgtgcgccgctattaaaatgttgagtaggggggngggggcttggttgtgaaggtgacaatacggagagaaaaagttgccttcttgtgtgaacccacgcgagggccgcgaggagctactcctcgtcaacagccaacacacgttcgcgcgcattcttgtgtttacgcacgcggggacgcgatatcaaccaagagttaactcgatgtgtgaggcgcgctgtttaccggatgtccccctgaaacaaataataattccgtccgacacgtgctgtccatttacgagagggggggatactcg

SEQ ID NO: 95667 - protein, 54 aa, Zea mays
  misc_feature: Ceres CLONE 1585976
MAGGGKPEVPPSKPWGNLKGPGPGTRCWPNQPGAGLGGAPPGPMNSLKVGPESF

SEQ ID NO: 95668 - DNA, 803 bp, Zea mays
  misc_feature: Ceres CLONE 1585977
  misc_feature: Translation starting site: 239
  misc_feature: Pfam Name: TFIIE_alpha Pfam Description: TFIIE alpha subunit
  misc_feature (711)..(711): n is a, c, t, g, unknown, or other
  misc_feature (749)..(749): n is a, c, t, g, unknown, or other
ctggagctccccgcggtggcggccgctctagaactagtggatcccccgggctgcaggaattcgtctcacccctagaaaaatatctctcgctcgccctttccccttcgatgcaactggtgtggcggcggcggctgcgggcggcgtgatacggcaccccctcctcccgcccccttatgcaagcgggcaatcagaactccgatcacccgcacgccggcacgccagtgtcgtcttcgcaaccatgaactccatcgagcctttcaaccggctggtgaggctggcggcccgcgccttctacgacgacgtctccatgaagggcgacaaccagcccaagacttcccgcggggacaaccgcggcatggccgtcgtcgtcctggacgcgctcaccagacgaccgtgggttcggggaggaagatttggctaaagcattgaagctccactcgaaacagctgcgtcgcattctccgtttctttgaagaggagaaactagtcacgaaggatcatcgaaaagagtcagcaaaaaaacgcaaaagcacataatgctgcagctgctaatgatggtcaaccattgctagggagggagaagagaaagtaaagctgcacacacattcatactgttgcttggattatgctcagatctgtgatgttgtaaggtaccggatcaccgcatgaagaaaaaattggaggatgaattggacagcagaatacaattcancactatatatgtcctagctgcaataaaagatactcagncttcgatgcactacaactggtaagctccacggatgagtacctccattgtgaacc

SEQ ID NO: 95669 - DNA, 833 bp, Zea mays
  misc_feature: Ceres CLONE 1585986
  misc_feature: Encodes the peptide sequence at SEQ ID NO. 95670
ctccccgcggtggcggccgctctagaactagtggatcccccgggctgcaggaattcgtctcacccctagaaaaaaatcacaacctcgcatcctcttctgtcacgtccccagctcttcgttcgttcccctctcgccgcccgtctcccccgcggtcgaggagccgccaatagcaaggagagggtttcctcctccctccacggctccaccgagccccccgatccctccgccccaaatcccacacacccggttggccaccgcctcgccatggatttggatctgtggatctccaaggtcaaggagggtcagcacctcgccgagcacgagcttcagtccctctgcgaatatgtgaaggagatcctcatcgaagagtcgaacgtgcaaccagtgaacagcccccccacggtttgcggtgatatccatgggcagttccatgacctaatgaagctcttcgcgacggggggccacgtcccagagacgaactatattttcatgggtgattttgtggaccgtggcttcaatagtctagaggttttcaccatcctattgctactaaaagcgaggtatcctgcacacattacccttctgcgtggaaatcatgaaagtaggcagttgacacaggtgtatggttttctttgatgagtgtcagagaaagtatggcaacgccaatgcatggaggtactgcactggagtttttagattacataacgctttcagcaaatcttaaatggccaagtcctcttggggtcctgggggggcctttcctcccgaaagttcgccacctattgaccccagttccgaacaccatttgttccgcccaattggggaaaattcca

SEQ ID NO: 95670 - protein, 123 aa, Zea mays
  misc_feature: Ceres CLONE 1585986
  misc_feature (43)..(120): Pfam Name: Metallophos Pfam Description: Calcineurin-like phosphoesterase
  misc_feature: SWISSPROT Homolog: EC 3.1.3.16 Phosphoprotein phosphatase
MDLDLWISKVKEGQHLAEHELQSLCEYVKEILIEESNVQPVNSPPTVCGDIHGQFHDLMKLFATGGHVPETNYIFMGDFVDRGFNSLEVFTILLLLKARYPAHITLLRGNHESRQLTQVYGFL

SEQ ID NO: 95671 - DNA, 1210 bp, Zea mays
  misc_feature: Ceres CLONE 1585987
  misc_feature (1)..(1): n is a, c, t, g, unknown, or other
  misc_feature (11)..(11): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (45)..(45): n is a, c, t, g, unknown, or other
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (73)..(73): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (90)..(90): n is a, c, t, g, unknown, or other
  misc_feature (558)..(558): n is a, c, t, g, unknown, or other
  misc_feature (559)..(559): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (887)..(887): n is a, c, t, g, unknown, or other
  misc_feature (888)..(888): n is a, c, t, g, unknown, or other
  misc_feature (892)..(892): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (908)..(908): n is a, c, t, g, unknown, or other
  misc_feature (911)..(911): n is a, c, t, g, unknown, or other
  misc_feature (914)..(914): n is a, c, t, g, unknown, or other
  misc_feature (919)..(919): n is a, c, t, g, unknown, or other
  misc_feature (941)..(941): n is a, c, t, g, unknown, or other
  misc_feature (953)..(953): n is a, c, t, g, unknown, or other
  misc_feature (955)..(955): n is a, c, t, g, unknown, or other
  misc_feature (956)..(956): n is a, c, t, g, unknown, or other
  misc_feature (1210)..(1210): n is a, c, t, g, unknown, or other
naagggggaanaaaaaaanncngcaccaaaaaacaaaaaaaaaanccccccncnnnnnnacaancnncccccnannnaacatcaccacantggccgccgctctacaatagtggatcccccgggctgcaggaattcgtctcacccctagaaaaagtacggacaaggggaatccgactgtttaattaaaacaaagcattgcgacggtcctcgaggatgctgacacatgtgatttctgcccagtgctctgaatgcaaagtgaagaaattcaaccagcgcgggtaaaacggcgggagtcctatgactctcttaaggagccaaatgcctctcatctattagtgcgcgcatgatggattaacaagattccactgtccctgtctactatcctctaaccacacccagggacgggcttggcgaaaccggcgggaagacaacctgttaacttgactctagtcgattttggccccggcttgaaaagcgtacaaaaattgggagccttccgggcccaagtgaaaatacccaccactttttaacggttatttttgtcctggggggggcccnncttccaaaatcagagggaaacccacgccccctcccttttttgagctccaaaaggtcccgggacttctgagcgggggcccatatttacccgggggggggaaaaaaccttttgggaccatgggggggaggaaaattttttggggctatgggggtggggtgtggtgacaaattcctggtggctaacataggtccgctgttgtgctgccctggtgggggagtatcgccactgaaatatgaaggagtagagcaatcattatgttattgccagaatatgagccggggaaattagcctgtgttggggtggtttagggaaatggaannnncccggnntgtncccnnnnnaaaaaaanaanaanaaaanaaaaaaaaaaaaaaaaaaaaanaaaaaattatanannaaagaactatataacatattagatacacacaccaccgaaataaaataaatcaaacgtgtcatcagtaactagcacaaggctgggtttttgtgtaaaactacggccattgctgtgataatgtggatatcgctctcaggcgatctgcgcccgagggaagtgaagttaatctcgtgacgtggattgttaacgtgagttgcatgccgggagtacccgcgaacgagcgacttagctcactataaaaatgtatatgcgcn

SEQ ID NO: 95672 - DNA, 818 bp, Zea mays
  misc_feature: Ceres CLONE 1585994
  misc_feature: Encodes the peptide sequence at SEQ ID NO. 95673
ctggagctccccgcggtggcggccgctctagaactagtggatcccccgggctgcaggaattcgtctcacccctagaaaaaaaaaggtgacggaaatagtgaggagcggagaacaccggaatgatccatcctcttgtgctttccctgcccttccccgctataatatcgcgccctcgtcgccatcgtcaccacaccaccactccctcactgccctctcactcccgatccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaaagatgctgttcagatcataacaaaaatggctgctgcccatgggagtaagacgtgtttggggttggacaaaacagtctcatgtctactccctgctggatctgcctgtcatccctggaaagaattggtgcaaaatggatcaaaaggctactgggtgccctttcatcttgaacgccgaggccataaaacccaggggggtccttaccggaaggaacttttgggtaatcaaaaaacaaaaggggggggaaaatgggtgggaaccctggccccctcgggaatccccggttacccggaaaaaaa

SEQ ID NO: 95673 - protein, 84 aa, Zea mays
  misc_feature: Ceres CLONE 1585994
  misc_feature: SWISSPROT Homolog: EC 5.4.2.2 Phosphoglucomutase
MGLFTVTKKATTPFEGQKPGTSGLRKKVTVFQQPHYLQNFVQSTFNALPADQVKGATIVVSGDGRYFSKRCCSDHNKNGCCPWE

SEQ ID NO: 95674 - DNA, 781 bp, Zea mays
  misc_feature: Ceres CLONE 1585995
  misc_feature: Translation starting site: 134
  misc_feature: SWISSPROT Homolog: EC 1.3.3.4 Protoporphyrinogen oxidase
  misc_feature (645)..(645): n is a, c, t, g, unknown, or other
ctggagctccccgcggtggcggccgctctagaactagtggatcccccgggctgcaggaattcgtctcacccctagaaaaagtcgtgtcatccactccgccgcacaggcgctcagctccgcaacgccgtcggaaatggtcgccgccaccgccatggccaccgctgcatcgccgctactcaacgggacccgaatacctgcgcggctccgccatcgaggactcagcgtgcgctgcgctgctgtggcgggcggcgcggccgaggcaccggcttccaccggcgcgcggctgtccgcggactgcgtcgtggtgggcggaggcatcagtggcctctgcaccgcgcaggcgctggccacgcggcacggcgtcggggacgtgcttgtcacggaggcccgcgcccgccccggcggcaacattaccaccgtcgagcgccccgaggaagggtacctctgggaggaaggtcccaacagcttccagccctccgaccccgttctcaccatggccgtggacagcggactgaaggatgacttggtttttgggggacccaaacgcgccgcgtttcgtgctgtgggaggggaagctgaggcccgtgccatcccagcccgccgacctcccgttcctcgatctcatgagcatcccagggaagctcnaggccggtctaggcgcgctttgcatccgcccgccctctccaggccgcaaagagtcagtgaagaagttcgtgcgcgcaacccccgggctgaatcctggagcccctattgacccttcggccaggggccaagcggggaa

SEQ ID NO: 95675 - DNA, 912 bp, Zea mays
  misc_feature: Ceres CLONE 1585996
ctggagctccccgcggtggcggccgctctagaactagtggatcccccgggctgcaggaattcgtctcacccctagaaaaacctcacctcgccttcacctcagctcacggcctcacccgtccacccacccacccgcctcgcctccatccacagcgaccacgcccatcttcgctctgtccgctcacccccacctctccgcccccgtctccgtccgcacccgtccgcctccgacttcccgtggcccagccggatccggagccgaactcgaccctgtcagggaagagagcccgaacgcggcgggcgggagggctctttttagcctgccccgcctgaggcagccgccccagggccaattcgccgaagcgccctcgtttcaacccttcaaccggcggggaaggttttaccgcccgttgggacctccgggggggggccaaaaaaatttaaacaaaaagaggggggggggggaaaaaccttttttgaaaaacgcctccccctttaataggggaaaccccgggaaaaaaaaaattcggggtaaaaaaaaagttccccccaaaaaaaaaaggggggtctcaaaaaaagggggggaaaaaaggggtgtgtccccccccttttcccgggggaaaaaaacaccccccctttaaaaaccccccaccccgccgggagatttttttctcccccccccttttttttaaaaaaacacttctttgggagaaaggggggccccccccaaaaaaaaaaaaaataaattggggggggggtcccctcataaaaaaaaaatctttgtggggggggggcgcgccccccccccggcattatttcacgctgggaggggaggggggccccccccctttttgttgaaaaaaaacccccccgaaggaaaatataaacccccccccccccctctccggagaaa

SEQ ID NO: 95676 - DNA, 1119 bp, Zea mays
  misc_feature: Ceres CLONE 1585998
  misc_feature: Encodes the peptide sequence at SEQ ID NO. 95677
  misc_feature (29)..(29): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
gttggggggggggggggggtttttttttntttataccttttgtgaaattttaaataaaggcgggggttttnnnnntaaaagctgggagctccccgcggtggcggccgctctagaactagtggatcccccgggctgcaggaattcgtctcacccctagaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccgggcgtgcggacgccccgtgatcgtgcgccttctccacccggtgatccacggaggcggggggtccccctgaaaacgaatccggcggaccccgccgcggggttccccccgtgtaaaattctaacacccccgccgagggggaaaactgggggaacctggcctgggggcaaaacaaaactttccccccgatgcctttctattaatttcccggccgagacgggggatttctcaaatgtttccccgcccggaaccgtgggaaatctccaacgcccggttttcacaaggccccccaaacacccggggcgggtgtctggccacacgttgcacacgggtaattataactgcggctcggggtgggggtgtccagaaaactctcccggtgtgtgcgctacaccctctccccccgaaagaaagacccttgtgaatcaaacccttttctattttttgttccccctcttttccaaaaacaaaacaggtgtgggccagtttgcccggttccccaaaatataccacctccacaactttgtgtaaaaaaaggtgttctctccacgtcttattaaaaaccccgatctcactcccgttttcccggtagaaaacccacggatggggg

SEQ ID NO: 95677 - protein, 99 aa, Zea mays
  misc_feature: Ceres CLONE 1585998
  misc_feature (18)..(100): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGRADAP

SEQ ID NO: 95678 - DNA, 885 bp, Zea mays
  misc_feature: Ceres CLONE 1585999
  misc_feature: Encodes the peptide sequence at SEQ ID NO. 95679
  misc_feature (380)..(380): n is a, c, t, g, unknown, or other
  misc_feature (756)..(756): n is a, c, t, g, unknown, or other
aaagctggagctccccgcggtggcggccgctctagaactagtggatcccccgggctgcaggaattcgtctcacccctagaaaaatatggtgccgtgcgtttcatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaanttcggctgggaagaaccgtccgaggacgactggatcggcgtcttctctccgtctgaattcaactcgtcggctacatgtcccgaaccatgggcagcagaaggaaacctatctctggccagcaaccatcaggtattcggttcgccaactactctgggaaactacatcttacgggggcaagggaagcatccgggctgcaagctcatcaaaccagggctccggactttttcccttcggccctctttcaccgggggggcctccggcaaccccaggggttgattcccggggggcccggaaccccatattcgtttccagaaaacccccagggggccccggggtttccccccccccttgggggccaggggaaccttcccccccnaaccaaaattgtaccggtggaagtggggaaaccagcgcggcttaaccccctttcgaatagaagggcggtaccccgcgttcctgtgggaaggtgggggcgcccccctgtgttgccgcccgacgggggcgg

SEQ ID NO: 95679 - protein, 160 aa, Zea mays
  misc_feature: Ceres CLONE 1585999
  misc_feature (69)..(69): Xaa is any aa, unknown, or other
MAVALLAALVASAAMLAGTASASPAEGIQPLSKIAVHRATVEMQPSAYVRATPSLLGEQGEDTEWVTVXFGWEEPSEDDWIGVFSPSEFNSSATCPEPWAAEGNLSLASNHQVFGSPTTLGNYILRGQGKHPGCKLIKPGLRTFSLRPSFTGGASGNPRG

SEQ ID NO: 95680 - DNA, 1120 bp, Zea mays
  misc_feature: Ceres CLONE 1586003
  misc_feature: Encodes the peptide sequence at SEQ ID NO. 95681
  misc_feature (9)..(9): n is a, c, t, g, unknown, or other
  misc_feature (14)..(14): n is a, c, t, g, unknown, or other
acttttttntgttngggggtttttttgttattctttttttcttttctgcacgaccaacggatttaatatgtgtttttttttatactggagctccccgcggtggcggccgctctagaactagtggatcccccgggctgcaggaattcgtctcacccctagaaaagcaggcgtacgaacacgaagctcccctggacggagctctatcgcgtagtacggagtccacagggcgaggaaagatgctagcaggcgcccccaccggcgatgcgggccccagctccggcgctgggagcaacccacccactcggccacggatggaccccggggcggcgcagccggagatcatgcgggcggcggagaaggacgatagctacgcagcccacgtcacggaggcatgccgcgacgcatttcggcacctcttccgtaccagggttgctgttgctttacagaatgaaataaaatggctttggtcaggcccttttactacttgctaacaactgggttcaaggccagcaaaacacttgggggaaagaatattggtgatatattcttcaggttgtcaaccttttgcattgggactttcccaccttactcccttgcttagggcggaatttctaattccatttttggtagccaaaaactaactgggggccccctaccctttgggctggaacaggggattcaagccttcccaagaatatttggtttggcccccggttaaggttatttgtgtaccctcaaaaccggaaaattcccccaagggtttggggaagggaaacacactctccctgggaaataaaagggaaattaaatatttccctaaatggagagtgggaaccttttggcacccaaatttcgccccccccacccaaaataaggtggggaacattttcccctttccgaaagaaaagccctttaaagtggggttttcccggcgcccccggtggcaggggtttctcaaaaaaggccgcgaggtttccagtggccctgtgggtggggcaatggaggtgtcccttcacaaaaataagtgccccttctaaatggcgcggcccattatgggccccaagaaatatttttttaacgggttgggggcttgctccgggaaactatattcttatggtgg

SEQ ID NO: 95681 - protein, 84 aa, Zea mays
  misc_feature: Ceres CLONE 1586003
  misc_feature: The sequence is a functional homolog of SEQ ID NO 1844 in the 11/479,226 US patent application
  misc_feature: The sequence is a functional homolog of SEQ ID NO 298 in the 10/374,780 US patent application
  misc_feature: The sequence is a functional homolog of SEQ ID NO 46 in the 10/225,066 US patent application
MLAGAPTGDAGPSSGAGSNPPTRPRMDPGAAQPEIMRAAEKDDSYAAHVTEACRDAFRHLFRTRVAVALQNEIKWLWSGPFTTC

SEQ ID NO: 95682 - DNA, 827 bp, Zea mays
  misc_feature: Ceres CLONE 1586005
  misc_feature: Encodes the peptide sequence at SEQ ID NO. 95683
  misc_feature (431)..(431): n is a, c, t, g, unknown, or other
  misc_feature (663)..(663): n is a, c, t, g, unknown, or other
  misc_feature (672)..(672): n is a, c, t, g, unknown, or other
ctggagctccccgcggtggcggccgctctagaactagtggatcccccgggctgcaggaattcgtctcacccctagaaaaaacctctaaacttctcttcctactttaaccgtttaatgtgcccccttcttcccgttacgattaccagcgtcaccgccaatgccgccgcctccaccaacgggcgaaccgaagcgccgccggctgctatccctcatggcagtctacccatgcgagagcatcgcgccggcgcctctgttcagctcgcttctcgcacttgcggccgacttggcgagccaagggctcggcgccgacgccggcgccttccctgttctccggcgcggcttacggcaggcagtgcggattgcaggcctcctcctcgcgtttctggaggaggtccaagacgtgtcagtgacgaagacggcacctctgccantcatcggcggtgctggggctcacggagctgcacgtggccatgcagaagctgcggttactcctcacggactgcgcgcgacgggccgcgccggctgtgggtgctcgtgaacgccggattggccgcgtctgagctcagggtgattctcggggtcgtcgctgcgggcatggacgcgctggcgaaagacgtcgtggacgcttccgtggaggccggggagctcccgccgctcatgtcngaccattcntggcccgtggccctgcctccggacaccaatgacaaacccccggcaaagaaccttcggtcaatactggagcagttcaagagcggcttcttcccggaacccgaggaaccaaggcgggggctaaaacacttcgggtttaaaaactggaaccagtgccc

SEQ ID NO: 95683 - protein, 77 aa, Zea mays
  misc_feature: Ceres CLONE 1586005
MDALAKDVVDASVEAGELPPLMSDHSWPVALPPDTNDKPPAKNLRSILEQFKSGFFPEPEEPRRGLKHFGFKNWNQC

SEQ ID NO: 95684 - DNA, 856 bp, Zea mays
  misc_feature: Ceres CLONE 1586011
  misc_feature (412)..(412): n is a, c, t, g, unknown, or other
ctggagctccccgcggtggcggccgctctagaactagtggatcccccgggctgcaggaattcgtctcaccccctagaaaacagtggtggtggtcatcggcgagactggctccggcaagagcactcagctctcccagatcctccaccgccgcggatacacccgtcggggtgccatcgctgtcacccagccccgccgcgttgctgcggtttccgtttccagaagagtagctcaagagcttggtgttccacttggggatgaagttggttatgcaattcgatttgaggacagaacttcagaaagaacatgcataaaatacctcacagacggcattcttctccgtgaaagcctttcaaatcctgagttgaagcagtactcagtaatcatactggatgaagctcacgagcgtagcttnaacactgatatccttttaggtttgatgaaaagattgatcaaggacccagcttcagatttaaaagtttaatcccctctgcgactcttggacggttaaaagtttcaaagttcttctccaggatgccctggggttaaacattcctgggaactttattccctggggaaaaaattttacgggacttgatccccccaacaaattatattggaaccctcccctcagaacagctttaggatttccctgccaaggaaacctccctggaaaatgccttaatttttttggacgggaaaagggtaatatttgccaagatgggtttccaaatttgggggaaaaaaattcgaaatcttggggggggggccccggcaccgggggccttgggccctcccccttaagggggcctttgcccccggggagcgggggggtaagaattttggccgccccgccccg

SEQ ID NO: 95685 - DNA, 850 bp, Zea mays
  misc_feature: Ceres CLONE 1586014
  misc_feature (162)..(162): n is a, c, t, g, unknown, or other
  misc_feature (230)..(230): n is a, c, t, g, unknown, or other
  misc_feature (381)..(381): n is a, c, t, g, unknown, or other
  misc_feature (382)..(382): n is a, c, t, g, unknown, or other
  misc_feature (392)..(392): n is a, c, t, g, unknown, or other
  misc_feature (770)..(770): n is a, c, t, g, unknown, or other
aagctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagntctagctagaatacactgcgcgttcaaaacaaacacacagcgtcgtggctgcggtgatctcctgaccngcgtcgacaaactaccgcagcaccaagcagctggatggcggccaccgtatcttcctggctgagcctcgtccccaccgtgcaccaacggggcgggcggggtcccccagcaggggtgggcctggacgaaaacggcttcagcgccgttcgtttnnttttcttccncccctttttttggccgttcccttcgggaacaaaaggcccaaaaagggggggcccccccccggggaaaaattccgaggaacgggggaacccctgtttctcttttaagggggcggggggggaaaaaaaaaaaggggggaaaaccccccccccccccggggggggggggggggggggggcccccccgggggaaaaaaaaaacaagggggggggggggggtttttttgaaaaaacacaccctagggggggggggggggtgttcccccccgcgggagagatcactcctccccccgagggggggggaggttgtgttcccccccccccccccaacaaaaaaaaaggtggttgttaaataagaagagggtgttctctccccccctntgtgccggggggggggggggtgtgtacccgcggagagagaaaaaaactctttctcttctctccgcggggggggggccggg

SEQ ID NO: 95686 - DNA, 1018 bp, Zea mays
  misc_feature: Ceres CLONE 1586016
  misc_feature: Translation starting site: 273
  misc_feature: SWISSPROT Homolog: EC 2.3.1.119 Icosanoyl-CoA synthase
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (43)..(43): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (58)..(58): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
ntttttttttnnntttttttccttttggtatcttttttttttnttctgnnntgggggnataagcgtggctnnnttttcaaagctggagctcaccgcggtggcggccgctctagaactagtggatcccccgggctgcaggaattcgtctcacccctagaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtggctggtgtgcggcgccgagctgggcagcctcagccgcgacgagctgtggcgcaaggtgtgggggggaggccaccctacgaccctcgccaccgtggctcggccttccctcgccggtccctcgcccttcaccaatctcccggtctacattcatgttccagggccccaaggccccgtggtacccctcattccgacctttccgccatggcctaccaaagccccgggcccgaaccaaagcctccaaagggggttccccaaagggccggaaattttccattccaaccccttggccccccgcaaagtttacggggccaaaggttcccaacccaaaggaacagacccctggggcggttttcccaagattccccgttcctggcctggggcccaaagattcccggggcatctcgggggaaacaaaaatcccgttaacttggccccgccgccctggccgtgtgtttcgaatagccccaaaacgcccagtcttggcccccaacccattttaaaagggagggggcccccccgcccccaaaaggcct

SEQ ID NO: 95687 - DNA, 827 bp, Zea mays
  misc_feature: Ceres CLONE 1586018
  misc_feature: Encodes the peptide sequence at SEQ ID NO. 95688
  misc_feature (394)..(394): n is a, c, t, g, unknown, or other
  misc_feature (436)..(436): n is a, c, t, g, unknown, or other
  misc_feature (456)..(456): n is a, c, t, g, unknown, or other
  misc_feature (506)..(506): n is a, c, t, g, unknown, or other
  misc_feature (731)..(731): n is a, c, t, g, unknown, or other
ctccccgcggtggcggccgctctagaactagtggatcccccgggctgcaggaattcgtctcacccctagaaaaaaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctgnggcctcggatctgacccggagaagctgcggtggaacgtgcangcggagctggtgcactgccnggtgggcgatgctcggcgcggcgggtatcttcatccccgagttcctgacnaagatcggcgtcctcaacacgcccttctggtacaccgccggcgagcagcagtacttcaccgacaccaccaccctcttcatcatcgagctcatcctcatcggctgggccgagggccgccgttggggctgacatcatcaagcccggaaagcgtcaacaccgatcccatctttcccagcaaacagctcaccggcaccgacgtcgggtaccctggtgggcctgtggttngaccccctcggctgggggctccggctcgcccgaagagatcaaggagctgcgcccccaagagatccagaacggagcctcgccatgctcgccgtcatg

SEQ ID NO: 95688 - protein, 56 aa, Zea mays
  misc_feature: Ceres CLONE 1586018
MLGAAGIFIPEFLTKIGVLNTPFWYTAGEQQYFTDTTTLFIIELILIGWAEGRRWG

SEQ ID NO: 95689 - DNA, 823 bp, Zea mays
  misc_feature: Ceres CLONE 1586019
  misc_feature: Translation starting site: 190
  misc_feature: SWISSPROT Homolog: EC 4.1.1.49 Phosphoenolpyruvate carboxykinase (ATP)
ctggagctccccgcggtggcggccgctctagaactagtggatcccccgggctgcaggaattcgtctcacccctagaaaaaccccacaccgcttcactcgtttccttccgatccatacacaccgcgcacgtacgcgtactccatcgtcccggtgcaggcgggttcacgtcacgacctcgggcgagacgagatggcgacgccgaacgggcttgctcggatcgagacgaacggggcgaccaagcccgacaacggcgtgtgccacgacgacagctcggcgccggtgcgcgcgcagaccatcgacgagctgcactcgctgcagcggaagcggtcggcgccaaccacgcccatcaaggacggcgccgcctcgaccttcgccgccgcgctctccgaggaggagcgccacaggcagcagctgcagtccatcagcgcgtcgttggcgtctctgacacgtgaaaccgggccgaaagtggtcaagggcgaccccggcccggtagggcgatgcccccgcgacgggtgcaccgccgacgccgcaggcgcaccaccagcaccaccaccccgccgcccccaccatcgccgtcagcgacagctccctcaagttcacccatgtcctctacaacctctcgcctgctgagctgtacgagcaggccatcaagtacgaagaaggggtcgttcatcacgtccaccggcgcgctggcgacgctgtccggcgcctagaccgggcgggcgcccagggacagcgcgtcttcaaggacaagtcgccgcgcgggacctgtgggggggcagggctcgccaaatcgagatggacgagcaccgtcctgaccaca

SEQ ID NO: 95690 - DNA, 807 bp, Zea mays
  misc_feature: Ceres CLONE 1586021
  misc_feature: Encodes the peptide sequence at SEQ ID NO. 95691
  misc_feature (807)..(807): n is a, c, t, g, unknown, or other
ctcaccgcggtggcggcctttctagaactagtggatcccccgggctgttggaattcgtctcacccctagaaaaaatcctcgcccgcaacaccatttccgttcgggtcgcgcccgagcccgatatgcccgcgaagcccaggcccagccagacccaaagcgatgcgacggagatcgtgagatcgcgcgccgcagcctcctcccccgcccccgccgccggcgatgacctccgcagtcctcgccggccggaatgaggtccaccaggcgcatcagcaccaccgccaatgggctggcgcccgcgtcccgctcatgcccaagccgtcctccaaccctaaccctatgcgccaccgcgcgggcccaaaccctatccccagtggctcgccgccggagccgcgggccgctccggccgtcgcggccgagccctcgccgtcgccttcggggcacctgaacttcaagccgtcggaaatgacccccgccgaggcccgggacctccgcgcgcgggtcaccagggaggtctggcgcgtccgcgctttcctctcccgcatcgactcctgagaaagggggggagcggcccggtttttttttcatgactatccagggggggggtgggtgcccccggcgggggggggggtgggagtggtgaggggttggggtggggggggtgtgcggttgggtgttgtgcagaggtagatcttaacttggatgggtgtgatattccctgggcattgatgagtaaaatcgtcatataggagaggggtggagagttccaggctcacaccatagtatactacgtggtaggtggtggtcccn

SEQ ID NO: 95691 - protein, 110 aa, Zea mays
  misc_feature: Ceres CLONE 1586021
MTSAVLAGRNEVHQAHQHHRQWAGARVPLMPKPSSNPNPMRHRAGPNPIPSGSPPEPRAAPAVAAEPSPSPSGHLNFKPSEMTPAEARDLRARVTREVWRVRAFLSRIDS

SEQ ID NO: 95692 - DNA, 824 bp, Zea mays
  misc_feature: Ceres CLONE 1586023
  misc_feature: Encodes the peptide sequence at SEQ ID NO. 95693
  misc_feature (487)..(487): n is a, c, t, g, unknown, or other
  misc_feature (549)..(549): n is a, c, t, g, unknown, or other
  misc_feature (550)..(550): n is a, c, t, g, unknown, or other
ctccccgcggtggcggccgctctagaactagtggatcccccgggctgcaggaattcgtctcacccctagaaaaagcaaaaccccatcgatacccaaaccctagccagcccctctcccacgcgccatgtccgtcgcgtctgcggcggcggcggcctccctcatcgcctctacctcgctctccgtcccagaccgcatccgcctccatccccgccccgcacttcctccactaccgtgcttccgccgacgatcgcgggtctgcctcgtacgcgccgtcctcgaagaccgcccgtccccgcctgccgaggaggacgccaagcgctacgggctcaacgggaacgggagcgggctcggatacgacgatgccgccgtccaagcgtacctcggaagcaacggtaacggtagcgccagcggtaacggcggggcggtgaagcagaaccccgaggttgccgggagcagcgcggccatagtcccggccccggtcccgccngcggagggtgagaggagaggaaggaagagtgagagatccccggcagggggaaaggatccctnnttcaaccaaaacaacgcaaaaggttcctggtggctcctggggggcgctgggatcggtttaaaacctattcaacaattccaaagaaccctggaaaaatggggggatccgtttttactttttaattcaaggcttgggctcaccaattcaaaagttcaccttacgagggggggaaggacttggggggaaataagattatgggggaaggaaaattccttggccaaggggcttaaaggaaaagtctttttggaaattagggcccccccttttattcaat

SEQ ID NO: 95693 - protein, 233 aa, Zea mays
  misc_feature: Ceres CLONE 1586023
  misc_feature (142)..(142): Xaa is any aa, unknown, or other
MSVASAAAAASLIASTSLSVPDRIRLHPRPALPPLPCFRRRSRVCLVRAVLEDRPSPPAEEDAKRYGLNGNGSGLGYDDAAVQAYLGSNGNGSASGNGGAVKQNPEVAGSSAAIVPAPVPPAEGERRGRKSERSPAGGKDPXFNQNNAKGSWWLLGGAGIGLKPIQQFQRTLEKWGDPFLLFNSRLGLTNSKVHLTRGGRTWGEIRLWGKENSLAKGLKGKVFLEIRAPPFIQ

SEQ ID NO: 95694 - DNA, 835 bp, Zea mays
  misc_feature: Ceres CLONE 1586024
  misc_feature: Encodes the peptide sequence at SEQ ID NO. 95695
  misc_feature (584)..(584): n is a, c, t, g, unknown, or other
  misc_feature (596)..(596): n is a, c, t, g, unknown, or other
  misc_feature (728)..(728): n is a, c, t, g, unknown, or other
  misc_feature (816)..(816): n is a, c, t, g, unknown, or other
  misc_feature (826)..(826): n is a, c, t, g, unknown, or other
ggagctccccgcggtggcggccgctctagaactagtggatcccccgggctgcaggaattcgtctcacccctagaaaaactcctcctcttctcttgcttttgccaaccagaagcatcgagccgaggcagccaagtatctcaccctctgattctcctcctccaaacaccatccgcgggcgtggcgtacatacccagtggtgccactgccgactgccgagcaaggcaaataagccaagcagcgccccgcaagcgagacccggcccgggtcccagcgcggttcgctgatcgccggggctagtcaacggccggtgaccagccgaccctcgcgcgggagtggggccgcggaacggcggcgatggcggggctgccgccggtcgccaggcggcgcccgctcgcgacggcggcgtcgtcgctgctgctgctgttgctgctgctcgcggtgaccgcggcggcgcgcgaggagcggggcctggctcgggtgcagggcccgccgccgcggcaccgccacgcgtacgccgcgatgatgtacatgggcacgccgcgggactacgagttctacgtcgccgtgcgcgtcatgatgcgctnccctccccgcgntcgcgccgacgccgaccgcgtcctcatcgcctccgccgacgtgccgcgcgactgggtccgcgcatgacagaagagatggcatgagggtggtgatagtggagaacctcaggaatccttacgagagcaacctangagggacaacaagaggttcaagctgacactgaacaagctttatgcctggaccctggtggactatgagcgtgtcgtcatgattgatttngataacatcntcctccaga

SEQ ID NO: 95695 - protein, 102 aa, Zea mays
  misc_feature: Ceres CLONE 1586024
  misc_feature (77)..(77): Xaa is any aa, unknown, or other
  misc_feature (81)..(81): Xaa is any aa, unknown, or other
MAGLPPVARRRPLATAASSLLLLLLLLAVTAAAREERGLARVQGPPPRHRHAYAAMMYMGTPRDYEFYVAVRVMMRXPPRXRADADRVLIASADVPRDWVRA

SEQ ID NO: 95696 - DNA, 872 bp, Zea mays
  misc_feature: Ceres CLONE 1586029
  misc_feature: Encodes the peptide sequence at SEQ ID NO. 95697
gctcaccgcggtggcggccgctctagaactagtggatcccccgggctgcaggaattcgtctcacccctagaaaaaagctgaggactcagcctatataatatctagactagagtacaccacaacgacgaggcacatatatatacacgcggcggcggcgggcagatccatcttggtatacacgtaatatatacacacacacacgatgggcagcgccggcggcggcggcgagagcaagctggagagcccgctgctgggcgcgtcgtcgacgggccacggcgaggcggtggtgagcgggcagctggagagcatcctgggcgacgcgtccgtgccgtgggggacgcggatggcgtcggcgtccgcggtggagatgcggctgctggtgcgcctgggcgcgcccgccgtgctcgtgtacatgatcaactacctcatgtccatgtccacgcagatcttctcgggacacctcggcacgctcgaagcttgccgccgcctcgctcgggaaacaccggaatccagggtcttcgcctacggcctcttgcttggcatgggggaccccggttgaaaaaccctttccggggaggggtaacgggggcaaaaataaccaattgctgggggatttaccttggagggttcccccgtccttgttaatggcccaggggggggcccctgggggggcctttttaacctttttcccccccccttttttgttttggtggggggggaaccccccaaaaatagggtgtggccccccccctttttttgttaaggggcggtgcccccaaaatttttttcattaacccgccaatatttccccataaaaaaatttttgggggcggaaaaattattggggggcccacaccttattaattttcgcc

SEQ ID NO: 95697 - protein, 118 aa, Zea mays
  misc_feature: Ceres CLONE 1586029
MGSAGGGGESKLESPLLGASSTGHGEAVVSGQLESILGDASVPWGTRMASASAVEMRLLVRLGAPAVLVYMINYLMSMSTQIFSGHLGTLEACRRLARETPESRVFAYGLLLGMGDPG

SEQ ID NO: 95698 - DNA, 929 bp, Zea mays
  misc_feature: Ceres CLONE 1586032
  misc_feature: Encodes the peptide sequence at SEQ ID NO. 95699
  misc_feature (189)..(189): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcngcatcgatctcggcacgacgtactcttgcgtcggcttgtggcagcaccacccgctccagattattgccaacgaccaggggtaaccgccccccgcccttgtaaggtgcccttccgagtcccgaggcccctttggaaaaggggccaaaaaacagggggcccctaaaccccataaaacacttttttttttcccacattcctcgcccccaaattgttttgaagtccccccccccaaaaaaaaattaataaggggggccccccttagaagtttttttggggggggggggaaaaaaaaaaaatttttttttttccccccccgggggggggggaaaaaaaattttttttttagaaaaaaaaacaccccccccccctccttgtttttatatagagggagggggggggaggggtcgggcccctccccgcccccagacaacaaaaaaaaaaaaggggggggggtgggccgcgccccccctccctttcttttttttatataaaaaaaaacaaaaaaaaagaagaaagggagggggggcggtgtgtagtgtttttttttcttttttatatgaaataataaaaaaacagaggcgacacacccccctccctctttggtgtgcggtgtaaggggctgaagaaagggagtgggagggggagagatatgggagtgggggtgtgggttggttgtggcatctgcccttctctcgtgctttcagtgaggaggaggaggagacagaggggcgtgtgagggg

SEQ ID NO: 95699 - protein, 37 aa, Zea mays
  misc_feature: Ceres CLONE 1586032
  misc_feature (11)..(11): Xaa is any aa, unknown, or other
MAGKGDGPAIXIDLGTTYSCVGLWQHHPLQIIANDQG

SEQ ID NO: 95700 - DNA, 892 bp, Zea mays
  misc_feature: Ceres CLONE 1586035
  misc_feature: Translation starting site: 140
  misc_feature (892)..(892): n is a, c, t, g, unknown, or other
ctggagctccccgcggtggcggccgctctagaactagtggatcccccgggctgcaggaattcgtctcacccctagaaaaagggcgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccggagtcccagcgcccggggacgacgcgtcgcccaagttcctgggcgtggagacgaagacaatcaagaagatcgtgcccctgggggctcatgttcttctgcatcctcttcaactacaccatcctgcgggaaaccaagggacgggctcgtcgtcccccgccaaggggaggcagcccccgaaatcatccccgttcctcaagaacctgggggcaacctgccccatgggcagtcgggcttcctggctccctccaacaccaaagctcggcgcaatggtcccctcccaagggagggcctcttcctaacgcgcgccatccttccccctttcagtcgccttttttgggcggccttgtcggctaaggtggctcttaaccacaagggggcggaacacccttccaaccccccttgggcgtccgcccagaatagcccttctcgcgctctgggcgtggggcgcccgacgctgtctgtgggaagcacggtgtggcaggcccccccctgagtgagtgggagatctctgtccgcggtcn

SEQ ID NO: 95701 - DNA, 1213 bp, Zea mays
  misc_feature: Ceres CLONE 1586037
  misc_feature (16)..(16): n is a, c, t, g, unknown, or other
  misc_feature (66)..(66): n is a, c, t, g, unknown, or other
  misc_feature (68)..(68): n is a, c, t, g, unknown, or other
  misc_feature (70)..(70): n is a, c, t, g, unknown, or other
ggtgggggggtgcccnaccgccaggggcccccggggcttctcttgagtaggggtgggtggagaaanangnaaactggagctccccgcggtggcggccgctctagaactagtggatcccccgggctgcaggaattcgtctcacccctagaaaaaaccccagctcactcgtgccgtgcactcgtcccgtccccctccaccctccaagacctcgcattgccaccgctcgccgccgagccaggggagaggagagaggccagccgcgtcccggccgggcggaggaggaggaccaacgggagaacggagcgagccggccgggcaggatgtttcggcgggatcccctggggcgggccgcctggatatttccaacgccgacttcgggaagggacaacaaccgcggccggcaccttgaaccgggggggcctgatgcgggggggtggggagaaaaccgggaaaaggtgggcgtcctgggccggggcccggccaacccacgccgggcaaaaaaaaagaagacggtaacctcgaacctccgggtgcccttgttggtcggtaaccggaaagggtcctccaattgttggaaccgtccagttcccttttcttcgtggcgcccgggtggtgtcttcaatcggggcactcagcgatacaaacgattggccaaaggcaccggcccccccacaaaagtgggccgccctcgggtcgatcgttctcctccctataacattttttcaacgcccaggggggggcttgtcgccaaagagggggtcccctatggggtcatttaaagagagcggcgcggtggggtttcccctgggctcgccgctcgtgcgccagataaagtcaaggagtgggtcgcagggaggaggttcccggagggggggaggacagtttgccgtgtggcgaggtagagaggtgactagggggttcctgtatccttagaaaaaggcgtgtttgtcgtccggcgtgggtgtcacctccagtgtcacggaaagagactctcgctctaccgaagtccgagcggggggtgaactcgccccctcctccgatgactaatagtgtggagcgaccgacaggggggcgtggggtgtatccgccggggcgcaacaggcgacagtacccgtcgagagtgctatgtctgttcgtatattgtgtcagggggtgctcgggcgcgtacagtgatggttctttgtggcgcctgtcggggtgtgtgggcctcgtg

SEQ ID NO: 95702 - DNA, 813 bp, Zea mays
  misc_feature: Ceres CLONE 1586040
  misc_feature: Encodes the peptide sequence at SEQ ID NO. 95703
  misc_feature (461)..(461): n is a, c, t, g, unknown, or other
aaagctggagctcaccgcggtggcggccgctctagaactagtggatcccccgggctgcaggaattcgtctcacccctagaaaaacacccctcaacgtagcactgccctcttcctctctgtcctctcccctgctgccgccccctttcccaaatctggccgcacgacgcaccagccaccaaccgcacacaccccaaacttgaaggcacaacccgagcgctcgcccgcctcgcctctgcgccgcgtccggccgccggtagcgggccggtcacttaccgggagggagaggtgctttggttcctggatgagctgtgaaggaactgggagcaagaagaattgatggtttactccgcagggcaaaggatggaccggctggtcgacgccaactccggccaaccagcggagcggtggtggggctcctgctgcgtcggcgccccttggaaagggcaaaggaagggtcgccnactccagcaggagtggcatgatatcagtacaaatgggggcttcttttgatgaaaaaaaaaatgggccccaaatttaaaaaaaacggggaagggccgacccaaaagaggaaaatctgaaaagggggcgggggggcccctcggaaaggcttttcaaaaataaaaagggggggagaaaaaaatgggaaaaaacccgggggtgagaaaaaaaagtgtccccccaattttaaaaaacaacccggggttaataacaccaaagaaatgggggggggatatttctcccccgaaaaaaaaaaaaaacaaggcgcgccccccctggggggggggggggagaagaaaaaaaaccggggagaag

SEQ ID NO: 95703 - protein, 57 aa, Zea mays
  misc_feature: Ceres CLONE 1586040
  misc_feature (42)..(42): Xaa is any aa, unknown, or other
MVYSAGQRMDRLVDANSGQPAERWWGSCCVGAPWKGQRKGRXLQQEWHDISTNGGFF

SEQ ID NO: 95704 - DNA, 844 bp, Zea mays
  misc_feature: Ceres CLONE 1586041
  misc_feature: Encodes the peptide sequence at SEQ ID NO. 95705
  misc_feature (78)..(78): n is a, c, t, g, unknown, or other
aaagctggagctcaccgcggtggcggccgctctagaactagtggatcccccgggctgcaggaattcgtctcacccctngaaaaaccacacagctcccacgctcaccgacgccggtttttttttcttccccactcctctcgtcgcgtccaataaaaaggggggaagagcattttcccttttttttgctcccctcccccctcgcttctcccgaatttgatgcttaaaccctcgccgggaggaggactccacgcgggagcccgcccgcgccacctaccgacgcgcccggatccccgccatggccgccgcgccgcaccgagcccaagtccccgctgatagcacggctccgttgcagacggggcctgtacttgagaataacccctccaaaagtgcaaacgccaaggaccagattctttctggaacagaaaatgtgactacgggaaatgcacgtggcgctagctccttgagatcgccaaactgctcaccacagaaggctacctctgccggaaaagctggacagcaaccttatctctaccagcaaaatgtgtatgcaccacagccaaaccactctatcctggaggatacatgaacccttcaggacaatgggaggaatatccccattatgtgaatgtgggaggggctcctttacgttatctcccggaatctacaatgacaaccagccccttcctgctatccgctgggatatgcaaacaacccccaaaaggatgcatgggaggccttttcgtcctggttccccctggctggagagggcccaacaatactttccctggggcactaatcccttcccccaaccgtttacctatgaaacccaccaacctttctctag

SEQ ID NO: 95705 - protein, 96 aa, Zea mays
  misc_feature: Ceres CLONE 1586041
MAAAPHRAQVPADSTAPLQTGPVLENNPSKSANAKDQILSGTENVTTGNARGASSLRSPNCSPQKATSAGKAGQQPYLYQQNVYAPQPNHSILEDT

SEQ ID NO: 95706 - DNA, 1203 bp, Zea mays
  misc_feature: Ceres CLONE 1586043
  misc_feature: Encodes the peptide sequence at SEQ ID NO. 95707
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (22)..(22): n is a, c, t, g, unknown, or other
  misc_feature (45)..(45): n is a, c, t, g, unknown, or other
  misc_feature (53)..(53): n is a, c, t, g, unknown, or other
  misc_feature (62)..(62): n is a, c, t, g, unknown, or other
  misc_feature (77)..(77): n is a, c, t, g, unknown, or other
tggtgtnnnggnnnntnttctntccctcccctcttcgcgcgggantattctangatgagagnaggggggggaggggncaaaactgggactcaccgcggtggcggccgctctaaactagtggatccccctggctgcaggaattcgtctcacccctagaaaaactctgcacacggccgccaccatgtcatgtctctacagccagggcttctcccctgcaagaaccctctcccccccgattacgagcaactccgactctgacagccagtacttgaccgagcttctcccagaacatcagaaactggggggccttcatgcatgtgctaccgatatgcagacggctgctcaggcaaagaaatcttgcggaaacctagcttggttcactaccaaggggattgcttgatcttgacaggtgccggttctaaaagaccctaaccctatgtcgtcaacaaatgcccggccctttatctacatggatgatgggttttcccccccctccgaattggggattgcacgcaagaagaaatttggggcctttccccccccccccgggaaaactccgttagggcaaccgggtaagggaaaaaaagcttccaaaagtccccttggctatgctgtttcataaggtcaaaaggaaataaatatacgtcacgggaatttgaaaaagaggtccccctggttcggaaaacccctggtgagcccgtgagaactcgttctaaaaaactggatcgacgtgggggggcgccgcacccatatttccatttgcggggggggccccccgggggcgggtggttcgaaaatgggtcctctctctaaaaaaacgaggagtacgttttcttcagcagctgcgtgagaataagcgtggagtgcctgagaacaagttctgagtgtttctttgtaatatagaagactatggagagaaaaggagtgtgtgccctcgtgccccaaacggcgcacccctcttgaaaaaaaaagcgaggcccaaataatacctctccaaaggcggataaaataaacaccggaaggggaataataagcaataatccgttagaagggagggacccctctttggcctattcgagtacggaaataccccaggccctctcaaatttgtcaccacgctggaatatttccactggttagagaactaagggcccgtacattacggagggtctcaaatactacgccttgggtgacacaaatctg

SEQ ID NO: 95707 - protein, 72 aa, Zea mays
  misc_feature: Ceres CLONE 1586043
MSCLYSQGFSPARTLSPPITSNSDSDSQYLTELLPEHQKLGGLHACATDMQTAAQAKKSCGNLAWFTTKGIA

SEQ ID NO: 95708 - DNA, 828 bp, Zea mays
  misc_feature: Ceres CLONE 1586044
  misc_feature: Translation starting site: 164
  misc_feature: SWISSPROT Homolog: EC 1.4.1.2 Glutamate dehydrogenase
  misc_feature (625)..(625): n is a, c, t, g, unknown, or other
  misc_feature (736)..(736): n is a, c, t, g, unknown, or other
  misc_feature (752)..(752): n is a, c, t, g, unknown, or other
  misc_feature (774)..(774): n is a, c, t, g, unknown, or other
tggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttncatgactcacagaggcaggccacaaagggatgctggggtgattgctgggcctaatgtgctgcgtatcatcaacgagccaacagctgcagctatcgcctatggtcttgactnagtagctaccagtgtncggtgagagaatgtcctcatcnttgatccttggagggggtacccttgatgtctccctctcaccattgaagaaggaa

SEQ ID NO: 95709 - DNA, 1071 bp, Zea mays
  misc_feature: Ceres CLONE 1586047
  misc_feature: Encodes the peptide sequence at SEQ ID NO. 95710
caccgcggtggcggccgctctagaactagtggatcccccgggctgcaggaattcgtctcacccctagaaaaagagttgtccgcttccagtcagtcgccgccgctgaaaccgaaacttaaaaacaagctcgccgggggtccggccgatttcccccaaattttgctgctgttgctgatagaaggccgcggcgaccaccatgggcaactgctgcgccacgccgtcgacgacggaggagagcggcaaaaaccgccagaagaaacccaagcaaaaagcgaacccctacaacgtggcgtacaaccgccggggcggcgccggcggcggcgcgccccggcctggtggtgctgcgggacccccacaggggggggaggggggggcgcattacaaaatggggccacaaacatgtggcccccccaaatttccgcacctgccgaacctgttgtcaaggaagtccggcccacggggggcgcgggctatccttttcggaagatctcacccccaaaggggaaagacttgtgccagccaccccctgtggaacgagtggtaggaaacgacggcggccccgatgagggaggggaagatcgtaataggcgccacattaatagggaaccttgagagggacccacacaggatcatgtttgaaggttcttattggtgcgtgacgagccacgcaagtgggaggtcgaccggggggggagccccctccgaagttccaggctggacgaaaccatgagagagaatttctgatcacgagggagcaggacgaggagaaagccggcggtgctagcccagatgaatgccttccgggtcagtaggctgcgacccccagtaaagtaaccctgtgggcgaaggcgctgatcaacctgctagcgttctgaggggtatggtgagggtcgggcgtgaggaggagagcgggatgtgaagtcaggtgtttaatgctgctgactccatgctcgtgcagtctctgaccctccggaggaggtgggcatgcgggagcaggagagtgagcgcgggggaggtgagtataggttcccatgacgtattagtctaccgccagcgtatgagcgtggttgg

SEQ ID NO: 95710 - protein, 115 aa, Zea mays
  misc_feature: Ceres CLONE 1586047
MGNCCATPSTTEESGKNRQKKPKQKANPYNVAYNRRGGAGGGAPRPGGAAGPPQGGEGGAHYKMGPQTCGPPKFPHLPNLLSRKSGPRGARAILFGRSHPQRGKTCASHPLWNEW

SEQ ID NO: 95711 - DNA, 838 bp, Zea mays
  misc_feature: Ceres CLONE 1586050
  misc_feature: Encodes the peptide sequence at SEQ ID NO. 95712
  misc_feature (786)..(786): n is a, c, t, g, unknown, or other
  misc_feature (790)..(790): n is a, c, t, g, unknown, or other
aagctggagctccccgcggtggcggccgctctagaacttgtggatcccccgggctgcaggaattcgtctcacccctagaaaaaatcgaccgtgttcagctgatgatgaataattacatctgtagttggcctgatatgggattgtagccggacgccgccttcatatagcggccgtcaagaaccccagcaagcaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtgtccttccgcgacctccacgcctagtacggccacaacgggctgatgctggtgcaagtcggcgcagtgcccatcatcgtggtgtccacgccgcatgccgccgaggccgtgctccgcacgcacgtacacgtgctggcgtcccgcccgcggaaccccgtcgacgacatcatccgctacaactccacggacgtggccttcgcgccgtacggcgagtactggcgcacggctgcggatagtggtcaacacgcacctgctcagcgccaagatggtcttctccnaacngtcggagcagggagtaagagggtgctcctggtggtaggcccggatccc

SEQ ID NO: 95712 - protein, 85 aa, Zea mays
  misc_feature: Ceres CLONE 1586050
  misc_feature: SWISSPROT Homolog: EC 1.14.13.68 4-hydroxyphenylacetaldehyde oxime monooxygenase
MALEAAYDYLHVAVVQCTPTQAAAVLGVLLLLAIRLAAAARSSSATSPKWKQHRLPPTPPGKLPIIGHLHLIGSHPHVSFRDLHA

SEQ ID NO: 95713 - DNA, 844 bp, Zea mays
  misc_feature: Ceres CLONE 1586055
  misc_feature (729)..(729): n is a, c, t, g, unknown, or other
  misc_feature (813)..(813): n is a, c, t, g, unknown, or other
ctggagctcaccgcggtggcggccgctctagaatagtggatcccccgggctgcaggaattcgtctcacccctagaaaaaccaggtccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgtagttagcttcttagagggactatggccgtttaggccacggaagtttgaggcaataacaggtctgtgatgcccttagatgttctgggccgcacgcgcgctacactgatgtatccaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgtcggatccggcaacaagggggggcgggttccccgcccccgacgtcgcggagaagtcatttgaaccttatcatttagaaggaaggagaagtcgtaacaaggttttcggtaggtgaaccctgcgggaaggatcattaaaaaaaccaaacgtgctttgatctcccttccggccacttcattncatttctcctcgctccccagtccccggggtaggcatgggcggtccgtcacccgcccggggccccggggtagcggcccctttcgnccccgtcgtcgggcatcgcctcaaagtccgt

SEQ ID NO: 95714 - DNA, 854 bp, Zea mays
  misc_feature: Ceres CLONE 1586056
  misc_feature: Encodes the peptide sequence at SEQ ID NO. 95715
gcggtggcggccgctctagaactagtggatcccccgggctgcaggaattcgtctcacccctagaaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacagcctcccgccggggcctccgggttggccggtggtggggaacctgttccaggtgatcctgcagcgacggcccttcatgtacgtggtgcgcgacctccgggaaaagtacgggcccatcttcaccatgcggatggggcagcgcaccctcatcgtggtcacctcggcggagctcatccacgaggcgctggttgaagcaggggcccatgttcgcgagccggcccgaggacagccccacccgcctcctctttagcgtcgggaagtgcaccgtccaactcggcgccctacggccccctgtgggcgtgctctgcgccccaactttcttcgccaaaattgtgtccccgcaacggggtcaaggggcttctcctggatcccggaatgggggcctggaaacccccacttgggccgccttctggggccaaacttaccggcggaacgaggcccgtgcggggttaatgggcaaattggcccgcctcaccatttgggaagaaccccttatctggaattttggctttcggggcccaaaatttcccccaaaagaactccttccggggatatatccggaggagggg

SEQ ID NO: 95715 - protein, 112 aa, Zea mays
  misc_feature: Ceres CLONE 1586056
  misc_feature: SWISSPROT Homolog: EC 1.14.14.1 Unspecific monooxygenase
MDVNDVLLVVLAAALAAMWWRRCSKTGGVDSLPPGPPGWPVVGNLFQVILQRRPFMYVVRDLREKYGPIFTMRMGQRTLIVVTSAELIHEALVEAGAHVREPARGQPHPPPL

SEQ ID NO: 95716 - DNA, 835 bp, Zea mays
  misc_feature: Ceres CLONE 1586058
  misc_feature: Encodes the peptide sequence at SEQ ID NO. 95717
ctggagctccccgcggtggcggccgctctagaactagtggatcccccgggctgcaggaattcgtctcacccctagaaaaaaaaaaaatctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatccctgagcagtgtgactgcttatggttttgatcttgtccgtggaacccaaactcttgggcttgtcacgagtgctggtttccctgctggaaagtacctctttgctggtgttgtggatggacgcaacatctgggatgatgatcttgctacatctctcagcactctccagtctcttgaggctgttgttgggaatgaaagcttgtcgtatcaactgctgctctctcatgcacaccgctgtggatcttgtgaacaacactaagcttgaccgcgagattaggtcttggacttgcttttcctccccagaaggtttgttgaggttgatgctcatgctaaggctttgccttggtcaaaaggatgaggctttctttcacaagaaaagctgctgctcaggcctccaggtaaatccttccccccgggtgacccctgtaaaatcccccgagggtggctggtgcttctcaaggggttctgaccaccgcccgtggggaccaacgtttagggcaaaaattggaggcccaaaaaaaaaaaaccctttaccctccc

SEQ ID NO: 95717 - protein, 183 aa, Zea mays
  misc_feature: Ceres CLONE 1586058
  misc_feature (8)..(161): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
GAPRGGGRSRTSGSPGLQEFVSPLEKKKIYKEVIAELKAAGASWIQFDEPTLVLDLDSDKLAAFSAAYAELESVLSGLNVLVETYFADVPAESYKTLTSLSSVTAYGFDLVRGTQTLGLVTSAGFPAGKYLFAGVVDGRNIWDDDLATSLSTLQSLEAVVGNESLSYQLLLSHAHRCGSCEQH

SEQ ID NO: 95718 - DNA, 899 bp, Zea mays
  misc_feature: Ceres CLONE 1586066
  misc_feature: Encodes the peptide sequence at SEQ ID NO. 95719
tggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgacagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccagggcaccctacgacagcttcgactacgaacgcttctccccctactggggcagctgcaaagtaccgggcgaggaacttccttccacgacgtcgggctcgggcgggatcgggttacgaaggtcacccggctacctcctacgccaccctggcaaacgacccttcaagttccccccagcttgccgggaattaaagaaagggccggcccaagcccccaatatattggggaaagcgagttctccgggaacgtttccaatgggggtgtacgtgggggccccttgttcccccccggacccaagggaaaacccggggccgg

SEQ ID NO: 95719 - protein, 215 aa, Zea mays
  misc_feature: Ceres CLONE 1586066
MAATVSSCLSLVPTVHHRAGGFPSSVALTNTLQRRRRSRRYLVVASATTAEQEAAPVTIEDVDLSSHQAAADDGELAARWREVHGSNNWEGLLDPIDGVLLQELIRYGEFAQGTLRQLRLRTLLPLLGQLQSTGRGTSFHDVGLGRDRVTKVTRLPPTPPWQTTLQVPPSLPGIKERAGPSPQYIGESEFSGNVSNGGVRGGPLFPPGPKGKPGA

SEQ ID NO: 95720 - DNA, 1009 bp, Zea mays
  misc_feature: Ceres CLONE 1586067
  misc_feature: Encodes the peptide sequence at SEQ ID NO. 95721
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
ggggggtggtnccnnccaggctacggggggagggttttttttttaattgtgatgggcnnnnnttgttnnnntttcaaagctgggactccccgcggtggcggccgctctagaactagtggatcccccgggctgcaggaattcgtctcacccctagaaaaatctttcgctcgctctcggcgacagctgggcgaccgtcgtcgccgccgcccttctctaggtgcccaggtcttcgccggtccctttgccgcctcttcgccgccgatgagcaccagccaggaagaaaagaagctgaaccatgggggaagagaaagtcagctgctaagccacctcctaagaagcggatggacaagcttgacactgtcttttcctgcccattctgcaaccacgggagtagtgttgagtgcccaaatgacatgaagaatctgattggcgaagcatcttggtaaatctggcaggaaaacttccgcacaactgtttatgcactcactggagcccattgatattttttagggaatgggattggaccagggtggaacctgttcaacacctggttgaaagccaaacaattaattccctggagccttgcccccctggggaagggaaaacgggttaccccacccctcccggaaaggggaaaaggggcccagaaattttccccgcaaatggccccatataccccactttattccccggccccctgggggctttggggaaattaacccccctaagtggggcccgaaaccgggaatattgcccccggttagggccccccccttttccttagggaccctttcccgaaaccctccccaaaaaggtgtggggttttttttaacctttttggggggcccaccctctttttaaaggggggcctattttgggggttcccctattcccaaaccccttttttccccaaaatgggggggtttcacgccggtttgttcctggggaaaagcgcggtttaccccccccttaaaaaccaaccggggggcccgcccccccttggggggca

SEQ ID NO: 95721 - protein, 34 aa, Zea mays
  misc_feature: Ceres CLONE 1586067
MDKLDTVFSCPFCNHGSSVECPNDMKNLIGEASW

SEQ ID NO: 95722 - DNA, 823 bp, Zea mays
  misc_feature: Ceres CLONE 1586068
  misc_feature: Translation starting site: 174
  misc_feature: SWISSPROT Homolog: EC 4.1.3.1 Isocitrate lyase
ctggagctccccgcggtggcggccgctctagaactagtggatcccccgggctgcaggaattcgtctcacccctagaaaaaacgcttcgcacttgcaatagttcgtcatctccaagtgcgtgcgccggccgccccctatcccgccggccctgtgtgtgttccccgctaccagccatggcgtcgccgttctccgtgccttcgctgatcatggaggaggaagggcggttcgaggcggaggtggcggaggtggagtcgtggtggggcacggagcggttccggctcaccaagcgcccctacaccgcccgcgacgtggtcctcctccggggcacgctccggcagagctacgcgtcgggggagatggccaagaagctgtggcgcacgctcaaggcgcaccaagccggcggcaccgcctcccgcaccttcggcgcgctcgaccccgtccaggtcaccatgatgggcaagcacctggacaccatctacgtctccgggtggcagtgctcgtccacgcacatctccaccaacgagcccggcccggacctcggcgactacccctacgacaccgtggcccaaaaagggtggagcacctcttcttcgcgcagatctatcacgatcgcaagcagcggggagcgcgcatgtcgctggcccgcgccgaacgcgcgcggggcgccttacgtcgacttcctcaagcccatcatcgccgacggcgacacggggcttcggcggggcccacggccaccgtcaagctctgcaaagctcttcctccaaccgcgggggcggcccgggggcccccccccaaagaaacagtccctccctccaaccaggag

SEQ ID NO: 95723 - DNA, 1166 bp, Zea mays
  misc_feature: Ceres CLONE 1586070
  misc_feature: Encodes the peptide sequence at SEQ ID NO. 95724
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (922)..(922): n is a, c, t, g, unknown, or other
  misc_feature (944)..(944): n is a, c, t, g, unknown, or other
  misc_feature (970)..(970): n is a, c, t, g, unknown, or other
  misc_feature (1099)..(1099): n is a, c, t, g, unknown, or other
  misc_feature (1102)..(1102): n is a, c, t, g, unknown, or other
  misc_feature (1166)..(1166): n is a, c, t, g, unknown, or other
nnnnnnnnnnnnnttttcccgcgcccnnncccccgcgccacggacgatgagggggtaccannnnngaannnnnnnnaaaattggaactccccgcggtggcggccgctctagaactagtggatcccccgggctgcaggaattcgtctcacccctagaaaaaactcccgactccctcggctgcctcccgcagccgcccgctgctccggtccttccgaacgctggcctgttcttccctgcctttgggccattcgtcaggcggcccctccgcaggcgaagcaagcgcgggcacaacagggcgggggcccggacttcctagacagctttacggtcttcgcctccggccccttctcctgtccccccattggggcgctggctgccactggcaaacttcaccccccggggaagtcccccgcaggtctttccggaaagggggcttttcatttttcccccccggggagggggagggggggggggcccccccccctgaggaaaaaggggggggggggggccccccgaataaggcagggagagaccgcggaaacccccgcgcttggaaggaacccccaccaccttgtatggggggtccacctgctcgcaaaaagcctcccccggctaaaattgtctcggcccacgacccagaggggtgtggaaatagggggggagcgacggtcttgttgacgctggtccgtgagggggggggatttctccacaacaccttattcttcgccggcgatggaagcggagaggtgggcgccgctgccccgcggctagttcataagcggccccgaaaaaacaagagtagcatgaatggtgcgccccccgcggcgttggcgccgtgccctcttcctccttgccgcccgatacgattcatcgcgtcggcgacaagctcagtgcttctgttgttaccccgcgtccttcgcancgcgacgccgccggcggcctgncggcggagagccccgagcgagctgtncaggtgttctgcgggctgcggaggagaacacaagaagaatgcggtggggtgtagctcggcgggctcgtcggcaaaagatgcaatcacaccgctcgccagcgggtgctacctcagaacgaagctcgaagnganacaaactagcagggcgactcaggtccgtaagtgatggacgtggaatttgcaaggagactagttn

SEQ ID NO: 95724 - protein, 89 aa, Zea mays
  misc_feature: Ceres CLONE 1586070
  misc_feature (5)..(5): Xaa is any aa, unknown, or other
  misc_feature (6)..(6): Xaa is any aa, unknown, or other
  misc_feature (7)..(7): Xaa is any aa, unknown, or other
  misc_feature (8)..(8): Xaa is any aa, unknown, or other
  misc_feature (9)..(9): Xaa is any aa, unknown, or other
  misc_feature (10)..(10): Xaa is any aa, unknown, or other
MRGYXXXXXXKIGTPRGGGRSRTSGSPGLQEFVSPLEKTPDSLGCLPQPPAAPVLPNAGLFFPAFGPFVRRPLRRRSKRGHNRAGARTS

SEQ ID NO: 95725 - DNA, 1199 bp, Zea mays
  misc_feature: Ceres CLONE 1586071
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (913)..(913): n is a, c, t, g, unknown, or other
nnnnnnnnnnnnnnnnnnttctccctcccccgccccccccggccggccggtccggtgcggggggnnnnaagaannnnnnnnnaaannnggggctccccccggtggcggccgctctagaactagtggatcccccgggctgcaggaattcgtctcacccctagaaaaagtggccgcaccgcagctgctgcggcggcggcagaggtgaacagcttcccgcggccttgtcctgtccggactccggggccgggaccggcagcgcagcgggctcgcgggatctcccgacccccatgcgtcggcctccgggacagggtttgctagcggagtccctcccactataatgaattaagcacccactacgtgatggggaaccggaagtcaaaacaaaactaatttttttttggggccccaggagaagtctacctgaacggggaaggggcctccgacggggcattccgccatccccggaaggggggggggggggggggggccatttccgctccggcaacaccttggaagtgagaagctgccccctccaagggggagaaaagggggcccgggttttttcccacaggaccacggggcgcccgcggaggaagttggagaacaacagccaaacggcgcgtgtgcggttcgcccccacaacgaacaacgacgttgctttttgttataccggcctcccctccactgaagaaacgagcggggggacgcttgaggaggcgcgttggcccctggcatccaggcgccgatacggcaggcagctccacaggacaggtgggcggatgtgccacggccagacagagcgcgctcgcggcgcccctgggtggaggcacgcgcgcgcggcgtaccctagccgtaacggagaaccactatccacggaagaaagtggacacagccggcggccccgcaagggtanccgaggtaagaaaaagaggagacaccgacactcgcccaccgtacggagccaagaccgggctctgccgcgctcaagggctggggcgctgcgagccacatgaggtggcgctgtcccgggtgggcaccgcaccgcacgccggtcccgtcacgtgcgcgtgcggggccgcgccggtcgctcttcaacaggcgcgccggcagctcatagtctagatggttgcgatttgcatggtgtcgcaggagggagggcaagcccgccggcgcggaaggcgtgggtgtgtgtaccgatt

SEQ ID NO: 95726 - DNA, 1254 bp, Zea mays
  misc_feature: Ceres CLONE 1586072
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
ntttttttttttnnggggtatatatatacaaaaaaattattgtaggggggaaaaaaaaaaccttcatggttgggtggagctccccgcggtggcggccgctctagaactagtggatcccccgggctgcttgaagtcgtctcacccctagaaaaaacccgcgcacaccaccaccagtcagtccagttcccgcagtgcactgctctacgccacagtacagcagcggccagcggctgcctaatctctccagccctttttcgtcccctagccacgccgcccaccgctgccgcgtcatccgcccgtcgtcgcctgccccgcggcttctggccccattcgccgccgaaacacaccgagccccgtcccaaatcgccacgacgcagggttggaaatctggttggaccactcagtgagtggcttcaggggaaaagcggttcgcggtgtcaagaagcgtcaccaatgtaatctgggaaatggggcccccccccccccaatcctgcaaggcttcgccaacctggaatcataaaggggggctctgagcgtgaggggaaaacggccccgactagcctttgggatttgggagtaattggaggcacgttggtgtggtgtgggaaggggaggggaaaaggggagagttgcggaaatggacaaaaaaataatttccttgggcgtgtgcggagtaaggaccatcctttaccaaagattcctaaaaaggggaagtccctattcggggtgataagttgagggaggtgccaaggcaaagtgtatggtgccaggctatggcggggatgggtaataatgagaatgaaagagaggggtagggggtgctggacggtcgtaaatgggcgagtagagttcgtagttgggtagggcgacacatggaaggacgttgcggtgctgtgtgtcgtttcgtcacacatgctttgagtggggctcggactaagaaatggtagtggtgatggtggggtggtgggttggaagggaggttgtggtgtagatcatatgacagatctggcatcgagggagtaggcaaggggaagagcgagactggatgtggtgagacttcaaaacgctgaaacgcggagtatatgtatatcaaagaggggaaagacagaacgcatgagcaacgaacgctgatctcgagaatactgcacgaagagagaacaggtgagtgagggaggcgtggggtggggactgtggttgcggttagtctggagattgagtatatataatgcgagtgggggaggtgtggtctgagcg

SEQ ID NO: 95727 - DNA, 837 bp, Zea mays
  misc_feature: Ceres CLONE 1586076
  misc_feature: Encodes the peptide sequence at SEQ ID NO. 95728
  misc_feature (352)..(352): n is a, c, t, g, unknown, or other
ggagctccccgcggtggcggccgctctagaactagtggatcccccgggctgcaggaattcgtctcacccctagaaaaacgatagccgccgccgtcgaccagagcactcccccctcgtcgccacgatgtcgtcggagcctccacccgcctcctctgccgccgccggagaggaactcgctgctgacctttccgccgctaccctcagcaagaagcagcagaagaaggacgcgaggaaggcggagaaggcggagcagcgccagcgccagcagcagcagcagcagcagccggccgacgccgaggacccgttcgcggccaactacggcgaggtccccgtcgaggagatccagtcaaanggcatctccggccgctcgtggtcccatgtcggcgacctcgacgactccgctgcgggccgctccgtgcttatccgcggagccgcgcagggcatcccgtcggtcagcaagaagatggctttcgtcgtgctgcgccagagtatgagcaccgtgcagtgcgtgctcgtcgctagcgcggacgccggcgtcagcacgcagatggtgcgcttcgccaccgccttcagcagggagtccatcgtcgacgttgagggcgtcgtatccctcccaaaggagcccctccaggccaccccacagcaagttgagatccaaggtggaggaaatctttttgcatccattggggctattcccgaccccttcccattataccttgaagaatgccgcctcggaagggggggcaaattttgggagaaggcttgaattggcctgggagaaaaaactttggttccgcgtttgggccaggattcccccgcttgggaacctcccgaggc

SEQ ID NO: 95728 - protein, 213 aa, Zea mays
  misc_feature: Ceres CLONE 1586076
  misc_feature (98)..(178): Pfam Name: tRNA_anti Pfam Description: OB-fold nucleic acid binding domain
  misc_feature: SWISSPROT Homolog: EC 6.1.1.12 Aspartate--tRNA ligase
  misc_feature (76)..(76): Xaa is any aa, unknown, or other
MSSEPPPASSAAAGEELAADLSAATLSKKQQKKDARKAEKAEQRQRQQQQQQQPADAEDPFAANYGEVPVEEIQSXGISGRSWSHVGDLDDSAAGRSVLIRGAAQGIPSVSKKMAFVVLRQSMSTVQCVLVASADAGVSTQMVRFATAFSRESIVDVEGVVSLPKEPLQATPQQVEIQGGGNLFASIGAIPDPFPLYLEECRLGRGGKFWEKA

SEQ ID NO: 95729 - DNA, 852 bp, Zea mays
  misc_feature: Ceres CLONE 1586080
  misc_feature: Encodes the peptide sequence at SEQ ID NO. 95730
ctccccgcggtggcggccgctctagaactagtggatcccccgggctgcaggaattcgtctcacccctagaaaaaatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctccagatctgatccgaagcgcggcggcgtcgacgacgacgacctaagggcacgatgcattcgaccaacctgctgctggaggagcccatccggatggactccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtgtggagacgccgcctaccaccaggagacgctcgagaacctcaagctcgccatcaagtccaccaagaagctgtgcgctgttatgcttgacacggttggaccggagctgcatgtggtcaacaagagtgaaccccccatctccctcgaagaagaacggaactgtcggtgctcacgccgcatcaagggccaagaagcctcctccaccttggtggcccataaacttcaatggaactccccaaagcttttgacacccggtggcaacgattatttgggaggccaataacttgttgcacgggtagcgaaaactacttcaaatttgggttgggaggttttcccgaaattcaaagggaaatgatgggggttttgtgatcaatcaaagaacccaggct

SEQ ID NO: 95730 - protein, 155 aa, Zea mays
  misc_feature: Ceres CLONE 1586080
  misc_feature (30)..(155): Pfam Name: PK Pfam Description: Pyruvate kinase, barrel domain
  misc_feature: SWISSPROT Homolog: EC 2.7.1.40 Pyruvate kinase
MHSTNLLLEEPIRMDSILEPSKTSFFPAMTKIVGTLGPKSRSVDTISSCLKAGMSVARFDFSCGDAAYHQETLENLKLAIKSTKKLCAVMLDTVGPELHVVNKSEPPISLEEERNCRCSRRIKGQEASSTLVAHKLQWNSPKLLTPGGNDYLGGQ

SEQ ID NO: 95731 - DNA, 1103 bp, Zea mays
  misc_feature: Ceres CLONE 1586081
  misc_feature (14)..(14): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (76)..(76): n is a, c, t, g, unknown, or other
  misc_feature (77)..(77): n is a, c, t, g, unknown, or other
  misc_feature (1081)..(1081): n is a, c, t, g, unknown, or other
  misc_feature (1083)..(1083): n is a, c, t, g, unknown, or other
ttttttttctctcnccccctttttttttgattgatatttgtataaagtagtgtagtgtatgggtaagnnntatttnntttttttaattggaactccccgcggtggcggccgctctagaactagtggatcccccgggctgcaggaattcgtctcacccctagaaaactcctgctacaaataaaaattcgtggggcggccaaaccctaaaacgccccacagcgcaagcgagcagatcctcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttacctttaatctgtttagttccattgcatcttctgcggttgcggttagtattgctgtttcttgctccttgtttcttgttcttttgcttctaaccatggacccagggaacctactccatcctcaccagagaaaaaccacacggcaggcagcggcgcgggcccccttcttcaggagggccgggactcgggcccctacatgaccggtcacttaaaacaccaggaatccgccccataacccgttccggcccaaggtggcttaaccgggcataataaggtgtcaattcccccgagaacaagggttccggatcgaaattgggagatatttggggaacaatttagggcgagaaaactttaacaccttggcttctaaaacgggaaaggccccaaatggaaaagacggagaacaaaggggaaaataaacaccccatggctgtgggtaaacacatttacccccaccatttcctaagaggaaaggaccgtataaccccgaaaaaggggccttctccccacccccacaaaagaaaaatttgccctcccaaacacaaacccggaaaaaaaccaccaattccccgttgtgcccctgtttaaggagaaaaaaaaagcgcgcgcactagagatgttcctaaataaatacagctcctggcgggcaaaagcgcatctacnangatcttctccccttacacaa

SEQ ID NO: 95732 - DNA, 800 bp, Zea mays
  misc_feature: Ceres CLONE 1586083
aaagctggagctccccgcggtggcggccgctctagaactagtggatcccccgggctgcaggaattcgtctcacccctagaaaaaaccgagctgtatccctgtctcgatcgcttgacagactcgactgtaatttgctaggcaacgtgcgcgtgcacaactattcgacttagtgtggagtcacgttcaacactacacacatgttcctgctgcgtgatctctgaccgcgtctgacaactactgctagcatcctacgttctgatgcgcggccacggtatcttcctgagtgaccctcggccccgccgtgcaccaccaggccggctggttcaccaccagtgtgtgactgacgaacgcgcttctgcgccgtcataggtctagccactatcttgtcgtcacctctgcgacgagactccaacaggaggacatccctgtgaccatcgacgacctggtacctatgatctcatcgggcgagcgcttacgacagatagatctgcacgaagaggttgaacgtccgatgcagcagagaatgctacggtccgctcgtactcgtcgacagggtgctcctcattgagatatccgctacggcgagatagtctttgctcttacaaagctggaacatgcgctgcttctcccccagatgcgagatgctagaagtgcttgtcgaaaccagcttcgatgacgttgtctcagctgtatctgctacgagatcaccgattcacttcttaccgccatgaaagtacgttagttacactactttggtctgagacgggcgcaactgccatgatggtgagtcagtcccgacc

SEQ ID NO: 95733 - DNA, 1057 bp, Zea mays
  misc_feature: Ceres CLONE 1586085
  misc_feature: Translation starting site: 177
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (69)..(69): n is a, c, t, g, unknown, or other
  misc_feature (71)..(71): n is a, c, t, g, unknown, or other
gttttgttgcgggtggtggcctattttacaggaagaagagagggaaaaaaagtgggaatnnnngggggngntggtgtgttggggctccccgcggtggcggccgctctagaactagtggatcccccgggctgcaggaattcgtctcacccctagaaaaaaaaaccctagcatctctcatggacgacggcgacggcggactgagcttcgacttcgagggcggcctcgactctgccccggcggccgggggccccgtgccgtcctccactgaccctggcgcgggaggcggcaacgggccggggtatgcacgggcgcggccgaagtcccgggacctaccgccagacggtgtgcccccactggcttcgggggctatgcatataagggcgaggcgtgccggtttcctgcccccagttcggacaagggccgtcatggcccttctgcccttttctttccgcgaatttccgggtaatggcaccgaaacccaaccccccccataccaaacactccgtttcgaagaacgtctaggggggggccaacttggtacaaaaatggggggtttttgttcccaattggggcccctaaaatgggccggggatcaagggccacttctcaaggcttccccggggggccgcccccgcctcttcctgtgggggaggaaaatttccctccgcgaaaaaaatttgtgtggcagaatgtcccctcccctttttgagccgaaaatccgggggcggggaatttgggagagggggggggtcttgtgtaaacccccccccagggggggagaagaggcccccaagcgatcccccccgggggggttctcggcgcttgtgcccctaacccgagtatccccgcgccggaaaaaatggcctccgggtctggcggcgctccaccccctcctgggggggggacaaataaaggtcccataagccgtggaagttaaagggccccccccgcgggagggggggcgaaaagccccagattacaaatgggccccgcgcgcccaggggtgggttctatagggggcctctcgggcccctctaatattcgcaccgcaccgctg

SEQ ID NO: 95734 - DNA, 1194 bp, Zea mays
  misc_feature: Ceres CLONE 1586088
  misc_feature: Encodes the peptide sequence at SEQ ID NO. 95735
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (58)..(58): n is a, c, t, g, unknown, or other
  misc_feature (59)..(59): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (888)..(888): n is a, c, t, g, unknown, or other
  misc_feature (890)..(890): n is a, c, t, g, unknown, or other
ggcggggtggccctgggtatcgggctccgcggcggttggtcgggtgccannnacaatnnaagcnnnaaaggtgtgggtgtcataagctggactccccgcggtggcggccgctctagaactagtggatcccccgggctgcaggaattcgtctcacccctagaaaaacagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccactcctcgagccgaccatccgcctgccgtccgagcgcgcggcggccgacgaaacggacgacgacgccgtcgggacccggggggccgtgctcatcgcccgctccaacggctactacaactaccgccaccaggacgacctctgccatgcataccagattcatgaaaaaagggcggaacttaagggacgagaaaaatccgttggccttccatgtacccatgaaaatccccgccatttatccccgtaaaaaatccgaagggccctggggtgttcattcattaaaaaccctttctccccacgcgggtgggtcccgacccctcctaatttggttgtgggggggtggccccaaaatgggaatattaccccacccgggagtgtgccaaaggatactcgttgccaaaacgccgcgcccgaacactaatattttttctcttataccccccctctgtttttcttcccgctcgcttatgttggagtcccaacactcctaaataatcgttggggctactctctccataagggggaggttgtgggggacaaactactccgtgtgacataatagaggttntngtatgatgtggaaaacgatattggtctgccccacaccaaatgtgagagaccccactgtcattatattttccgagcgttctatcctctttatccagaggggagacgccctctatggtgtgtgggagtccacctctgtggcgcttcctctcttgtaggggtatggggccctctaagcagtgtgtcaccgcacacctcgctgctaccggggggggggatcgacccccaccctctttgataaattttcgccctaagaaaaataataataccaatatccttgccccgcgggaaacaaacacaaataacc

SEQ ID NO: 95735 - protein, 103 aa, Zea mays
  misc_feature: Ceres CLONE 1586088
  misc_feature: SWISSPROT Homolog: EC 3.4.22.34 Legumain
MVADRLRLALLLSACLCSAWARPLLEPTIRLPSERAAADETDDDAVGTRGAVLIARSNGYYNYRHQDDLCHAYQIHEKRAELKGREKSVGLPCTHENPRHLSP

SEQ ID NO: 95736 - DNA, 882 bp, Zea mays
  misc_feature: Ceres CLONE 1586089
  misc_feature (297)..(297): n is a, c, t, g, unknown, or other
  misc_feature (313)..(313): n is a, c, t, g, unknown, or other
  misc_feature (314)..(314): n is a, c, t, g, unknown, or other
  misc_feature (374)..(374): n is a, c, t, g, unknown, or other
  misc_feature (781)..(781): n is a, c, t, g, unknown, or other
  misc_feature (783)..(783): n is a, c, t, g, unknown, or other
aagctggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtggatgggccggcaatcggcatcgatctcggcacgacctactcttgcgtcggtgtgtggcagcacgaccgtgtcgagatcatcgccnacgaccagggtaaccnngcacacacctcgtacgtcggcttcaccgactccgagcgcctcatcggagatgcggcccangacccagggtcgccatgaacccccatccacacccggtctttgaatgcccaagcgttctcattgggcagggagggtttagttgatggccccctggcccagaagggaaaatttaaagctgggtgggccttttcaaaggggcctttccctcgggggccccggggggaaaaataacccaaaatgaaaaaatgtttgttgttcccccccccacaagggggggggggggggaggaaaaaaacatttttttcgaccccaaaaaaaaaaaacctccccccccccggggggcttccccaccaaaaaaagggggggggaaaaaacccccgaaaaaatctctcccctgtggggggccccccaaaataaaaaaagaagtgtgggttttccccgggcccccccccccatctttttttttnanacccccccaaaaaagggagggggcgccccaaagaaaaaagaaggggggggggggataatttattccccccccccaccctaagtggtgggggaaatataa

SEQ ID NO: 95737 - DNA, 817 bp, Zea mays
  misc_feature: Ceres CLONE 1586093
  misc_feature: Encodes the peptide sequence at SEQ ID NO. 95738
  misc_feature (741)..(741): n is a, c, t, g, unknown, or other
  misc_feature (742)..(742): n is a, c, t, g, unknown, or other
ctggagctccccgcggtggcggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccagctccctcctcacggcccccaagccctccgccgcggcctccgacctccccgagggcgctcagtggcgctacagcgagttcctctccgccgtcaagcgcggcaaggtcgagcgcgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctctttccttttatcgcgttcgctgggctctttcttctcttcnngcgcgcgcaaggcgagcccggcgccggggctggtggcctcagcaggcccatggacttctgccgctccaagagaaa

SEQ ID NO: 95738 - protein, 221 aa, Zea mays
  misc_feature: Ceres CLONE 1586093
  misc_feature (103)..(220): Pfam Name: FtsH_ext Pfam Description: FtsH Extracellular
  misc_feature (197)..(197): Xaa is any aa, unknown, or other
MAPPSVSASHLLITASLPKPKPSSLRPPRLPLAKPLPASAALLALAASPALAADAPAPAPAPTPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGFVAFVGNLLFPFIAFAGLFLLFXRAQGEPGAGAGGLSRPMDFCRSKR

SEQ ID NO: 95739 - DNA, 812 bp, Zea mays
  misc_feature: Ceres CLONE 1586095
ctggagctccccgcggtggcggccgctctagaactagtggatcccccgggctgcaggaattcgtctcacccctagaaaaaatcgggcacaggtgtgagccttcctcttctgtctgcttgcttctccttctaggtagctagcgcctgctccccttctggtgtgatcatgtcttgcgctagcgacgactaccattgtgggtccaactgctcctgcggcagtgctgctgcctgcgtgtcaccctaagatggagaacgagaagctgatcatcatgacgagaaaggtgctgttcatacacacgatctaggtcactgctcgtgaggtgccaagtcagccacctagggtttcgtggttgggactggaaaacgggtgccaacctgcggaacctgggctggccggcccccccgccccaaattgggtttttttcaaccttacccccggggtgttccatagagggggcttttaccggggacagaaaacaaccaggattctcgtgggaaaaaaaaaaacagcggggcgaataaaaaaaaaaaaaccttttgaaccgggccccccccaacattgtgtttttctcccggggtgttttccccccggggctttcttttattttttatttgggggggggggcccccccccgaaaaagggggggggggcgccccccccccccccggttcttttttttttttgggggatatttttctgggggggggaaaaaaaaataaaaaaaaaaaaccctcttccaaacaaaagagggggggcgcccaaaaaaaaacccaaccctccctcccccgcgggggggcggggggggcaaacct

SEQ ID NO: 95740 - DNA, 799 bp, Zea mays
  misc_feature: Ceres CLONE 1586096
  misc_feature: Encodes the peptide sequence at SEQ ID NO. 95741
  misc_feature (751)..(751): n is a, c, t, g, unknown, or other
  misc_feature (753)..(753): n is a, c, t, g, unknown, or other
  misc_feature (754)..(754): n is a, c, t, g, unknown, or other
ctggagctccccgcggtggcggccgctctagaactagtggatcccccgggctgcaggaattcgtctcacccctagaaaaaatcacaaatcatattacaggtctgatggtatatctcagtatagaagatggaaatagcgatatttttttgtttataaactcccctggcgggtggctaatctcaggaatggcgatttttgatacgatgcaaacggtgacacctgatatatatacaatatgcctcggaatagccgcgtccatggcctccttcattctgcttggaggagaacccaccaagcgtatagcattccctcacgctaggattatgcttcaccaacctgctagtgcttattatcgggcaaggacaccagaatttttactagaagtggaagagttacacaaagttcgcgaaatgatcacaagggtttatgcactaagaacaggcaagcctttttgggttgtatccgaagacatcgaaagggatgtttttatgtcagcagacgaagccaaagcttatggacttgtcgatattgtaggggatgaaatgattgacgagcactgcgatactgatccagtgtggtttccagaaatgtttaaggattggtaggtggggtggatttcttgtaaatttatctcaaacctaaattcgggttttatgctatagaaaatagaaatacttcatgatgatgaatcatcaggttaagatcgatctaaaccaatccattttatatatacatacgacatgccaacggntnnaacaaactatagaaaatgcagacagccaatacgaaatgctagaaa

SEQ ID NO: 95741 - protein, 200 aa, Zea mays
  misc_feature: Ceres CLONE 1586096
  misc_feature (4)..(181): Pfam Name: CLP_protease Pfam Description: Clp protease
  misc_feature: SWISSPROT Homolog: EC 3.4.21.92 Endopeptidase Clp
GAPRGGGRSRTSGSPGLQEFVSPLEKITNHITGLMVYLSIEDGNSDIFLFINSPGGWLISGMAIFDTMQTVTPDIYTICLGIAASMASFILLGGEPTKRIAFPHARIMLHQPASAYYRARTPEFLLEVEELHKVREMITRVYALRTGKPFWVVSEDIERDVFMSADEAKAYGLVDIVGDEMIDEHCDTDPVWFPEMFKDW

SEQ ID NO: 95742 - DNA, 916 bp, Zea mays
  misc_feature: Ceres CLONE 1586097
  misc_feature: Translation starting site: 154
  misc_feature: SWISSPROT Homolog: EC 6.1.1.17 Glutamate--tRNA ligase
  misc_feature (466)..(466): n is a, c, t, g, unknown, or other
  misc_feature (489)..(489): n is a, c, t, g, unknown, or other
tggagctccccgcggtggcggccgctctagaactagtggatcccccgggctgcaggaattcgtctcacccctagaaaaacatttcgtcgcaatcctcaaaaagggaagacatggcggcgagcgcactgctgatcggggtcgccgtggctgcgcatgcgcctcctaccggacgcgcccgcgcgccccttccgccacctccacctccgccggagcttctccgtccgcgcctccggcgccgacagcagccccgcccccgtccgcgttccgcttcgcgccgttcgcccacccgagacctccacgtcggcgggccccgcaccgcgctcttcaactacctcttcgcgcgcctcaagggggggccgcttccctggcccccgcgtcaaggaacccgaacctcaagcgctccccccgggaagtccgcaaggaggccggtccctcccccgacctccgcctcggttccggtctaganctggggacgaaggtccccgatgntcccgtggggggattttttgggcccttatcgcccagtcagagccgggaactcactggttacaaaacagtatgcctggagaagctttttgggaccccctggttggcggtttttacccccttgcttttttggctccccgccaaggaactccgagccaaattgaaagggaagtccccaaaagcagaagacaaccttcctccctgggtttattattggggggaaaagtggggccaaagggccttcccaattgcagagtttcccaccgggaggtttaagaaaagggacccccttacccttttccccgcttcccgtgtgccccaaaaggaggggcttttggaaaataggggaccttattctccggggggaagggccatttggactttaaacccccccggggggaattccggggtttttagagacattgggaac

SEQ ID NO: 95743 - DNA, 823 bp, Zea mays
  misc_feature: Ceres CLONE 1586099
  misc_feature: Encodes the peptide sequence at SEQ ID NO. 95744
  misc_feature (347)..(347): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (353)..(353): n is a, c, t, g, unknown, or other
  misc_feature (354)..(354): n is a, c, t, g, unknown, or other
  misc_feature (357)..(357): n is a, c, t, g, unknown, or other
  misc_feature (359)..(359): n is a, c, t, g, unknown, or other
ctggagctccccgcggtggcggccgctctagaactagtggatcccccgggctgcaggaattcgtctcacccctagaaaaactcccttcttcgcctcccaatttccaaacctctctcttgggactgggagcacgtacacgcggaggaaaagcgatcggcgccgcggcggcaagatgactgcggcggcgacgatgacgtggcacgaggacctggccactctcgtgggggacacggacgttcacctcaccggcgccggggggcacgcgccggcgccggcggatgttacgccggcgggggccgggtggtacggggaggaggaagaggtgagggcggaggagggggtgggcncnnncnngcnanggggttcgcggagtcgacggcggagatgctgcgggagctgggccgtgggctgtgggacgtcgccgcgcatagcctcgccggcgccgaggacagcgagctcgggcggcggctgcggaagcgggcggcggccacgggggagcgcctcagcttcatgaacgagtaccttcccgaggagcgcgacccagtgaggtgttggctcatcgtcgccgcagtctcattcgtcacgctcctagttttaggtgctgggaatggcaatgaaaaccccgtagagctcccaaagaaacttaccatctgtcccccaaggggtgatggaatccaccttgctgagggaacacatcttggctaatgaaaaacagggaggctcccctaacaaagcgagaatttcacgggattggtcccacatcggtttcttccctcaaggctaaaggggatttccctggaataagggggtcccctcctgaaaa

SEQ ID NO: 95744 - protein, 106 aa, Zea mays
  misc_feature: Ceres CLONE 1586099
MLRELGRGLWDVAAHSLAGAEDSELGRRLRKRAAATGERLSFMNEYLPEERDPVRCWLIVAAVSFVTLLVLGAGNGNENPVELPKKLTICPPRGDGIHLAEGTHLG

SEQ ID NO: 95745 - DNA, 793 bp, Zea mays
  misc_feature: Ceres CLONE 1586101
  misc_feature: Translation starting site: 206
  misc_feature: SWISSPROT Homolog: EC 3.6.5.5 Dynamin GTPase
  misc_feature (369)..(369): n is a, c, t, g, unknown, or other
  misc_feature (414)..(414): n is a, c, t, g, unknown, or other
  misc_feature (611)..(611): n is a, c, t, g, unknown, or other
ctccccgcggtggcggccgctctagaactagtggatcccccgggctgcaggaattcgtctcacccctagaaaaagcctagacgcggctgggcggtcggcctcacctcgttccccctcctcccttcttcctgctccgcgtctcgatctcgactcccccgccgcgtcgcgcgacccggccagatctcgcccaccctgcgccgcggccatggataacttgatcaccctcgtcaacaagctgcagagggcttgcacggctctcggagaccacggagaggagagcgccctcccgacgctctgggactcgctgccggctatcgccgtcgttggaggacagagctctggtaaatcatctgtgttggagagcgtggnttgggaaggatttcctaccgaggggttcaggcattgtaacccgtncgtccgctggtgctgcagctccacagaattgatggtgacagggaatatgcagagttcatgcatcttccgagaaaaagatttacagattttgctgctgtgagaaaggagatagctgatggaactgaccgagaaacagggcgttcaaagcaaatatcaactgtcccctatccatttaagcatattttctccccatggtngtgaaatcttactcttattgatcctccctgggcttacttaaagtagcagttgatgggccaaccggagagtatggtacatggacattgaaaacatgggtccgctcatataatgaaaaagccaattgtgaatcattctgggctgtttcccccagccaatcagggaccttggctacttcctgata

SEQ ID NO: 95746 - DNA, 1106 bp, Zea mays
  misc_feature: Ceres CLONE 1586104
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (47)..(47): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (353)..(353): n is a, c, t, g, unknown, or other
  misc_feature (829)..(829): n is a, c, t, g, unknown, or other
  misc_feature (834)..(834): n is a, c, t, g, unknown, or other
  misc_feature (836)..(836): n is a, c, t, g, unknown, or other
  misc_feature (874)..(874): n is a, c, t, g, unknown, or other
  misc_feature (897)..(897): n is a, c, t, g, unknown, or other
  misc_feature (898)..(898): n is a, c, t, g, unknown, or other
  misc_feature (900)..(900): n is a, c, t, g, unknown, or other
  misc_feature (901)..(901): n is a, c, t, g, unknown, or other
  misc_feature (934)..(934): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (949)..(949): n is a, c, t, g, unknown, or other
  misc_feature (986)..(986): n is a, c, t, g, unknown, or other
  misc_feature (992)..(992): n is a, c, t, g, unknown, or other
  misc_feature (994)..(994): n is a, c, t, g, unknown, or other
  misc_feature (1024)..(1024): n is a, c, t, g, unknown, or other
  misc_feature (1044)..(1044): n is a, c, t, g, unknown, or other
  misc_feature (1046)..(1046): n is a, c, t, g, unknown, or other
  misc_feature (1073)..(1073): n is a, c, t, g, unknown, or other
  misc_feature (1075)..(1075): n is a, c, t, g, unknown, or other
  misc_feature (1078)..(1078): n is a, c, t, g, unknown, or other
  misc_feature (1103)..(1103): n is a, c, t, g, unknown, or other
gggggggggggggnnggggnnnnnnnnnnnnnnnnnnnnnnnnnggngggnnnnnnnnnnnnnnnnnnnnnnnnnnnnnnggctgnnnnggtcaaagctggagctccccgcggtggcggccgctctagaactagtggatcccccgggctgcaggaattcgtctcacccctagaaaaaccgcgcgtcacgttcgcatcgcttctggttcgggtctcacctctcgcgatcaaagcagtagcgggttcagtggcttggcgaagggaaaaaaagggagaaaaaaaatagcaaggctgtgcagcgaagaaacaactcgactcaactggggggccgaaaattaaaaaaaggattaggcngggcccaaccggggggccccccccctcccaaataccccccccggccggggaaaacccatccccccttggccccctaaaattggaaaacccgggttttccccccccgaaaccccacattggggggggtcacgggtcttttaaaacacccgggttaaagggggttaagagaacccccccccccttttttttctaaaatggaaacccccccttgtttttgggggggggtgttctccctttttcccccccccgggggggggttttttttcttcccgcgcccaaaaaaaataaataatataataggagccccccccttttttttattcccccccgggcgggggggggggggggggttttttttttttaaatcaccaccccccccccccctctgaggggggggggggggaggaagggaaagaaaaaatttttttttttttttttctcgccgcggggatgttttataatcaccctcttctaanctggngngggcggggggggggggggggggcccgccccccgctccntaattatattaattaaaataaannanncaaaaaagggggccgcccgccgcgcgcgcgcgngggcgnnnnnnnnanttattttatttttttttttttttttgtgtggtgcggnggccgngnccacccacaaaagggagaaaaaaaagaagngtggtgtctgttcctcctgncnccccgccccccccgtcctccgcccttngntcngataagtgtaggaggtgatgagganggc

SEQ ID NO: 95747 - DNA, 918 bp, Zea mays
  misc_feature: Ceres CLONE 1586106
  misc_feature (260)..(260): n is a, c, t, g, unknown, or other
  misc_feature (262)..(262): n is a, c, t, g, unknown, or other
  misc_feature (263)..(263): n is a, c, t, g, unknown, or other
ccccgcggtggcggccgctctagaactagtggatcccccgggctgcaggaattcgtctcacccctagaaaacgcaggcggtatccttccttcctcggttcctctcctctcccccaccagccccaccccagcgccccaaatgccgctccaaccctagcctcccgccacgcctttcgatctcgggcggccatgggcaactgctgccgctcgccggccgccgtcgcgcggggaggaacgttccaggctcccctccgcaacctngnngtggttttttaagggaaataggaacaactgagaaacatctatagccaccacgaagatggtaccccgccagtgtgatgtatagtcgggggtatgtttgcccctggtacgaagtaaaaggtgtgggtgggaggcgcattgtatcttgtgggtgcgcttgtgtctgcgtgtggcggatagtagaacggacatttagggagcgtttattgtgtatttatttgttatgggggtgtgtttattgtttgttgtgggatttgtggaggtgttttatttttggctgtctttttttagagatatatcgtactctcggattcttacacgtcacccggattatattttttatgatggtagcttagtacatggtgtgagaaggggagtatgaagggggagagacaggcgaaggtagaaaatatatacatcaaaataataggcttggttaaatgattgatctattgccttttatttattattaaccacggttgattacttccatcttggtgggacgaggttgcttcatgtggccgaattatatatattccctgtaacgaatgtctcaaggctcctatcatccgactgctctcagaagaaaaggaggggctgggtgtcgcgggtcgtgttgtgccgccgtcctctgtttcttcccgcccgtgttcccgcg

SEQ ID NO: 95748 - DNA, 792 bp, Zea mays
  misc_feature: Ceres CLONE 1586107
  misc_feature: Translation starting site: 191
  misc_feature: SWISSPROT Homolog: EC 1.4.1.2 Glutamate dehydrogenase
  misc_feature (575)..(575): n is a, c, t, g, unknown, or other
  misc_feature (677)..(677): n is a, c, t, g, unknown, or other
  misc_feature (691)..(691): n is a, c, t, g, unknown, or other
tggagctccccgcggtggcggccgctctagaactagtggatcccccgggctgcaggaattcgtctcacccctagaaaaactcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaagggtcattcctgggcccggtgagaagccaatgatagttgttcagcacaagggggagggagaacagtttgcagccgaagagatctcctccatggttctncatcagatgcgtgagatcgctgaagcttaccttggcagcacgatcaagaatgctggtgtcacggtccctggctacttcaacgactcacagaggcaggccacnaaggatgctggggntgattgctggcctcaatgggctgcgtatcatcaatggagcaaccgctgctgcttattgctatgggctggacaggagggaacccgcggtcggtaaaagaatt

SEQ ID NO: 95749 - DNA, 783 bp, Zea mays
  misc_feature: Ceres CLONE 1586108
  misc_feature: Translation starting site: 172
  misc_feature (450)..(450): n is a, c, t, g, unknown, or other
ctggagctccccgcggtggcggccgctctagaactagtggatcccccgggctgcaggaattcgtctcacccctagaaaaagttcttctctctccttcttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgagcgcctccgcctgtcctcgcgctcaccgcgcgtctggcccgacctcgcgtcaactggcgggtggtggtcgccaccgtcgtcaggttcctcggttccgcgtttggcaccgtcngcggcgtccgcggaggcgggatcttcgtgcccatgctcaacctcgtcgtcggcttcgacacaaatcccgcgccgcgctctccaatgcatgatcatggggggctcggcgtcatcagttttgtacaaccctcaggtgtcgcacccgaccaaagaagcgcccgtcatcgactacaagctcgcgttgctcttcagcccatgcttatgctcggcataaacatcggcgtagagctcagcgtcatcttccatactggctatcactgtcctcattataatctcttcgtaggccctcctcgagatcctctacaaggcatctgatgtggaaggaggatcaaga

SEQ ID NO: 95750 - DNA, 922 bp, Zea mays
  misc_feature: Ceres CLONE 1586110
  misc_feature (278)..(278): n is a, c, t, g, unknown, or other
  misc_feature (286)..(286): n is a, c, t, g, unknown, or other
  misc_feature (760)..(760): n is a, c, t, g, unknown, or other
ctggagctccccgcggtggcggccgctctagaactagtggatcccccgggctgcaggaattcgtctcacccctagaaaaaactgcttcctctcgaggctccgagccgcccgttagtagtgtagacctgcctccgccttctcctcgccaacgcgccaccgcagtaaagagcgcggattaattccagggcgaggggggagactcacctccattacgctccgtcccccttccccggcgtgcaccgtgcagtaggtatctgtgcattcctgccctgctgtgntgggctangtaagggttgttactggtaaatacaccaagaccaaacctgggctgccgaatttggggtccgggtcaacgggtgggccaacccggagttggcttttcccacccccttgggcggggatttcttttttgggaaagggggccccccccgggggccggggtccttggaaaaatttcccgaaaaaatttttggaaaaaaaaaaagggtttttttttttaaccccccccccggggaaaattttttttcccccccccccccgggttgtgggaaaaaaaatagttttttttttttttaatattaaggggggggccccccccccgccgggggggggggcgccccccccccccccccgccccggaaaaagaaaaaaaaacccggcggagaggtggtggttttcttttatatataaaaaccccccccccccctctttttcttttttttttgctttggagagaaagagggagagggcggggccgcgnggtttttctctttttttttcttttttccccccccccccaataaaaagagagagggagggggatgtggaggagtgtttttaaattcatataatacaatgtcgaccacccccgcctggtaggcagtatttatgctttattattatatcccggcgccgcccaccc

SEQ ID NO: 95751 - DNA, 1220 bp, Zea mays
  misc_feature: Ceres CLONE 1586112
tgggtggttgttttttattcgcgccggcagccctgagctttatatttgtttataattttttatatagaaattataaaactggagctcaccgcggtggcggccgctctagaatagtggatcccccgggctgcaggaattcgtctcacccctagaataaatgtaaaccacactccactccagcactgaacacttgattgattcagtgggtagctaggctagctgaatcacaatggatcctaccaagttcccgtccgtcctgtagccaccacacaacggttgacaacgacgaacgctgggccctcctttgtgagaacgacaacgaggcgcttaccgttggggccctcgccgtccccatcctgtctggagggaactaccacttgatcgaaggaaggtgggcgcaccttctgcgcgcctagcaccatccccggaaaaccccgtggtgccaacgctcacccgggggccccccccccaagggggcctcccttccaagtgccgccccatcgaaagtgaatttcaccttaaacctagcagccaaaaattccatttcatcatcccccaccgaattttgacggggaacccccccgtggaccgcggtacgacctttcgtcgaaacaggggggcgcccccccaagccggggggtgttcccccccgtgtaaaaccgattctcggggaagccctcggcgacgggaatttaccccctccggataatatctgttttttaacaacaccgggtgggagggggggaaaaactggggagaaaactcttttttttggggggaaaacaatttgccttcgtcccccgcttgtgtacttagtattaaatgcccgcccctctaacacgagaatcaatatattgttatcatcacccgccaaaggcggagaaaacgaccaaccctagatttctaagaagccaccaacaccactgtggtggatttgtctcctgcgcgcttatactgttaaggtgtacatttatgtgctcaagtggtttgcgttctcgccaccacccaagacttgtgtttccaaccacgtagtacccttcgtaataagagccgtgtctgaaccccgcacctgttccgtttgtttgttcgcgtgttgttttgtggctatgatacaccccgggggtggctacaaacacccccccccccgctcttacacccccccctatactatgagagtgcaaaagactctcgctccacgcctatctctattaatctacccc

SEQ ID NO: 95752 - DNA, 841 bp, Zea mays
  misc_feature: Ceres CLONE 1586113
  misc_feature: Encodes the peptide sequence at SEQ ID NO. 95753
tggagctccccgcggtggcggccgctctagaactagtggatcccccgggctgcaggaattcgtctcacccctagaaaaagcacgacgcctacatctgtcaaccacaacccaagcgctcccccctccccgtcgcctgcaggatctcctcgggccaaggaatcgttcccctccggcgaccttcctccctccctccgttccgtttcggtccttccactgtatcaccggcaaagcaaaggatcggaggccactccgcccggaggagcaagccgactctgagcattggagttgtgcttgttcaaaaagtgtgaattgcatggagatgggaatgactcctgatgtaatgtatggacaaaatgtttttgttcctgctactgcaactccctaccaatatggttatgcagaagttggatcacagatggaatgggtgtaaccccgtcgagctctttaggatatgatggccaagataatttctatcccactgaaggcatgcaatgcgtatactacgcagcccccagacaacggatctgtggcatcctacctacagttcttacccttctgatcctttctttcgtacccccgatgggtcatttattgcctcaggaagatttttgctgacccccgctaactccccctggccaaatagcccccgacttcccttttatttttccggcttgttcttcctttttgcccaaaaatagggccctgggggaaaggcgaaccacaattcttttcctcccaaactcccaaggtttgcttttttttcccggggatatacccagggtatatggcgtggaacattttgggaaaattgtccgcccattttcccttttaattgggcccc

SEQ ID NO: 95753 - protein, 38 aa, Zea mays
  misc_feature: Ceres CLONE 1586113
MEMGMTPDVMYGQNVFVPATATPYQYGYAEVGSQMEWV

SEQ ID NO: 95754 - DNA, 1076 bp, Zea mays
  misc_feature: Ceres CLONE 1586114
  misc_feature: Encodes the peptide sequence at SEQ ID NO. 95755
  misc_feature (18)..(18): n is a, c, t, g, unknown, or other
  misc_feature (36)..(36): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
ttttctttgtttgtttgntgggagggggacacaaanattgttttagatgttttatttattaaccgcccccnnnnaaagctggagctccccgcggtggcggccgctctagaactagtggatcccccgggctgcaggaattcgtctcacccctagaaaaaaatgcctgcgcattagcgatcctcctcgctctccttctccttccgctgagccgtgctgccgcggccccgggacgccatggcgtccgacgggtactcgcgggcgtcgtccaacacactgccgcgggggctaggggcggctgcccccgcgccctctaccgggcctcacgttccaaatcgagccccagaagctgggcggcggcctccgtcccccgcttcttcctggccctcctcagcgttcccctccctcgtccaaactttttcccgggcctcccccctggttttcccccagaacgggccaaaaccatccggggcctgtaggcccccaaaccccgccaattgggcctcctccccaagccctccctggccggaaaaacggggaaccttccccccccggaaaaaaaacctgtggaacaccggccaaacgtccccggatatcccgggcaaacctccgggggggaacaggaaccccgggctttgcccaaaaagcccgccccgcctcggaggggaaatcaaactttgtggccccggggggtccccaaatgagccccggggtttttcccccccccggggtaaagaaagggcccgctttgtggaatttggggaaagggcccgaaccccccccccaaaaaaagcaccctgctttgaggaggagggaaaagggggcggggcgcccccaagtttgggcccaaaaatgaggctgtggaacacgaaaagaaaaagtgttggtcacattaggcggtttcccccgtggactcccccgcgccagaatccggtggggcaacagcctgttccgggcgagaaccccctcccctgtgttacccccttattccacagaaaagaggggggtgtcgcggggggtaaacaccccccacaccaaaaatacagtggttctcctggtgttttcattaaaaagaaatg

SEQ ID NO: 95755 - protein, 75 aa, Zea mays
  misc_feature: Ceres CLONE 1586114
MRLWNTKRKSVGHIRRFPPWTPPRQNPVGQQPVPGENPLPCVTPLFHRKEGGVAGGKHPPHQKYSGSPGVFIKKK

SEQ ID NO: 95756 - DNA, 832 bp, Zea mays
  misc_feature: Ceres CLONE 1586116
  misc_feature: Encodes the peptide sequence at SEQ ID NO. 95757
  misc_feature (832)..(832): n is a, c, t, g, unknown, or other
cggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagttaaagccttccccagctccctcctgacggaccccaagccctccgccgcggcctccgacctccccgagggcgctcagtggcgctacagcgagttcctctccgccgtcaagcgcggcaaggtcgagcgcgtgcgcttttccaaggagggcggtctgctccagctcaccgccgtcgacggccgccgcgccaccgtcgtcgtccccaacgaccccgacctcatagacatcctcgccgaccaacggcgtctaaatctccctctcaaagggtcgagtccgccggaccgggcgggctttcgtcaccttccccaggaaacctccttcttcccctttaattcgggtttggccgggcctccttcttcatctttccccccgaatcgcaaggggaggggcccgggggcccgggggcctgggggggcccccgggcgggagcccctggaaatcttggggccgcccccccaaaaaaan

SEQ ID NO: 95757 - protein, 232 aa, Zea mays
  misc_feature: Ceres CLONE 1586116
MAPPSVSASHLLITASLPKPKPSSLRPPRLPLAKPLPASAALLALAASPALAADAPAPAPAPTPAPAPELQAEAPTPTVKAFPSSLLTDPKPSAAASDLPEGAQWRYSEFLSAVKRGKVERVRFSKEGGLLQLTAVDGRRATVVVPNDPDLIDILADQRRLNLPLKGSSPPDRAGFRHLPQETSFFPFNSGLAGPPSSSFPPNRKGRGPGARGPGGAPGREPLEILGPPPQK

SEQ ID NO: 95758 - DNA, 939 bp, Zea mays
  misc_feature: Ceres CLONE 1586118
  misc_feature: Encodes the peptide sequence at SEQ ID NO. 95759
ctctccgcggtggcggccgctctagaactagtggatcccccgggctgcaggaattcgtctcacccctagaaaaagttcatcagtcaccacacatctcataccacatatcatcacacaccataccacatcgacgacttgagcgcgtgcgtgcgtgccctgatcgagcaccgattgccatggactcgacgacaacgacgacagcgccgctgctgcagccggccgccgccgcctcgagcaaggaggagccggcaccggcgtccccgcacggcgcgggcagctgggagctggaggcggtcctggccgacgcgtcgtcgccggtcttgcggcgggcctggggaaggcgcccgcctggagctgccgctggctgctgcgtgtggcgcctgccggcggggggcgttctacgtgatccaacttcgtcatgtcccatgttccacggcagatctttcttgcgggcattctcgggcaaccttggaagcttggcccgccgcgttcgcttcggcaaaccaccgggcattccagtcccctccgccctaacgggcctcattgggcgtgggggatgggggccagccccgggtggggaataacccctgtggcggggggcaggggcgttaacgggcggccgccaccaaagcaccgggcaatgggcttggggggggggggtacccctgggaatgcgggtgcccaaccggggtgccgtgcttgaatggggccaaccccccccgggggcccctctttggaaccggtggtgtggtaacgcccctttttttggggggcggcgcaatcctcggggggccccccccggggggccaagatccggaaaaccccattcttccaggggggccgcccccgccccttgttttcgttgttatcggggctctcattccccggcaatatatttttccggggtaaggcgggggcaaaattttcccccattatcag

SEQ ID NO: 95759 - protein, 135 aa, Zea mays
  misc_feature: Ceres CLONE 1586118
MDSTTTTTAPLLQPAAAASSKEEPAPASPHGAGSWELEAVLADASSPVLRRAWGRRPPGAAAGCCVWRLPAGGVLRDPTSSCPMFHGRSFLRAFSGNLGSLARRVRFGKPPGIPVPSALTGLIGRGGWGPAPGGE

SEQ ID NO: 95760 - DNA, 884 bp, Zea mays
  misc_feature: Ceres CLONE 1586120
  misc_feature: Encodes the peptide sequence at SEQ ID NO. 95761
ctccccgcggtggcggccgctctagaactagtggatcccccgggctgcaggaattcgtctcacccctagaaaaaggtgctcatcgtctatctgtcgtcagatgctcatcttgaaacatttacatcttgagccgaggcgccgagctgactagcagagggccatcttctactcttctctcccagccaacccccttgtccaacggttcagcctgctcaattttagtgaccagttacagcaaatgcagccctcggcggacagcaggaagaagaagcggcggcggcggaggatgaggaggctggcggcatgctactcatcgagacctgctgccggcgccgctcaaaggcagtgtcagtgcggctcctctagcccccgtggcggcgggggaagccgcagcctcgtggcaagaacaacccgcgcgttctcaagctgcttcagctaccccgccctcgtctgcccggcgcgaccgggggggggccgtccttttggggtccccagcacaaagcggacgggggctccctcgtcggggctcggggctcctcctagttcttccttcggccctcctttttttgggagggggttccccgggtggtggtcccccccccaggaaaggggaaaggatccgcccccccccctgggaaaaggttccaccaagaaccccccctggggctccccttggggaaggccggggagggggaaaccccttccaaatgggtggggcgggcccacaaaaaaccccggccctggaaccctcccccttccccaaggggggcacgccccttccaaaagggaaccccccccaaggccccccagagggggggaggggtgcgccttctcttttccccgggggggtgcttgggaaaaaaagaggaacggggcacagggaa

SEQ ID NO: 95761 - protein, 59 aa, Zea mays
  misc_feature: Ceres CLONE 1586120
MGGAGPQKTPALEPSPFPKGGTPLPKGNPPQGPPEGGRGAPSLFPGGVLGKKRGTGHRE

SEQ ID NO: 95762 - DNA, 848 bp, Zea mays
  misc_feature: Ceres CLONE 1586121
  misc_feature: Encodes the peptide sequence at SEQ ID NO. 95763
  misc_feature (405)..(405): n is a, c, t, g, unknown, or other
  misc_feature (802)..(802): n is a, c, t, g, unknown, or other
ctggagctccccgcggtggcggccgctctagaactagtggatcccccgggctgcaggaattcgtctcacccctagaaaaagaaaatgagaaggcagattcaagggttcgtctgatgcgagatcaaatgatcatggccagaatatattctgttcttgccaaatctagggacaaacttgatctctatcaggagctgctagcaagactcaaggaaagccagcgctcccttggggaagctactgctgatgccgaacttccgaagaggtggtgcctgctcgaactgtctaggcccaaattttcagtgttactgatttctctttctctattgattcatctcttctttaatttgcagtgcttcagatagaatcaaagcaatgggccaagttttatcaaaagcaagggatctngttgtatgattgcaaggaaattacccagcgtttgagagcaatgcttcagtcagcagatgagcaggtccggagcttgaagaagcagagcaccttccttagccagcttgcagctaagacaatcccaaatggcatccattgtctttctatgcgcttaacaattgattattaccttctctctccagagaaaagaaagttccccaatagcgagaacttggaaaatcctgatctttaccattatgctcttttctcagacaatgttttggcagcatcagttgtggtcaactcaaccatcatgaatgcggaggttagtgtaatccccatcttgaaactggaagtgtaaatctctcattatgtctaccattgaatgacccattatatagcacttttgattttcttnctataattttcaggagcctgaaaaacatgtgtttcaccttgttact

SEQ ID NO: 95763 - protein, 99 aa, Zea mays
  misc_feature: Ceres CLONE 1586121
MLQSADEQVRSLKKQSTFLSQLAAKTIPNGIHCLSMRLTIDYYLLSPEKRKFPNSENLENPDLYHYALFSDNVLAASVVVNSTIMNAEVSVIPILKLEV

SEQ ID NO: 95764 - DNA, 810 bp, Zea mays
  misc_feature: Ceres CLONE 1586122
  misc_feature: Encodes the peptide sequence at SEQ ID NO. 95765
  misc_feature (390)..(390): n is a, c, t, g, unknown, or other
  misc_feature (395)..(395): n is a, c, t, g, unknown, or other
ctccccgcggtggcggccgctctagaactagtggatcccccgggctgcaggaattcgtctcacccctagaaaaactcctcacacccctctctttctgtcggcggcgactgggcggccgtcgctgccgtcctacgccagctgcccaggtcttcctcgcgcccttcgccggcggcaaccaccgccagggtaagccagccatcagccatggctttgaaggcgagctccagcgacaaccggaccaggagcacggtatccctgtgcatagtgattggcatgtgctgcttcttctacatcctcggggcgtggcagaagagcgggttcggcaaggggggacagcatcgcgctggaggtcaccaagcgcaccgactgcaccgtcgtgccgaaccttancttcnacacccaccattctaaagccagtggcaactctagcagcctggtttctccgtcgaagaagtcaagccgtgccctgatctctacacggactacaccccctggcaagatcagaacagggcgatgaagttccctagggagatcatgaattacagagagcggcattgccgggcgcagaaggaaagctgcactgtttgggtcccccccaaaggctatgtggcttccgtcccctggccgaggagccgggactatgtcccttttcgcaaatgcccatataagaacttgacagtcgagaaagccctccagaactgggtccattatgaggggaatgtattcagattccccggggggaggaacgcaattccccgctgggagcaaaaaagttttattggtcagctttggatcagtcctttccaatcc

SEQ ID NO: 95765 - protein, 99 aa, Zea mays
  misc_feature: Ceres CLONE 1586122
MKFPREIMNYRERHCRAQKESCTVWVPPKGYVASVPWPRSRDYVPFRKCPYKNLTVEKALQNWVHYEGNVFRFPGGRNAIPRWEQKSFIGQLWISPFQS

SEQ ID NO: 95766 - DNA, 808 bp, Zea mays
  misc_feature: Ceres CLONE 1586124
  misc_feature: Encodes the peptide sequence at SEQ ID NO. 95767
ctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctggatcacgcgcagagcatcctcgccatctgggcctgccaggtcgtgctcatgggtgccgtcgagggctaccgcattgcccggcgggccgctccggcgaggtcgtcaacccccctgttccctggggggcagcttcgaacccctcgggcctggccgaacaacccccaaagcctttcgccgaaagctaaagggggaagggagctcaagaaccggcccccctcccccatttttttccaaggtt

SEQ ID NO: 95767 - protein, 227 aa, Zea mays
  misc_feature: Ceres CLONE 1586124
  misc_feature (61)..(217): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLDHAQSILAIWACQVVLMGAVEGYRIARRAAPARSSTPLFPGGQLRTPRAWPNNPQSLSPKAKGGRELKNRPPSPIFFQG

SEQ ID NO: 95768 - DNA, 826 bp, Zea mays
  misc_feature: Ceres CLONE 1586125
  misc_feature: Translation starting site: 350
  misc_feature (725)..(725): n is a, c, t, g, unknown, or other
  misc_feature (765)..(765): n is a, c, t, g, unknown, or other
ggagctccccgcggtggcggccgctctagaactagtggatcccccgggctgcaggaattcgtctcacccctagaaaaaagctagctactaccactcatgcccgcctcctacgctgctccctactcctcctctccctttcggctcccgatcccttcccgcgcgcgcacgtcgtccttcccgattcgctccgacgacgcaccgccgtgccgtcggctggatatagctgagctgcccgacccagcgcgccattaaaagacctctttcctcctcgatcgcggccgtgccaagcgcatagaccagcacgtaccacacgtttacgtgaacgaccgaccggcgcattccatcgtccatgggcaaccgcaagaagctggtccacttcctccgcgtcgacccggcggcggcggcggcctccgccctctcctcccctaggtccttctccgacgacgacggctacagctcctcctccttctcctcctcctcgccgtcgcggtacagcccgcccaagtcgccgtgggcgcgcctcccggggctcggcggcgccgacgccgccgccgcgacaggcctcatcgcgtcgctcgtcaaggaggacggcaaggtctactcgctggcggcgggccggggacgtgctgtacaccggcacgggactcggagaacgtgcgtgtgtggcgggaccggcgcgagctcgcggggttccgggacggcagcggcctcgttcagggcatcgntggtcgccgcccgacggccgcatcttcacgggccaccagnacgggcagggtccgggtggtggggggccaacgccgccaaccccgccgttgcaccgccgggg

SEQ ID NO: 95769 - DNA, 889 bp, Zea mays
  misc_feature: Ceres CLONE 1586126
  misc_feature (385)..(385): n is a, c, t, g, unknown, or other
ctccccgcggtggcggccgctctagaatagtggatcccccgggctgcaggaattcgtctcacccctagaaaaacttttccgctccagacacagcagcccctcttgtaccagtaaaccgtgctgctatcccccgctagccgccgcgctgctgcggctcgcctccctcctccccagtccccacgccccgccgccgccgccgccacctcctctcgctccctccttttaccccgagcttaagctcgcgcgtacctgcctacctatccgtaggagaggaagaggggaaaggcccggtcggtcggtcggtcggtcggggggctctcggatctcgccgctgcctcccccgtcgttcgttcgttcgttgggatctcgcgccatggccgccgtngcgccgcccccggcccccggggcgggaaccgggtcctggcccctgctcccggcaacgggccctggcgggggataaaaccacggaatctgccggaaaaaactgtcggctcgaaccccaaaccccaagccggggggaaacaaaaaaaagcctgggggggtggcccccggcaaaaaaggggccccgggggggaaaccaccccccttgaggcggggggaattcccccccggagaaccccccctccacgcccggggggtacccaaaacattttagggggaatggggggggcgcccccttacggggggaaaatattttccgggcgacttttccccagtttcaaaaaaatttgaaaggggcaaaaaggtgttgggggcgcccacttttttcccgaggttcccccgcgggggtttttttcgcgccccccctacccaacaaggggtcctttctccgccccccaaagaaggggccccccggccgccttctaaaaaaaaccgggaaaaaaccccg

SEQ ID NO: 95770 - DNA, 1220 bp, Zea mays
  misc_feature: Ceres CLONE 1586127
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (15)..(15): n is a, c, t, g, unknown, or other
  misc_feature (16)..(16): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (817)..(817): n is a, c, t, g, unknown, or other
  misc_feature (880)..(880): n is a, c, t, g, unknown, or other
  misc_feature (940)..(940): n is a, c, t, g, unknown, or other
  misc_feature (982)..(982): n is a, c, t, g, unknown, or other
  misc_feature (1002)..(1002): n is a, c, t, g, unknown, or other
  misc_feature (1025)..(1025): n is a, c, t, g, unknown, or other
  misc_feature (1040)..(1040): n is a, c, t, g, unknown, or other
  misc_feature (1106)..(1106): n is a, c, t, g, unknown, or other
  misc_feature (1220)..(1220): n is a, c, t, g, unknown, or other
nnnnnnnnncccaannaactaaaaaaccaaaaggaagagacgggcggggcggggggnnnnngtggnnnnnnnnaaatgtggggctcaccgcggtggcggccgctctagaactagtggatcccccgggctgcaggaattcgtctcacccctagaaaaagaatccccagaccaaatcgccgtcgccgtcggatcgcagcagcgggagtcccagggtcccggaccgaatccattgccagacacccaaggccaagatccatcgctcgttccaacctgcctcctccttcttctgcttggtcgtctgatctcgttttccgtgcggggtgcatcggaggcaggccaccgctgtgaatgattgggctaaaactgtcccacccgaccgggtcgggcgtggcggcggggggggcggggacacgagcggtggtgggacggggcggcggccggggcgtcaggggtggggtggtttttgtggcggtggcccacccaaggggagcccgggccgcggtagtgggttctgcgcccccctcccgcggcccccacgctgcaccaccgtggtaagggggagcaccggggccgcacgcggaaggaggccgccaaacagggtggaaagccatggagcggcgaggtagtggcggctggacaatggagcctatcatgggatagccccggcgcccccccgaaaggaagagattatgcgtcgaggatatgagcaaacccgccgggagagctcactgcggcaaatatatgagaagcaatgctgggtgttatctccgcgacatcagtacgacgtggagtacgtgaggaagcatgttctaggcanatcagcgccagcgtcggacggagatgcgcagtagactacgacatcccagtacgtgtagcgcgnacgagagcattgaacgtacgactggggtgctgggcacacgaatggcgaccagacaggcgngagcgccatatgagtagatatgatgggtggtgtgagaggcgntgttccgaacaggtaagacnacataacgtcgttcaaggggagncggcacgacatctcncagacaggcacaataacggggagtggatcggcagatagtatattccggattgaaatacagtgacgntagcaaacgaggtgaggactggaggataggtagaacgctagccatttaagccgttagcgatctgagcacgctcccgcacaatatctaagtcagctttagaccgcaatgagcgan

SEQ ID NO: 95771 - DNA, 1165 bp, Zea mays
  misc_feature: Ceres CLONE 1586130
  misc_feature: Encodes the peptide sequence at SEQ ID NO. 95772
  misc_feature (34)..(34): n is a, c, t, g, unknown, or other
  misc_feature (36)..(36): n is a, c, t, g, unknown, or other
  misc_feature (39)..(39): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (73)..(73): n is a, c, t, g, unknown, or other
  misc_feature (75)..(75): n is a, c, t, g, unknown, or other
ggggagtgtgtttgggtgtgaaagatgttttttnanacnttatttttttcagaggacannnnncctctttttntnaaggtggagctcaccacggtggcggccgctctagaatagtggatcccccgggctgcaggaattcgtctcacccctagaaaaaaccaccaccaccgaaaacgaatcccagaacagtaccgcagcggcagccatggtgctctcgcacgcgagctccggccgggacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcgtcatggactccatccaacgggaactacggtccacaggaacgaagaacccccgtcaccaacggatgctccagaaaccgcctggggtaaaacatgaaaagcctcacccgggttcaaacgcccccaaatcaagggagggacgaagacccgcctaattggggggcgggggaaacaaggggggaatcccttcaggaaaggcgaaattcatgggcggttggggtgggggtcttaatacccgttcctattgggggaatatttggcgcaagcaaacccacaaaagggaaaaaggagatacccaaggggtgtaaaaaaccctcgtgggggaagaacaaaatagccccgttaaaacatattcggtttcataacccgcggggagggccaccaaaacgagattatccaggtggtatcgctcgtccgtggagcaagaaaaaagaaagtcccgaaaagaggagtaatattttttttaagaaagtatggcaagaatctgcagaaacgaagagagcttcaacacttctttgtatagtaaagggggtgacattataatgggtagatgggagacacacccgggaactaaagagctctttatgtgatatatatgcggaggagatgaataaaaatacaacaggacctctggttggtccgcgacgcacataatactttagggggggccgcagccacccacccacgccgtagggtccccgaagagatattcccacacccacctaaaaaaccgc

SEQ ID NO: 95772 - protein, 126 aa, Zea mays
  misc_feature: Ceres CLONE 1586130
  misc_feature: SWISSPROT Homolog: EC 4.1.1.15 Glutamate decarboxylase
MVLSHASSGRDDDAVASTFASRYVRERLPRYRMPERSIPREAAQQIISDELMLDGNPRLNLASFVTTWMEPECDKLVMDSIQRELRSTGTKNPRHQRMLQKPPGVKHEKPHPGSNAPKSREGRRPA

SEQ ID NO: 95773 - DNA, 827 bp, Zea mays
  misc_feature: Ceres CLONE 1586131
ctggagctcaccgcggtggcggccgctctagaactagtggatcccccgggctgcaggaattcgtctcacccctagaaaaaggtccctcccactcctgtcctctccccgccatttggctccgaaccctcacaacagtgcatcgtctctcctgtccccgccatttggttcggaactctcgcggcctcaactcctcctcgtcatcgtaacacccacgcttagagttcgtgagggtcgcccccgggggatctcgagacgtccgtttccaagagtggaccggctcggaggcgctgctgttaccttgggtggagctcggacctgcggatcagtgggattctcaagggagacggagtcgggagcaactggttttgggcgtcgcggagcacatggcttaagaataatttcttccagcccggcgacaaattcgcagttggattcagcatatgcattttttatgctgacataggatgtgctcaaccatccgtggactccctctagttgcacaaaccacctcagtgctctctctttcttcgaatcgggctaaatatgggcagtgcttgccaagctggcacagacgggccttcccgcaaggatgtgttagggatagggaatgccgccttagagaatggcaacatcaggctgaagctgacgcagatgaatggagggaaaaagaagaggacttggccaacgggcacagtgcgccacgccaggcatgcagcaggtggatgagcattaggaggaacaaagacaaagcatccccttgggagagggtccctacctgtgaaagacactgaagagtcttgctggggggaaaaatgatgaccctaccc

SEQ ID NO: 95774 - DNA, 876 bp, Zea mays
  misc_feature: Ceres CLONE 1586132
  misc_feature: Encodes the peptide sequence at SEQ ID NO. 95775
ctggagctccccgcggtggcggccgctctagaactagtggatcccccgggctgcaggaattcgtctcacccctagaaaaaagctcgactgctccagttcttcccatttcccagccgccgcggcgccacgcagacctagcagagaaacacccacccgagatggcgatggctctgcgccgccttgcgggcgtgtccggatcgccgtcggcctcctctgccgcggccacggtgctactccggtcggcgctgacccgcccgatctccaccggcttccgcgaggagcgcgacaccttcggtcccatccaagtccccaacgacaagctgtggggcgcgcagacgcagagatcgctgcagaactttgacattggcggggagcgtgagaggatgcccgttcccatcatccgtgtctttggcgtgctaaaaaagtgcgccgctaaggtgaatatggactatgggcctgaatcaacaatagggaaggcccatatacaggcagctgaggaggtcgcagagggaaaggtggatgatcacttccccactgttatctggcaaactggcagtggcacacaaagcaacatgaatgccaatgaggtaattgccaatagggcatctgagatccctgggacccagcgcggtgaaaaagtttgtgcaccccaatgaccattgtgaatagggcacaatcttcaaatgatacatttcccactgttatgcattttccggacggcccttgaaaaaaaaattccaagggttttcccccagtttgccaccgttgggctggattcccctttctttccaaaaaactattggaagttttaaaacactaattaaaaaattgggaacgtgtcccctttcccccaagattgtcccccccccatttgga

SEQ ID NO: 95775 - protein, 165 aa, Zea mays
  misc_feature: Ceres CLONE 1586132
  misc_feature: SWISSPROT Homolog: EC 4.2.1.2 Fumarate hydratase
MAMALRRLAGVSGSPSASSAAATVLLRSALTRPISTGFREERDTFGPIQVPNDKLWGAQTQRSLQNFDIGGERERMPVPIIRVFGVLKKCAAKVNMDYGPESTIGKAHIQAAEEVAEGKVDDHFPTVIWQTGSGTQSNMNANEVIANRASEIPGTQRGEKVCAPQ

SEQ ID NO: 95776 - DNA, 844 bp, Zea mays
  misc_feature: Ceres CLONE 1586133
  misc_feature: Encodes the peptide sequence at SEQ ID NO. 95777
  misc_feature (671)..(671): n is a, c, t, g, unknown, or other
  misc_feature (741)..(741): n is a, c, t, g, unknown, or other
  misc_feature (759)..(759): n is a, c, t, g, unknown, or other
  misc_feature (817)..(817): n is a, c, t, g, unknown, or other
ctccccgcggtggcggccgctctagaactagtggatcccccgggctgcaggaattcgtctcacccctagaaaaaagctctctctgactctctctcgcgtcgggcacgcagtcgcacaagtagtgaactcaaacgggatctcctgctctgcctccctcgtcttcctctgcccgtgcgcgtttcagagcacgtacggagagggcgagcagcagcttgcggccgggcaccatcatggaggacgtcgcgccgggtgcggagccgtgggaggggtacgtggactggaggaaccggccggcgaccaggtcccggcacggcggcatggccgccgcctccttcgtcctcgtggtggaggtgctggagaacctggcgttcctggcgaacgccagcaacctggtgacctacctgatggggttcatgcactactcgccgtcgcagtcggccacggcggtcaccaacttcatgggcacggccttcctgctcgcgctcctcggcggcttcctctccgacgccttcttcaccacctacaccatctacatcgccagcgccttcatcgagctcatgggggctggtgatcctgacggtccaggcgcggacgcagtcgctgatgccggcgcagtgcgccaagccgggggctccgtgcgagcccgtgtcgggcgccaagaagcgatgctngtcgcggggctgtacctcacggcgctgggcgtgggcgggatcaagggtcccctcccctcccacggcgcgntagcagtcgaccagcatngcgcgcggggggcgcaggggcgctccacctttctcaactacttcgtcttctgcctctnctggagcggccctcgtcgccgtcacct

SEQ ID NO: 95777 - protein, 204 aa, Zea mays
  misc_feature: Ceres CLONE 1586133
  misc_feature (171)..(171): Xaa is any aa, unknown, or other
  misc_feature (177)..(177): Xaa is any aa, unknown, or other
  misc_feature (196)..(196): Xaa is any aa, unknown, or other
MEDVAPGAEPWEGYVDWRNRPATRSRHGGMAAASFVLVVEVLENLAFLANASNLVTYLMGFMHYSPSQSATAVTNFMGTAFLLALLGGFLSDAFFTTYTIYIASAFIELMGAGDPDGPGADAVADAGAVRQAGGSVRARVGRQEAMLVAGLYLTALGVGGIKGPLPSHGAXAVDQHXARGAQGRSTFLNYFVFCLXWSGPRRRH

SEQ ID NO: 95778 - DNA, 776 bp, Zea mays
  misc_feature: Ceres CLONE 1586135
  misc_feature: Encodes the peptide sequence at SEQ ID NO. 95779
  misc_feature (561)..(561): n is a, c, t, g, unknown, or other
ctggagctccccgcggtggcggccgctctagaactagtggatcccccgggctgcaggaattcgtctcacccctagaaaaaataatcagtgctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccggccgtggcgacggtgctgtacctgacgctccggccgcgcgcggtgtacctggtggactacgcgtgcttccgcaccaaccccaactgccgcgtcccgttcgcgacgttcctggagcactcccgcgtgtggccgggcttcgacgagcgcagcgtccggttcatgacgcgcctgctggaccnggtcggggctggggaggaagagacgtgcctgccgtacgcgcagcactacatcccgccgtcgcgcgacctggagtcctcccgcgccgaggccgagctcgtcatcttctcggccatcgacgacctgctggccatgacgggcgtgtccccgcagacatcgacatcctggtggtgaactgcagcctgttcgcgccgacgccgtccgtcgcggacatggg

SEQ ID NO: 95779 - protein, 180 aa, Zea mays
  misc_feature: Ceres CLONE 1586135
  misc_feature (71)..(180): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature (124)..(124): Xaa is any aa, unknown, or other
MGSSAQLRRLKPLYQLVVNNILTIVAVPLAAAVLLKAAELGPEEILARARALRPAHMLLAGFLPAVATVLYLTLRPRAVYLVDYACFRTNPNCRVPFATFLEHSRVWPGFDERSVRFMTRLLDXVGAGEEETCLPYAQHYIPPSRDLESSRAEAELVIFSAIDDLLAMTGVSPQTSTSWW

SEQ ID NO: 95780 - DNA, 880 bp, Zea mays
  misc_feature: Ceres CLONE 1586136
  misc_feature (299)..(299): n is a, c, t, g, unknown, or other
  misc_feature (420)..(420): n is a, c, t, g, unknown, or other
caaagctggagctccccgcggtggcggccgctctagaactagtggatcccccgggctgcaggaattcgtctcacccctagaaaagcccccccgtgccctcccccgtcccactgacggtggcccccaccgcccggccccgctcgtcggcgagcgccccttccccacgctgcaccgctgtcctgggcttcctgcccaagagatccgcccgactccggtcgctcggaggccggcgagccgcgcgtgctgggcgccgggatgcaggcggccgggcgcagccggtggcccggatctcgctggcngcgcgtctcggcgagaggagacctctgaactttctgaactcaagtcctcgattttgtcatagatcagacaaataatgggagagtttacagattgcaactcaagaaagcctgggttgccttnccgggcctctttgggttctgcgtctcttttaggctgtttgggccagcagggatcagaggtcatggccagaagtacatacttgctttactttcctgtttgggcagggaaggactacttcctccggggggagtcggaagaaaccctccagatggtggtcctggggatatttccaggaatttagattttcttttccatagggctacagaatttggggataaggggaaaaactttgaaactggagggggccaaaaaccccttttccgagggctccattccaggagggggaattcagggggcggaccgaaaccgaatggattggccaccttccccgggccctttcctgaaggacactgtttccaaagaactgccctggcttgggggctggccaaattcaaaactcccctttcccctttttttgggctgaaacaaaaaaaattccaattgggttaatttaaacggg

SEQ ID NO: 95781 - DNA, 897 bp, Zea mays
  misc_feature: Ceres CLONE 1586138
  misc_feature: Translation starting site: 169
  misc_feature: SWISSPROT Homolog: EC 3.6.1.1 Inorganic diphosphatase
  misc_feature (897)..(897): n is a, c, t, g, unknown, or other
ctggagctccccgcggtggcggccgctctagaactagtggatcccccgggctgcaggaattcgtctcacccctagaaaaagctgcagagagcgtgacgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaataacggctacggcgactacctcatcgaggaagaggagggggctcaacgaccacaacgtcgtcgtcaagtgcgcccagatcccagacccgctatctccgaaggagcaacatcgtttcttttcactggagtaacaattatgttgggtatcttcatggtcccatctttggcggtggggaatcttcctccttcccttgggttccggtggaagggattccgccccgaaaaaggccagccccggcccctttttggaaggggacaaagtacctgcaaaaccctgccacggtttaactggcacttcttttatgcaacgggggttccctcctttggcttgggaagcccttccacctccctctggggcccccgggtttcccttgggcgttgaaaaaatttgccccactttggcgaaattggcccaaacccacccttgggaaaaccaatggaaaggggggttttggcaaaagctttttatttcccccctttttttcccccctggggggctgtgtttgggggctttccgggctgtgcaaaaaagagggggcttggggggtttccgtacctcccccctttaagggggttttaaggttgggtn

SEQ ID NO: 95782 - DNA, 797 bp, Zea mays
  misc_feature: Ceres CLONE 1586143
  misc_feature: Translation starting site: 223
  misc_feature (339)..(339): n is a, c, t, g, unknown, or other
aaagctggagctccccgcggtggcggccgctctagaactagtggatcccccgggctgcaggaattcgtctcacccctagaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcaaggcgacggcacgacgcctcggtccgcggcggcggggcaagccatgatggagcttcaggcaacgggtcggccgccgtcggggcgccatggntggtggggctcacccgctcagcgaagccctgtggcgggacagcaagcgctcccgcccggggcccggcccgcccgctcatccggcgacgtgtccgcccagctcacgtgggaaggaactcttgcgtcaccgtgggctctggggcccccggcaaaacccaaaaccgtgctggaccaagctccaccgggtaccccggaaaccccggggcgcctaaccccccctccatgggggcccctcggggtccccgggaaaaatccaccccgggttgaaaaccctttggccgggggcgccttggccgccaaaagccttttcctttccgggaaaaatgggttcctctaaaagggcccaaagggccaaagtcttccccttggggggccccccgggggttttttttaacccggggaacaaccaacccctatattggggaaccctctaaaggggccgccccaaaaaaaaaaacc

SEQ ID NO: 95783 - DNA, 929 bp, Zea mays
  misc_feature: Ceres CLONE 1586144
  misc_feature: Encodes the peptide sequence at SEQ ID NO. 95784
ctccccgcggtggcggccgctctagaactagtggatcccccgggctgcaggaattcgtctcacccctagaaaaagacaaaccatagaagccgccactcacgcctggaagcatctggaggcgtggcacggcagccgtcgcccgccacaccagcagcgaactgcgtcccggtgcccgcggcggcgaagcacaggactgagagaggcggcgagtgaaaccgatgacgcagccgatggatccgcccgacgttgagatggagatggagcccgcgccccagcctccggctccgacagcggtcggggaggggtggagcatgctgtcgcgcgccccgcgggctgctcgaggaggggaaaccgtccctcgctctgcaggcggttctcttgggcattagatctcaaggcggtgaaacaagctctcatgcagacattgaaaccgtgcacgtgaactctatggacagagattgcaggccagtccctaatggttgataagcttggctcttttgccttgcccaatggtggccttagcaaaggctccagtcctcaaaatactaacccctcccccaaggggcttggggccaaaccccggtcaaaaatggctgaaattctgaaggggggccctggcttttcttgcttaaaaagtgggaaagggaaaacaaatcatcctctggaccccctttttcccgaccgggaagcacaccctcatttttgccttgaaaaatgggggggggggggcccttttgggccccttcctcccccagagaatgaagcaaccttttccccctaaaggggggtggggggaaacgccccaggaacaccgcggggtaaccctcccggtggccgcgggggggaatgtcccccgtggggacaccgccctgtgtcctttggtacccccgtttgtttccttgttgttccccccgcctagataatttttt

SEQ ID NO: 95784 - protein, 56 aa, Zea mays
  misc_feature: Ceres CLONE 1586144
MTQPMDPPDVEMEMEPAPQPPAPTAVGEGWSMLSRAPRAARGGETVPRSAGGSLGH

SEQ ID NO: 95785 - DNA, 830 bp, Zea mays
  misc_feature: Ceres CLONE 1586145
  misc_feature: Encodes the peptide sequence at SEQ ID NO. 95786
ctggagctccccgcggtggcggccgctctagaactagtggatcccccgggctgcaggaattcgtctcacccctagaaaacatttcctagaagctacggacgtcatttctccttcatcctcatctcttcctcaagctctagccgaactccctcacgccatcctctttcctggtgttcatccctgcggcaaccaccacttgggcgctcctctccctgcccctcccatggcggctccccctggatccctccctgcgcggaccctctcccgtggatggtgccgccccttcctgcagcacgtcgtgctccctcccctggcgccctcgtccccaacgccggaaatgccgctgctgctccaccagccgctactgctcctgaacgccagtgccgaccaccatctcccatggcgcaggagctccccaatctcctctttccagggcgccgtcgctgagctcgccctgccccagccatggacgccgtcgggccacccgtctcctatcttccctcgccctcatcctctggctgctgccccttcctattcctggtggctgagtcttcttccatggatgctggccgtgctgccctccctggtgctcacctctgccccctgcgttggatggccggttgctcctgccctagccatgaaaccccatcgtgtcgcgcccctcgacgtgttcgacggaatatcgcagcacgggccaacccgatctgcagccctggttgcgaggacgtcgaaccccgctaccgtcgacgttgtgcctcacgcttcaccaatgcgatggaatgtctgagcgatagaccacatgcgacccgagtttgattctgccaggttgt

SEQ ID NO: 95786 - protein, 74 aa, Zea mays
  misc_feature: Ceres CLONE 1586145
MLAVLPSLVLTSAPCVGWPVAPALAMKPHRVAPLDVFDGISQHGPTRSAALVARTSNPATVDVVPHASPMRWNV

SEQ ID NO: 95787 - DNA, 827 bp, Zea mays
  misc_feature: Ceres CLONE 1586146
  misc_feature: Encodes the peptide sequence at SEQ ID NO. 95788
  misc_feature (711)..(711): n is a, c, t, g, unknown, or other
ctggagctccccgcggtggcggccgctctagaactagtggatcccccgggctgcaggaattcgtctcacccctagaaaaaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaacaacgatcttgctggagatgggacaaccacctctgtggtccttgctcaagggctgattgctgagggtgttaaggtcgtagcagctggtgctaatccctgtcagattactcgtggtattgagaaaacagctaaagcactagttgaagaactacngaagttgtctaaggaggttgaagatagtgagcttgcagatgttgctgcagttagtgctggcaacactatgaaatgggtaacatgatagcagaggcatgagcaagtcgggcgggagg

SEQ ID NO: 95788 - protein, 193 aa, Zea mays
  misc_feature: Ceres CLONE 1586146
  misc_feature (166)..(166): Xaa is any aa, unknown, or other
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKNNDLAGDGTTTSVVLAQGLIAEGVKVVAAGANPCQITRGIEKTAKALVEELXKLSKEVEDSELADVAAVSAGNTMKWVT

SEQ ID NO: 95789 - DNA, 801 bp, Zea mays
  misc_feature: Ceres CLONE 1586155
  misc_feature: Encodes the peptide sequence at SEQ ID NO. 95790
  misc_feature (682)..(682): n is a, c, t, g, unknown, or other
  misc_feature (740)..(740): n is a, c, t, g, unknown, or other
  misc_feature (794)..(794): n is a, c, t, g, unknown, or other
tggagctccccgcggtggcggccgctctagaactagtggatcccccgggctgcaggaattcgtctccccctagaaaaacttctcctctcttccccgaaagagaggtcgcggacggaacccttccaccctcacctcatcccacaaccttcgattccttcacgatcttacctcgcgcgctcgccgattcctcgatcgagtcccgcgcgattcgctttctggtcggattctctcccccgaagcatgcagccggaccagcctgtgatcagcttgcgccccggcggcggcggcggcccgcgcgccggccgcctcttctcccccgccttcgccacctccgtctctggagacttcctccgcccgcacggcgggggcgcctccggcatctccaagatcggagattcacattttgagccacgtgagcgtgttcgatacacaagagatcaacttctcgagctgcgtgagattgttgatgtgtctgaggaaattttaagaatcaagcaagagattgatgtagagcttcatggtgaagaccagagctgggttcgcaatgattcaactgttcaaggacaagcacaagctcaaacacaagcacagaatcgctatgctgagactgatagccgtgattggcgtgcacggtctgcacagctgactccgactaatgaagaaaaaatctggggacacatangggagggctaagagcctatgcctctagcggtaggcagcaagagcaaagctacaggcangatcagttaagcctccagttttgctcgaaagctcaggtgggcctacccctgctnctattac

SEQ ID NO: 95790 - protein, 150 aa, Zea mays
  misc_feature: Ceres CLONE 1586155
  misc_feature (148)..(148): Xaa is any aa, unknown, or other
MQPDQPVISLRPGGGGGPRAGRLFSPAFATSVSGDFLRPHGGGASGISKIGDSHFEPRERVRYTRDQLLELREIVDVSEEILRIKQEIDVELHGEDQSWVRNDSTVQGQAQAQTQAQNRYAETDSRDWRARSAQLTPTNEEKIWGHIXEG

SEQ ID NO: 95791 - DNA, 955 bp, Zea mays
  misc_feature: Ceres CLONE 1586156
  misc_feature: Encodes the peptide sequence at SEQ ID NO. 95792
  misc_feature (358)..(358): n is a, c, t, g, unknown, or other
  misc_feature (561)..(561): n is a, c, t, g, unknown, or other
  misc_feature (830)..(830): n is a, c, t, g, unknown, or other
  misc_feature (930)..(930): n is a, c, t, g, unknown, or other
  misc_feature (955)..(955): n is a, c, t, g, unknown, or other
ctggagctccccgcggtggcggccgctctagaactagtggatcccccgggctgcaggaattcgtctcacccctagaaaaagtctgtatgcggcaccacggcgcccgtggggcccaccacggcgccgccggcagcgtcaccaacccccacccccacctccgccctcccaccggcactcccctcgcctgctccacgacgcttatgcgctcgcgccccgctctcgccgcccacctccggcgcctgctcctcctctctcccctccgcccacctcatcatcatcccgggccccggggggcgggggggccccccccccaaaaggggtggggggggggggggggcccccccacacaaaaaaaaancagggaccacccccccccccaccccccgaaggaggagagagagaaagagccaacaagcaccccccccccccccaacggaacgcggagccaggcgaaaaaaaaacaagaaaccacaagcacacaacccaccggacccccagccgcgcgcccgcagggaaggccccggacccccccaccggccaaaaaccaccgcggcccgaccncggcgccgagaggcgcggcggcgaggcgggcgggcggggggaggcggcgaccggagcacacacccgaagccaagaggggcgggggcaggaggcagggggcgaagcgggggcggggggacggggaagccgcgaagagcggcggaggcgcagacaagagcaccaggaggcggcgcgggggccaggagagggacgcacgcgcgcgaggacgccggggcgggcgacggggaagcaacgcgcacggaggacggacgagagaacggagagaaaanaacgagagacaggagagggaagagacgggacgagcgacgggggggggcgggaggacgccgcgggaggggcccgacgccgagcgaaggggcaacgggaggnccaggaccgaggcaagacaggcggn

SEQ ID NO: 95792 - protein, 289 aa, Zea mays
  misc_feature: Ceres CLONE 1586156
  misc_feature (91)..(91): Xaa is any aa, unknown, or other
  misc_feature (159)..(159): Xaa is any aa, unknown, or other
  misc_feature (248)..(248): Xaa is any aa, unknown, or other
  misc_feature (282)..(282): Xaa is any aa, unknown, or other
MRHHGARGAHHGAAGSVTNPHPHLRPPTGTPLACSTTLMRSRPALAAHLRRLLLLSPLRPPHHHPGPRGAGGPPPQKGWGGGGGPPTQKKXRDHPPPHPPKEEREKEPTSTPPPPNGTRSQAKKKQETTSTQPTGPPAARPQGRPRTPPPAKNHRGPTXAPRGAAARRAGGGRRRPEHTPEAKRGGGRRQGAKRGRGDGEAAKSGGGADKSTRRRRGGQERDARARGRRGGRRGSNAHGGRTRERREXNERQEREETGRATGGGGRTPREGPDAERRGNGRXRTEARQA

SEQ ID NO: 95793 - DNA, 843 bp, Zea mays
  misc_feature: Ceres CLONE 1586157
  misc_feature: Encodes the peptide sequence at SEQ ID NO. 95794
ctggagctccccgcggtggcggccgctctagaactagtggatcccccgggctgcaggaattcgtctcacccctagaaaaactcacatcgcctgaccgacgcgcccgttttctcctgaaaacagaaggctccggcctccggcatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgtcacgccggagacgcagcatgaccagatccgcctgctcaagcgcttcaacgttggcgaagactgccccgtcttcgacggcctctacagcttctgccagacctatgcgggtgcctccgtcggcggggccgtcaagctcaaccacggccacgacatcgcaatcaactggtcgggggggctgcaccacgccaagaagtgcgaagcgtcgggcttctgctacgtcacgacatcgggctcggcatactcgagctgctaagcatcaacaagagaggtctggatgtcgatatcgatatccaccattggccattgaatggaaggagctttctacccaccaaaaaggtttatgaccgtcccctt

SEQ ID NO: 95794 - protein, 176 aa, Zea mays
  misc_feature: Ceres CLONE 1586157
  misc_feature (24)..(177): Pfam Name: Hist_deacetyl Pfam Description: Histone deacetylase domain
MDPSSAGSGGNSLPSVGPDGQKRRVCYFYDPDVGNYYYGQGHPMKPHRIRMTHSLLARYGLLNQMQVYRPNPARDRDLCRFHADDYINFLRSVTPETQHDQIRLLKRFNVGEDCPVFDGLYSFCQTYAGASVGGAVKLNHGHDIAINWSGGLHHAKKCEASGFCYVTTSGSAYSSC

SEQ ID NO: 95795 - DNA, 839 bp, Zea mays
  misc_feature: Ceres CLONE 1586159
  misc_feature: Encodes the peptide sequence at SEQ ID NO. 95796
  misc_feature (839)..(839): n is a, c, t, g, unknown, or other
ctccccgcggtggcggccgctctagaactagtggatcccccgggctgcaggaattcgtctcacccctagaaaaaacaagcgcaagccgggcaagaaaactccgcaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaagcgcacctgttcaagccgacctacccgcggagcaaggagcgcatgatcgggccgtcggctctcttcttccaccagggcgactaccacctccgcctccgcaagctcgtccagagcgcgctcggccccgacgcgctgcgcgcgctcgttcctgaggtggaggccgccgtgcggtccactctcgcttcctgggacgcccgccacgtcagaagcacgttcccacgccatgaagaacctgtcgttttgatgtggggcatcgtgaactatctttcggcgggccggcctggaccaagccggcgccaaggggggaagcttaaaggaagaatttacttcccttccggggaagaaggggggtaacaaactccctttcccccaaaaaggcctgtgccgggggataaccctccccn

SEQ ID NO: 95796 - protein, 221 aa, Zea mays
  misc_feature: Ceres CLONE 1586159
  misc_feature: SWISSPROT Homolog: EC 1.14.13.93 (+)-abscisic acid 8'-hydroxylase
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFHQGDYHLRLRKLVQSALGPDALRALVPEVEAAVRSTLASWDARHVRSTFPRHEEPVVLMWGIVNYLSAGRPGPSRRQGGKLKGRIYFPSGEEGG

SEQ ID NO: 95797 - DNA, 836 bp, Zea mays
  misc_feature: Ceres CLONE 1586162
  misc_feature: Encodes the peptide sequence at SEQ ID NO. 95798
  misc_feature (663)..(663): n is a, c, t, g, unknown, or other
ctggagctccccgcggtggcggccgctctagaactagtggatcccccgggctgcaggaattcgtctcacccctagaaaaagtccgcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtagcagctggtgctaatcctngtcagattactcgtggtattgagaaacagctaaagcactagttgaagaactacggaaagtgtctaaggaggttgaagatagtgagcttgcagatgttgctgcagttagtgctggcaacaactatgaaatttggtacatgatagcagaggccatgagcaggtcggtcggaaggc

SEQ ID NO: 95798 - protein, 160 aa, Zea mays; identical to SEQ ID NO: 90849
  misc_feature: Ceres CLONE 1586162
  misc_feature (148)..(148): Xaa is any aa, unknown, or other

SEQ ID NO: 95799 - DNA, 807 bp, Zea mays
  misc_feature: Ceres CLONE 1586164
  misc_feature: Encodes the peptide sequence at SEQ ID NO. 95800
  misc_feature (789)..(789): n is a, c, t, g, unknown, or other
ctggagctccccgcggtggcggccgctctagaactagtggatcccccgggctgcaggaattcgtctcacccctagaaaaaccccgtccagccgtttttcgcatccacgtgggccagccggccaggcgaccgccgccaccgccgccctactcctggtcccagctctgctgcacccttcgccggcgacgagcgtccaccgcggcagccgaagctcccagcgtcctcctgcaggccgagctgaaggttcagcgcgccggtggagttcgacgacgaaactccgtcacgtcatacctctccgcctcccgtctccaatcggggctcccagcgtctcggagaagaggagcagcacggcacggcggctgtggcgaggaaggctcctgtcccatcccaacccagttagcagccgcccaaggaggaggagatccaatcggcgtgcgggcgtccgcggtccatccatcgatccaattccaatctgcagcgaggaggtcggctacctttctcctccggcgagctccacgagggcgccgacgaggggatggacgcgcagcctaactggagaggtggaccggcggcgactaggatatcgtacaagaacgccaccatcgtcatgtgcgcctttaacctcttcgttgcggccctcctcctccacaactactactcgtcctggacgcgtatcgccggaggcaacaagctcgattctgctcagcttcggtatatatggggatctgaggagctgcgtcgtgctatggagcctgtgggatttgataagagagtgaaagaaatggagcanaaagcttatgtgagcatg

SEQ ID NO: 95800 - protein, 91 aa, Zea mays
  misc_feature: Ceres CLONE 1586164
  misc_feature (85)..(85): Xaa is any aa, unknown, or other
MDAQPNWRGGPAATRISYKNATIVMCAFNLFVAALLLHNYYSSWTRIAGGNKLDSAQLRYIWGSEELRRAMEPVGFDKRVKEMEXKAYVSM

SEQ ID NO: 95801 - DNA, 837 bp, Zea mays
  misc_feature: Ceres CLONE 1586166
  misc_feature: Translation starting site: 670
  misc_feature (216)..(216): n is a, c, t, g, unknown, or other
  misc_feature (396)..(396): n is a, c, t, g, unknown, or other
  misc_feature (489)..(489): n is a, c, t, g, unknown, or other
  misc_feature (514)..(514): n is a, c, t, g, unknown, or other
  misc_feature (648)..(648): n is a, c, t, g, unknown, or other
  misc_feature (770)..(770): n is a, c, t, g, unknown, or other
ggagctccccgcggtggcggccgctctagaactagtggatcccccgggctgcaggaattcgtctcacccctagaaaaaagcctccacccctcacccgccgcagccaatccctccccagcagccgtcgtcgccaccgctgcagcgcggaggcgaccccccatcgccgccaagatgcagatcttcgtgaagaccctgacggggaaaacgatcacgttnggaggtggagtcctcggacaccatcgacaacgtgaaggccaagatacaggacaaggagggcatcccgccggaccagcagcggctaatcttcgccggcaagcagctcgaggacggccgcaccctcgccgactacaacatccagaaggagtccaccctccacctggtgctccgccctccganggtggcgccaagaagcgcaaagaagaagacgtacaccaagcccaagaagatcaagcacaagccaccagaaggtaaagctcgccagtgctgcangttctacaaggtgggacgacgccanccgggcaggtggacccgcctcccgcaaaggagtgcccccacaccgagtggcgggggcgggtgtcttcatgggccaaacactttcgacccgccacttactggcggcaagtgcgggccctcaccctacgtcttacnattccgaagggcgtaatccccatgcgcccgcctttggctttcacccgccctacctatcaagccattcaacccggttgggttacctcgaatttggaatatcattttagatcccgggttggaantttgaaaccataaatgccggcaggaagttcccggccctaattattttggggaccccctgttaaccgg

SEQ ID NO: 95802 - DNA, 819 bp, Zea mays
  misc_feature: Ceres CLONE 1586167
  misc_feature: Encodes the peptide sequence at SEQ ID NO. 95803
  misc_feature (819)..(819): n is a, c, t, g, unknown, or other
ctccccgcggtggcggccgctctagaactagtggatcccccgggctgcaggaattcgtctcacccctagaaaaaaatcaatcgatcacacgcgtcccgccccattcggccattcccagccttcgagaggtcgccgccgccggtcgctgctccgccgactcggggatgccaccggcggtagcgcccgcctcgccgcgccaagaccctagcggctccagtctttccgccgcagccgccgcggcttccatggcgaacccggtcctagggcttggcctcgcgccaccgggcgctgagccctccgccggaacgccaccgtcttcacgccgcgcgccgcgcttggccaagcggcgccacgcgcccgcctcctcccgtttccgcgcggcgcaggcctcagtcggaacatggaacccgtttggcggtggcggcggtacggatggacagactcgagggtttgtgtttggtgctgcttcgccagtgagccagcagcctttcgagccagcagtggagataccttcatccagtgaggcgcccctcgtggttcagagtgtgagggagaaccttcctcggtttgaaggagggattgtctgggtcatcaatggcccctgaataagatgggggaaactgaacctggcccacattcgggggagggttgggggaatggccctccggcccgggggaggggattccaaagggtgggaagttcccccccttttgggggttgaataaaacctgggggtttggtttttctcaacaaggggaaaaattaagtggggcctcccagggaaaaaacctttaaccacggggtgaaaattttatggcn

SEQ ID NO: 95803 - protein, 119 aa, Zea mays
  misc_feature: Ceres CLONE 1586167
MANPVLGLGLAPPGAEPSAGTPPSSRRAPRLAKRRHAPASSRFRAAQASVGTWNPFGGGGGTDGQTRGFVFGAASPVSQQPFEPAVEIPSSSEAPLVVQSVRENLPRFEGGIVWVINGP

SEQ ID NO: 95804 - DNA, 1193 bp, Zea mays
  misc_feature: Ceres CLONE 1586168
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (1097)..(1097): n is a, c, t, g, unknown, or other
ttttccccnnnnnaacaataggggagcgaggggggaaacacatatatagagtttttctctaacaaaaatggtaagctggagctccccgcggtggcggccgctctagaactagtggatcccccgggctgctggaattcgtctcacccctagaaaaatttcctagaagctacggacgtcatttctccttcatcctcatctcttcctcaagctctagccgaactccctcacgccatcctctttcctggtgttcatccctgcggcaaccaccacttgggcgctcctctccctgcccctcccatggcggctccccctggatccctccctgcgcggaccctctcccgtggatggtgccgccccttcctgcagcacgtcatgctccctcccctggcgccctcgtccccaacgccagaaatgccgctgctgcttccaccaaccgctacggctccttggaaacgccagggccgatctaacatcccccccagggcccaaagaaactccccaatcgcctccttttccaaggggaccggccgctgaaaactccgcctccgcccccagccaatgggaacggccgtccgggggccaccccgtgtattcccctattcttcccctcgggcccaacaaacactgggggactggctagacccccttcccctatttccctgagtgggcctggagattctctctcttccacaagagagatatgaccttgggccggggggcgggtgccccttacccccgggggggtgttcgaacccttccgtgggggcgccaccttgcgcggtttagagaaaatggggccccgaggttggagtcccctccggaaacccctttgataagaccacttgtaaatatacccgcccacctcgatgtatgtttgagggtgcaccagtgtacaaaaaggtgagtttgtgaacaccggcagatttattttcccccgacgatacacgatatggtccaataacacccaaaaatactaccaaaatgaactcctggtttttcggggaagaaagaccacctcgcagaacaacgccgggccttagccgaattctgaaaagatttttgtgcgacggcgagtatttcattcaacagagtatatncatgtggaagatgtttctctggagaccaaaatggaaccgcaacatagccctggactcctggagtttagtagatacccgcccccgtatgtgatcttg

SEQ ID NO: 95805 - DNA, 1107 bp, Zea mays
  misc_feature: Ceres CLONE 1586172
  misc_feature: Encodes the peptide sequence at SEQ ID NO. 95806
  misc_feature (71)..(71): n is a, c, t, g, unknown, or other
ggggggggggggggggggccctgggccgacccccggtcgcgcgaggcgtgggcgcgctaaacatctgtttngttaaagctggagctcaccgcggtggcggccgctctagaactagtggatcccccgggctgcaggaattcgtctcacccctagaaaaagccgtccccgtccccgtcccgacgaattggaataggagaagcaaaagatgatggatctcgccgacagccagcaacagcggctcatcgccggcgcggctctgctggtcgccaccgtcgccttcttcaggttcctcctgcgctctcgctccgggggcaagcgcctgccgcccaccatcccgggggcgccggtggtcggcggcctcgtcaagttcatgcgcgggcctatcccgatgatccgggagcagtacgcccgcctcggcagcgtcttcaccgtccccatcatcagccgcaagatcacgttcctcgtcgggcccgaagggtccgcgcacttcttccaggggcaacgaggcccgagaatgagccagccgggaggtgtacaaggtttcaacgtggcccacccttccgggcccccgggggtccgtctttgaacgtccgaactacctcccttcaagggcagggaggcaggtttcaggggttctttccacccgaagggccgccctcccggggggccaaataaaaggctttgccccccaggcctatttgttcccaaaacccaagaaaatggggtgtttggtttttgaaagggccctttgaaaaagggaaaatataaccttttcccttccacaagaaggtggggggggtggaggaaaataagtggggcgaccctggggttgtggaattttttgagaaagttatacccaaagtttgtggggaagcaaacccttccacttccttataacttggaacagcgccttgagcccgggggggccctttggccttgggggaaaaaggggagggtgtgcccaaaaaaaaaggcttggttttcacacccaaagggttttctggcccccccctctccaccgggacccttgtaacaaacgggagtggcgaacccaatcttaggtgtgccctcctctcccggaaacctcccaaatccctgggggaataa

SEQ ID NO: 95806 - protein, 126 aa, Zea mays
  misc_feature: Ceres CLONE 1586172
  misc_feature: SWISSPROT Homolog: EC 1.14.13.70 Sterol 14-demethylase
MMDLADSQQQRLIAGAALLVATVAFFRFLLRSRSGGKRLPPTIPGAPVVGGLVKFMRGPIPMIREQYARLGSVFTVPIISRKITFLVGPEGSAHFFQGQRGPRMSQPGGVQGFNVAHPSGPPGVRL

SEQ ID NO: 95807 - DNA, 800 bp, Zea mays
  misc_feature: Ceres CLONE 1586173
  misc_feature: Translation starting site: 224
  misc_feature: SWISSPROT Homolog: EC 1.2.1.3 Aldehyde dehydrogenase (NAD(+))
ctcaccgcggtggcggccgctctagaactagtggatcccccgggctgcaggaattcgtctcacccctagaaaaaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcaactttgttgattccgcatccgggcagaccttccccactctggaccctcgtacagggggaggtgattgctcatgtggctgagggtgacccataggacattaaccgtgcagtagctgcggctcgcaaaggcttttgatgaaggggcttggcccgagatgactgcctaatgaaaggccccgatccctactgcgggtttgctggatttgattgagaaacccaatgaccagctttggtgctttggggaaatggggacacacggggaagccttttgagccagccgcccccgaattgaaatacccccgggggggcccccgccttagggcgttaactaggcggggttgggggcggaaaa

SEQ ID NO: 95808 - DNA, 1170 bp, Zea mays
  misc_feature: Ceres CLONE 1586175
  misc_feature: Encodes the peptide sequence at SEQ ID NO. 95809
  misc_feature (19)..(19): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
gtgtggggcgttttttttnaacgagagaaaacaaaacacgctaacaaaacactatgagtggggggggttnnnnnntnaaaaactggagctccccgcggtggcggccgctctagaactagtggatcccccgggctgcaggaattcgtctcacccctagaaaatctgctacacgcctttcaaggacccggcgttcaacgcgaccatccagcggcacggcgtccgcctgtccgatgtcgcctgcctgcccatctcgctcgggtggtacggccccagccaggagaaccggcggctgatcaagatccagtgcttctccgcggagggcaccgccaacttctacatgcgccccatcgagggcctcaccgtgctggtggacatggacacgagggaggtggtccgcatctccgaccgcggcgccggcatccccatcccgcccgccgccaacaccgactaccggtactctcgccacatgcaagaccaaagcgacgaccagcagacagcgagggttccacgaaggatccgggccgccgttccatgggaaccgggggggccgttcgtcagggccccccgggctgggagcatggttggaaccgccccaccacggtgccccaatggaggcccagggttgggaattttccccacccttcaaagggacggaaaatccccccccccgcccaggcaaatggggtggggggggtcggcccgcccggcaaaaggggtggtggccacaggaaaacccccccgcggtctaacgggagggggaggccggctcaccccacgtggaataagagaggtgcgcctctggttttacacaaaacggcgggctcaattgtgggcgcggttcccagagaaataccctgtatgttcccgtccacccccgtgggaaaaaagtggggaatccccccccaccccacaaaagggggcgctgtggggtgacccttttccaaaggaacccgcttcccattgtgggaacactaccccggggcacaaaagaaaaagggggcctttctctgaggccctggcgcagggggcacatatggtcccccttgtgggttgtccaccccctaataaatataacgtgggcctcctggggacacacaactcggcaccatatacctctgagaaacacggccgtgttcttcttgtgggcccccccctaaatacaatacggaa

SEQ ID NO: 95809 - protein, 277 aa, Zea mays
  misc_feature: Ceres CLONE 1586175
MRPIEGLTVLVDMDTREVVRISDRGAGIPIPPAANTDYRYSRHMQDQSDDQQTARVPRRIRAAVPWEPGGPFVRAPRAGSMVGTAPPRCPNGGPGLGIFPTLQRDGKSPPPPRQMGWGGSARPAKGVVATGKPPRGLTGGGGRLTPRGIREVRLWFYTKRRAQLWARFPEKYPVCSRPPPWEKSGESPPTPQKGALWGDPFPKEPASHCGNTTPGHKRKRGPFSEALAQGAHMVPLVGCPPPNKYNVGLLGTHNSAPYTSEKHGRVLLVGPPLNTIR

SEQ ID NO: 95810 - DNA, 873 bp, Zea mays
  misc_feature: Ceres CLONE 1586176
  misc_feature: Encodes the peptide sequence at SEQ ID NO. 95811
  misc_feature (368)..(368): n is a, c, t, g, unknown, or other
  misc_feature (408)..(408): n is a, c, t, g, unknown, or other
  misc_feature (439)..(439): n is a, c, t, g, unknown, or other
  misc_feature (465)..(465): n is a, c, t, g, unknown, or other
  misc_feature (600)..(600): n is a, c, t, g, unknown, or other
  misc_feature (606)..(606): n is a, c, t, g, unknown, or other
  misc_feature (611)..(611): n is a, c, t, g, unknown, or other
  misc_feature (616)..(616): n is a, c, t, g, unknown, or other
  misc_feature (619)..(619): n is a, c, t, g, unknown, or other
  misc_feature (620)..(620): n is a, c, t, g, unknown, or other
  misc_feature (625)..(625): n is a, c, t, g, unknown, or other
  misc_feature (677)..(677): n is a, c, t, g, unknown, or other
ggagctccccgcggtggcggccgctctagaactagtggatcccccgggctgcaggaattcgtctcacccctagaaaaagctgacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcagggttgctcgagtggctaagatgttaggtgatngaatatggtactgcttcgaacatcaaagagtagagttaantcgtcaaatctgtgttaggctgccatcaccntcagctcagcagaaagttgtagctcntacaacaaaagtgccctcctaaacggattggtttctgtacactgggaacctattggttactggaagacgggaagggaaaagaaagtttactattggatttttgagcccattcaagccctatcaaatgtatcactnctaccntttgntgacnacnnagttnccacactggaagcttttaaaatgagctcttgggaatctgatgaacaagtttngggttcatttgttattgggatgggtaatgggtactctttttgggcacactaagtgggcaattaccccgtgaagtgcttcaacaatttcactggtgaccctcccaaagaaagcatggtaagaggagggcagttcttgctctgcgtttttgctccggctttcgatgggagaaacgccatttactttgtccgcaaaaca

SEQ ID NO: 95811 - protein, 48 aa, Zea mays
  misc_feature: Ceres CLONE 1586176
MSDSHETDRNIEIWKIKKLIKALESARGNGTSMISLIMPPRDQGCSSG

SEQ ID NO: 95812 - DNA, 1127 bp, Zea mays
  misc_feature: Ceres CLONE 1586178
  misc_feature: Encodes the peptide sequence at SEQ ID NO. 95813
  misc_feature (49)..(49): n is a, c, t, g, unknown, or other
  misc_feature (58)..(58): n is a, c, t, g, unknown, or other
  misc_feature (68)..(68): n is a, c, t, g, unknown, or other
  misc_feature (72)..(72): n is a, c, t, g, unknown, or other
  misc_feature (1127)..(1127): n is a, c, t, g, unknown, or other
gtggtggtgttgggtggtcactttttttttctcttggggtgtggtctgnattttatancaaagtgttntttnaaaaactgagctccccgcggtggcggccgctctagaatagtggatcccccgggctgcttgaattcgtctcacccctagaaaaagtatcctagctgtcccaaatgacaggtttccgactggagcctataccctagctcgcctatcaatggctccgattacttgcagagcctatcccgccgagtcccccatcgccctggagactgccaccaccaaccaccttctcgagccagcgtcctccgagaccaatgcacccggatccatctacttccccatcgcggaccagccgccgcaacggaacgccgcccaagaggactatgatcacggcgcttgccaccaccatgactagacacatgatcttgccaaactgcttgagcccctgccggcgggatcaacatctgacactccccctttcaggccgcgggaggcaagcccccgccacaaagggcaggccattccgccgaggccggttgagaccggaccaatccgcgccgggaaagcttttttaaccaatcgagccctcgaaatgtgggaggccggggctcccaaggggaccaaacagcccccagagcctggggttaccgcaaattggaagacaaccctcgggagggaaaagggaccaagggtaccaattggtctctgaaaaaaagcataaagtcgccgggggaaagacacccctccaaaggggtcccaaacacaggggtgttttcgtgttccgcctcgtaatttttgtggatgtttaccgcaacgggccctctagcgaaccaatatcccgagagggctctccctaaaaaaatctgtgtgccatttaagagaatgctcctggaggggggaaatgggctcctaagtgagggtaagttgctttatgaggtatagcccgtgttgtgccacctctttaaaaggggggcagaggcaaccccccacatagtctcaaggttgtatccgggaagcacgttaaatttgggcgaagagccccccacacctcctattccgcctcaaaaaaacgtttcgtggcgatgagaacccctaatgttgctggggtggtcaattctttaggn

SEQ ID NO: 95813 - protein, 66 aa, Zea mays
  misc_feature: Ceres CLONE 1586178
MAPITCRAYPAESPIALETATTNHLLEPASSETNAPGSIYFPIADQPPQRNAAQEDYDHGACHHHD

SEQ ID NO: 95814 - DNA, 1151 bp, Zea mays
  misc_feature: Ceres CLONE 1586179
  misc_feature: Encodes the peptide sequence at SEQ ID NO. 95815
  misc_feature (62)..(62): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (815)..(815): n is a, c, t, g, unknown, or other
ggtggggtttgtttttgggccccacccacccccccattcgccgggggggggggacatagccnaaaaaagggnnnnnnnnaaaaactggaactcaccgcggtggcggccgctctagaactagtggatcccccgggctgcaggaattcgtctcacccctagaaaatctccgttccacatcgcgtgcgcattgagacgacgagtttctagagcgccgtaccgcgcacggctcccgagccccaccggcaccgcaaagcgccggaatcgtgagcgcgtccggcctctcctagctgctccgcggtgagaggcggccgaggaggacgggcgatgtacccggtggtgacgggcacgccgccggcgcggctgccggcggcgtcccgggtggacaaggccacgagccacctgctgcagggccccaactgggccggcaaacctcaaatctgcgaaaccctcgaggccgacccgtggcaaacgaaagacccagtaaaaactgtggaagaagcgattggcgccctaggggccccaaaagttaaattcctttacttttggacggtatttggaagaccactgaatgaaagaaaccggggggggggaaatatgttttccattttttggaaaggttggcgggaatccaagccaaggtttttttaacaaagagaaaaatttgggtttataataattttggtgcccccttaaaagaaaaggggcgtttctgattgtttgcgcccaaaagtttgaaaaggagggaaataaaagaggggcgttttttggggtgttaacaccttatactcggagggaaaatttcgcctgttggggcnaagagaaaaggaggcacaattttctgggggggaggggaaaaccccttcgggggggggcgccctaaattgattcccccacccccagatgacacctacccgcggggggcccactttcccctgtgttggaaacctctatcatgaagggggggcgccggggaatgtataaggggttgtcccccacaaaaaagggaccccctgttaccaaaaagcgcacccctccccaaagatattttaagtcccgcccccccgggagagaagctcatcaaggggttatatgtggctccccccccgagaagtatgccccctcccgggaaggcgctcgaagtggagaaaaac

SEQ ID NO: 95815 - protein, 107 aa, Zea mays
  misc_feature: Ceres CLONE 1586179
MYPVVTGTPPARLPAASRVDKATSHLLQGPNWAGKPQICETLEADPWQTKDPVKTVEEAIGALGAPKVKFLYFWTVFGRPLNERNRGGGNMFSIFWKGWRESKPRFF

SEQ ID NO: 95816 - DNA, 925 bp, Zea mays
  misc_feature: Ceres CLONE 1586190
  misc_feature: Encodes the peptide sequence at SEQ ID NO. 95817
  misc_feature (925)..(925): n is a, c, t, g, unknown, or other
gagctccccgcggtggcggccgctctagaactagtggatcccccgggctgcaggaattcgtctcacccctagaaaagtccgcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaaactcccagactggagtcaataagcttgcagaccttagttggagttacactcggaccgaagggaaaggaatgtccgttttgggagagcaagtacggctctccccaagattgttaaacgatgggccgttacagttggccagaagaggttgagcttgggaggacccctggtggaaaaacattgggagcctaaatttgggtcagggcaaagctggcagcttaaaaacccaaacgatcttttgcctgggaaaatggggacaaaccacacccccctgggggggtccttggctcccaagggggctgattttgcctgaaaggggtggtttaaggtgcggtaagcaagcctggggggcctaatccccggtttcaagaattatcctccgcgggggtaattggagaaaaaacagccctaaaagccaccttggtttgaaaaaaaacttccccgaaagtttgtgtcctaaagggaggggtttgaaaaaattgtgggaaccctttggcaaaaaggtgttggcttgccagattttaggtggcctgggcacaacaacctctttgaaaaattgtgggtn

SEQ ID NO: 95817 - protein, 55 aa, Zea mays
  misc_feature: Ceres CLONE 1586190
MASTFGATSTVGLMAAPTGKNVRLQRRANFRVKAAKELYFNKDGSAIKKLPDWSQ

SEQ ID NO: 95818 - DNA, 850 bp, Zea mays
  misc_feature: Ceres CLONE 1586191
  misc_feature: Encodes the peptide sequence at SEQ ID NO. 95819
  misc_feature (261)..(261): n is a, c, t, g, unknown, or other
ccccgcggtggcggccgctctagaactagtggatcccccgggctgcaggaattcgtctcacccctagaaaaaaagctcaacaaaggagcgcggcggcccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacngagatcgagtcggagtaccggtacgacacgacggagctggtgcacgaagccaaggacggcgcctcccgctgggtcgtccgccccaagtccgtcaagtacaacttccggaccagcaccgccgtccccaagctcggggtcatgcttgtggggtggggagggaacaaacggtccacgctgacagctgggggtcatttgccaacaggggaggggattctcatggggcgacccaggacaagggggaggcaaggccacctaccttggggttccctccccccccggctttcccccctcagaattagggcaggctacaaccgggggaaggaaaataaaatggcggccgcttcaaaaaaccctcccttcccccttggtgaaacccccaaaaaaaccctttgtgtttggagagggggggggacacccccccacccttaaacccccggccaaaaacccttctaccccaggcgccaagggggcgcggggaaattttaacccgccgaaaagaagaccccaaggcccccccccttcgagaccaccggggggggcccccttcccccccgggtgtttttgaaatacgggaaacttctattccccg

SEQ ID NO: 95819 - protein, 160 aa, Zea mays
  misc_feature: Ceres CLONE 1586191
  misc_feature: SWISSPROT Homolog: EC 5.5.1.4 Inositol-3-phosphate synthase
MFIESFRVESPHVRYGPTEIESEYRYDTTELVHEAKDGASRWVVRPKSVKYNFRTSTAVPKLGVMLVGWGGNKRSTLTAGGHLPTGEGILMGRPRTRGRQGHLPWGSLPPRLSPLRIRAGYNRGKENKMAAASKNPPFPLGETPKKTLCVWRGGGTPPHP

SEQ ID NO: 95820 - DNA, 834 bp, Zea mays
  misc_feature: Ceres CLONE 1586193
  misc_feature: SWISSPROT Homolog: EC 3.2.1.21 Beta-glucosidase
  misc_feature (728)..(728): n is a, c, t, g, unknown, or other
  misc_feature (816)..(816): n is a, c, t, g, unknown, or other
ctggagctccccgcggtggcggccgctctagaactagtggatcccccgggctgcaggaattcgtctcacccctagaaaaaactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccctcggaaatccctcgaagggactggttcccctctgacttcatctttggtgccgccacttcagcgtaccaaattgaaggtgcatggaacgaagatggaaagggggaaagcaattgggatcacttctgccacaattttccggaatagataatggacgggagcaatgcagacattggagcgaattcgtaccatatgtacaaaacggatgtcagattgctgaaggaaatgggcatggacgcatataggttctctatctcttggcctagaatactgcctaagggaaacggtcgaggaggtattaaccaggatggcatcgattactacaaagggctcatcaacttgttgctagagatggcatagagccatatgtaccattttcccactgggatgcccctcagcactagaagnaaagtacggcggatccttagatagacttcatagaggattgtaatgattacaaaaacctcgctaggtgtgcttcgacactttggtgacnaggggaaaaatggttgac

SEQ ID NO: 95821 - DNA, 856 bp, Zea mays
  misc_feature: Ceres CLONE 1586195
  misc_feature: Encodes the peptide sequence at SEQ ID NO. 95822
tggagctccccgcggtggcggccgctctagaactagtggatcccccgggctgcaggaattcgtctcacccctagaaaaaaccaaacagcgccgcgctccgcattgcgctagggttttagaactcttcctccggtcctccccgttatccctccaaaaggcagcgcccgctagggttttagccgccgcctccttccctctcctcctccacgtctcctcaacagccgctgccacccggagccttcccgcagcgacgccatgtgggctcttcgccgagctggcaaccccctcaggttcccgtgccaaaaagttgcaagtgcccatgtctgtgcgagtcttgaagtgctgctagctgctgatgcaaagaatgtagaagagcaccatgaggcagactgccagaaaatgtgctgctgtcataaacaaggtcaccagcctttccattgtcatttttcatctggccagttttgcttgcaataggggtttctcctctccagcagggtgcaaatccgggtgacaaagctgaatgagttaaaggaacggattttctgaatccccaaggtcccccccaccggctgtttcaaaacgaaggaccgggttggccatccggaaaaatagttcccgaatgaaggaatgcctgccgaaccaattttggctttgccccgaagggggaatcccggatgcaaaaaccccggaaaaggagaccccccagaaaaatttttccggattccatttccccccccaagaaaatttatccggaattccattcccccccccaaaaaccggtggttgggaaagcccccaaagggattcaaaggccccctttccggccccttgagaaaaagggggccaaaaggatggg

SEQ ID NO: 95822 - protein, 72 aa, Zea mays
  misc_feature: Ceres CLONE 1586195
MWALRRAGNPLRFPCQKVASAHVCASLEVLLAADAKNVEEHHEADCQKMCCCHKQGHQPFHCHFSSGQFCLQ

SEQ ID NO: 95823 - DNA, 750 bp, Zea mays
  misc_feature: Ceres CLONE 1586197
  misc_feature: SWISSPROT Homolog: EC 2.3.1.119 Icosanoyl-CoA synthase
  misc_feature (219)..(219): n is a, c, t, g, unknown, or other
  misc_feature (331)..(331): n is a, c, t, g, unknown, or other
  misc_feature (343)..(343): n is a, c, t, g, unknown, or other
  misc_feature (404)..(404): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (633)..(633): n is a, c, t, g, unknown, or other
  misc_feature (651)..(651): n is a, c, t, g, unknown, or other
  misc_feature (652)..(652): n is a, c, t, g, unknown, or other
  misc_feature (654)..(654): n is a, c, t, g, unknown, or other
  misc_feature (655)..(655): n is a, c, t, g, unknown, or other
  misc_feature (659)..(659): n is a, c, t, g, unknown, or other
  misc_feature (662)..(662): n is a, c, t, g, unknown, or other
  misc_feature (664)..(664): n is a, c, t, g, unknown, or other
  misc_feature (667)..(667): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (673)..(673): n is a, c, t, g, unknown, or other
  misc_feature (678)..(678): n is a, c, t, g, unknown, or other
  misc_feature (680)..(680): n is a, c, t, g, unknown, or other
  misc_feature (682)..(682): n is a, c, t, g, unknown, or other
  misc_feature (692)..(692): n is a, c, t, g, unknown, or other
  misc_feature (693)..(693): n is a, c, t, g, unknown, or other
  misc_feature (703)..(703): n is a, c, t, g, unknown, or other
  misc_feature (708)..(708): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (735)..(735): n is a, c, t, g, unknown, or other
  misc_feature (742)..(742): n is a, c, t, g, unknown, or other
  misc_feature (747)..(747): n is a, c, t, g, unknown, or other
gagctccccgcggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgntcgacggagatcgtgaaccgcggcgtggagccgtcgggcccggacgccggctcgccggccttcttcggtgcgcgtgcgccgccgcctgccggacttcctgcagtcggggaanctcaagtactgncgcctcgggtaccactacctcatcagccacggcgtgtacctggccaccatccccgtcatcngtgctggtgtgcggcgccgagctgggcagcctcagccgcgacgagctgtggcgcaagtgtttggggggaggccacctacgacctcgccaccgtgctcgccttcctcgccgtccctcggcttccacccatctccggtctacattaagggcccaggccccagggccccgggggtaccccctatttggaaaatttttttcagaaaatatgggggggggnnncccccacaaanaaaaaaaaaaaaaaaaannannacanacnanaanannnanaaaanananaaaaaacccnncgcccgcccnccccncnnncccgcccgccggcnnncgccggnccggcgncgcgnccg

SEQ ID NO: 95824 - DNA, 881 bp, Zea mays
  misc_feature: Ceres CLONE 1586198
  misc_feature: Encodes the peptide sequence at SEQ ID NO. 95825
  misc_feature (294)..(294): n is a, c, t, g, unknown, or other
  misc_feature (296)..(296): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (390)..(390): n is a, c, t, g, unknown, or other
  misc_feature (394)..(394): n is a, c, t, g, unknown, or other
  misc_feature (396)..(396): n is a, c, t, g, unknown, or other
tacccgcggtggcggccgctctagaactagtggatcccccgggctgcaggaattcgtctcacccctagaaaaagcaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccncnacgtcccccaaatggaagcagcacaggctgccgccgacgcctccgggtatcccccccatcatgggggacgaacggggggatnnnntcccacccncacntntccttccacaacctcaaacccaaatacggccacaacggggttgatgcttggtgcaggtcggcccccttgcccacccatcggggggtccacgcccgcagggcccccaaggccgtgctccccatgcacgaacacgtgctgggggccccgcccgcggaaacctccgttgccgaacatgattgggttgcaagtggccggggaggtgagccttgcgcgcccgtacgcgccaggatttggccaccggggcgggaaggggggctaaggagagcgcgggcaagcgcgggggaaggggcggctccccacacgcgggaaccgggggaggacgagggtgtgcgccggagtgcgggggggcggagcgggggatgggtgcacgggggggtcgcgctgggaagcgggggctcttctgcccgcgatccgagtggggtgcgcgtgccagcacgcttgttactgacaacgctctacccccccgtggcgcactgaatactacg

SEQ ID NO: 95825 - protein, 92 aa, Zea mays
  misc_feature: Ceres CLONE 1586198
  misc_feature (45)..(45): Xaa is any aa, unknown, or other
  misc_feature (73)..(73): Xaa is any aa, unknown, or other
  misc_feature (74)..(74): Xaa is any aa, unknown, or other
  misc_feature (77)..(77): Xaa is any aa, unknown, or other
  misc_feature (78)..(78): Xaa is any aa, unknown, or other
  misc_feature (79)..(79): Xaa is any aa, unknown, or other
MALEAAYDYLHVAVVQCTPTQAAAVLGVLLLLAIRLAAAARSSSXTSPKWKQHRLPPTPPGIPPIMGDERGDXXPPXXXLPQPQTQIRPQRG

SEQ ID NO: 95826 - DNA, 785 bp, Zea mays
  misc_feature: Ceres CLONE 1586203
  misc_feature: Encodes the peptide sequence at SEQ ID NO. 95827
  misc_feature (671)..(671): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (697)..(697): n is a, c, t, g, unknown, or other
  misc_feature (698)..(698): n is a, c, t, g, unknown, or other
  misc_feature (716)..(716): n is a, c, t, g, unknown, or other
  misc_feature (717)..(717): n is a, c, t, g, unknown, or other
  misc_feature (719)..(719): n is a, c, t, g, unknown, or other
  misc_feature (721)..(721): n is a, c, t, g, unknown, or other
  misc_feature (725)..(725): n is a, c, t, g, unknown, or other
  misc_feature (727)..(727): n is a, c, t, g, unknown, or other
  misc_feature (732)..(732): n is a, c, t, g, unknown, or other
  misc_feature (733)..(733): n is a, c, t, g, unknown, or other
  misc_feature (735)..(735): n is a, c, t, g, unknown, or other
  misc_feature (737)..(737): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (759)..(759): n is a, c, t, g, unknown, or other
  misc_feature (775)..(775): n is a, c, t, g, unknown, or other
  misc_feature (776)..(776): n is a, c, t, g, unknown, or other
ctggagctccccgcggtggcggccgctctagaactagtggatcccccgggctgcaggaattcgtctcacccctagaaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttacccaatccccctgggcctggctgttttcctgacaatcgaaccagttcccccaggccttggctcccctgggaagtcccctcccccttccctttttccaatttttgtttccnaaagggggggggggnnnnnnnnnntnntttgtgtgtgtggggtgnngngnggtngntgtgnntntntnnntggttgcgtcttttctcnttcccccgccccgcgnntcgcgcctt

SEQ ID NO: 95827 - protein, 50 aa, Zea mays; identical to SEQ ID NO: 23071
  misc_feature: Ceres CLONE 1586203
  misc_feature (1)..(50): Pfam Name: AdoMetDC_leader Pfam Description: S-adenosyl-l-methionine decarboxylase leader peptide

SEQ ID NO: 95828 - DNA, 822 bp, Zea mays
  misc_feature: Ceres CLONE 1586204
  misc_feature: Encodes the peptide sequence at SEQ ID NO. 95829
  misc_feature (507)..(507): n is a, c, t, g, unknown, or other
ctccccgcggtggcggccgctctagaactagtggatcccccgggctgcaggaattcgtctcacccctagaaaaactccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcaggccaaggcctggtgtctgggattacattcgggtgaatgtaagtgagctggctgtggaggagctgagtgtttctgagtacttggcattcaaggaacagctggtggatggancatccaacagcaactttgtgcttgagcttgattttgagcccttcaatgcctccttttctcgtccttccatgtcgaagtcatcgggaaatggagtgcaattcctttaccgacacctgtcgtccaagttgttcaaggacaggagagtttgtaccccttgctgaactgctcaaagctcataactacaagggcacgacgatgatgttgaatgacagaatcaaagccttcgtggtctccatcatccctgagaaagcagaggagtatctactgagtgttcctcagacactccctactcggagttcaacatagggtccagag

SEQ ID NO: 95829 - protein, 175 aa, Zea mays
  misc_feature: Ceres CLONE 1586204
  misc_feature: SWISSPROT Homolog: EC 2.4.1.13 Sucrose synthase
  misc_feature (123)..(123): Xaa is any aa, unknown, or other
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRVNVSELAVEELSVSEYLAFKEQLVDGXSNSNFVLELDFEPFNASFSRPSMSKSSGNGVQFLYRHLSSKLFKDRRVCTPC

SEQ ID NO: 95830 - DNA, 809 bp, Zea mays
  misc_feature: Ceres CLONE 1586206
  misc_feature: Translation starting site: 186
  misc_feature: SWISSPROT Homolog: EC 5.2.1.8 Peptidylprolyl isomerase
  misc_feature (809)..(809): n is a, c, t, g, unknown, or other
ctccccgcggtggcggccgctctagaactagtggatcccccgggctgcaggaattcgtctcacccctagaaaaaaaccccgcctcccttctgtcatcccgtacgtctcgacctcgcagccgcaaacgcgaaaccctagcctcgagctctatctccggccacagctggtcaggttagcgacgaaggatgagcaggcgctggagccgcacgatctacgtcgggaacctccccggcgacatccgggagagggaggtggaggatctgttctacaagtatggtaaaattgttgacattgacctgaaggtccccccaagaccacctggttatgcttttgttgagtttgaagatcctcgtgatgctgaggaggcaattgctggacgggatggatacaactttgatggacaccgtctaagagtggaggctgctcatggtggtagaggtaatgcttcctcgcatgatcgttcagtggctttggtggcggtggtggagcacgtcgtggtgtgtcgagacactcagagtatcgtgttcgtgtcactggactgccttcttctgcatcatggcaggatttaaaggatcatatgcggaaagccgggggatgtttgtttcctctgaaatgtaatcgcgaagggcgggggcaccgtagggattgggggactacacaaattttgatggatatgaaaattggctataaagaagctgggatgaaaccggaattcagggaacccctttgggccaacccctttttaagggggaaaggaatttaacgggcaaaacggtggtcgcctccctactcaacgttagcccaaagcn

SEQ ID NO: 95831 - DNA, 836 bp, Zea mays
  misc_feature: Ceres CLONE 1586207
  misc_feature: Encodes the peptide sequence at SEQ ID NO. 95832
  misc_feature (339)..(339): n is a, c, t, g, unknown, or other
ctggagctccccgcggtggcggccgctctagaactagtggatcccccgggctgcaggaattcgtctcacccctagaaaaaccagtcagtccacacagcctacggcctgctctggctctgcctgtagagggctagagctacaagctacaactctgaaagtctgaacagtgcgccgcccaaccagagatggcgccgcataccaccgcagccgccggcggcggcggcggcgaggaggcgctggaggaggccagcactctccggcaccgccacagcgctgccaaggacggcggcgaggagggccaggccaacaacggggtcgccgccgccgccgacgacgacnggggaggggaacgcgctgtcggtggagcgcgcgttcgcggaccaggcggttccgtcgtggcgggagcagctgacggtgcgcgccttcgtggtcagcttcttcctggccatcatgttcagcgtcatcgtgatgaagctcaacctcaccacggggatcatcccctcgctcaacgtctccgcggggctcctcggcttcttcttcgtacgcctctggaccgccgccatcgagagggttaggcctctcaggcagcccttcacgcgccaggagtacaccgtcatccagacctgcgtcgtcgcagcctacgacatcgccttcagcgggtgggttgggtacatacttgtttggcatgagcgaaaacatcgccaagcaagcaacagaggctgacatccctcagaatgtcaaaaccctcacatcggatggaatgaatagggttcttccttccttggcaagttccattaggcctaatttgctcctggtgcctcggagaaaaggttatg

SEQ ID NO: 95832 - protein, 90 aa, Zea mays
  misc_feature: Ceres CLONE 1586207
MFSVIVMKLNLTTGIIPSLNVSAGLLGFFFVRLWTAAIERVRPLRQPFTRQEYTVIQTCVVAAYDIAFSGWVGYILVWHERKHRQASNRG

SEQ ID NO: 95833 - DNA, 838 bp, Zea mays
  misc_feature: Ceres CLONE 1586211
  misc_feature: Encodes the peptide sequence at SEQ ID NO. 95834
  misc_feature (403)..(403): n is a, c, t, g, unknown, or other
  misc_feature (405)..(405): n is a, c, t, g, unknown, or other
  misc_feature (658)..(658): n is a, c, t, g, unknown, or other
aaagctggagctccccgcggtggcggccgctctagaactagtggatcccccgggctgcaggaattcgtctcacccctagaaaaaagccccgttcagaccgcccgattcccgttcccgcatcaccttcctccaccaccgcctcccacattcttcgcatccccttatacttttttgtccttctatcgtcgtcgatccgggctcctgttttgcccgcacgcaggctggttgccaagaaagacagggcgagtgcgcggcgcccagctccgaccgtgcttcatagctcatctggccggggacggggatattcgcgttgctcgcttgcccggcgggtagctgtagcctgtaggcgagaatcgggaacgggggtgtttacaggccatgaagtataacacgaggaaagacncnagcggtggcggtggcggcgcgccgtttgccgtcccatgcgtcgacatcaagtcgttcgtgggctcgctcgccttcctcacgctgttcgtcgtgttctggcagctccagccctacggctccgtgctcacagcggctcgcacctccgcctcgcccccctgcaccctcctccccacaaccgctgtcatcgaacctcgctctcctgataccaccagcagcactgccgcaaagacggaacaaacccggcgcggcggcnggcggccgcctgttttcagcttactgccgcaagcgcaaatggctgcccccggggttgggttggcaaaaagccaaccaagggcccggcgccggcccggaaaaatcccgaaaccaagccgcgggtgttccccggcgcccttaacggaaaacgcgcgggcgggccccttgtttccgtggcaaa

SEQ ID NO: 95834 - protein, 153 aa, Zea mays
  misc_feature: Ceres CLONE 1586211
  misc_feature (9)..(9): Xaa is any aa, unknown, or other
  misc_feature (94)..(94): Xaa is any aa, unknown, or other
MKYNTRKDXSGGGGGAPFAVPCVDIKSFVGSLAFLTLFVVFWQLQPYGSVLTAARTSASPPCTLLPTTAVIEPRSPDTTSSTAAKTEQTRRGGXRPPVFSLLPQAQMAAPGVGLAKSQPRARRRPGKIPKPSRGCSPAPLTENARAGPLFPWQ

SEQ ID NO: 95835 - DNA, 813 bp, Zea mays
  misc_feature: Ceres CLONE 1586212
  misc_feature: Pfam Name: MR_MLE_N Pfam Description: Mandelate racemase / muconate lactonizing enzyme, N-terminal domain
ctggagctccccgcggtggcggccgctctagaactagtggatcccccgggctgcaggaattcgtctcacccctagaaaaaagtccagtgggcaatggtgccaatggacccctcgatctcctcgtcctcctcgcctctccggctccccggctcccccaccagcccgggcgcgagctctacgcctagcccgaggcccaccctcgtcgcggccggccgccagcccgccgccgcgcccagcaccacccgcctccgcgccatctcgccgtcccagtcccagtccccgcccaccccggcgtcccccgtggagccgttcggcttcgacgcgctcaaggggaccttctccgtggacgtggcggcggccgacgcgcgcgcgctcgacgtcccgctcgccgcgccctgcaccatcgcgtcctccccgcctcgtcgcggtctccaacgtcggccgtgcgcgtcgagctccgcagcggcgctgtcgggtttggggggaaggcacccgtgttgccctccgtcacggccgaagaacagccggcagcgctcgacgccgccggacaggcgtgcgcagcgctcgtcggcgccccagcggcgccccctcgccgcggtgctcaggaccctcgccagtgtgcttccaggacacgccttcgcctccagcagggatgggaaatggcgcctgattgatgctgttgcttataacatgggcatacctcttatgagattatttgggagagcatcagatagtttgacaactgacatcccaattcccattgtgacccccaatgaagctgctcagttggcggcaaatatccggggacaaggg

SEQ ID NO: 95836 - DNA, 849 bp, Zea mays
  misc_feature: Ceres CLONE 1586217
  misc_feature: Encodes the peptide sequence at SEQ ID NO. 95837
ctccccgcggtggcggccgctctagaactagtggatcccccgggctgcaggaattcgtctcacccctagaaaaatccccccgcgtagaggagaggagaggaagaagaagaacccagccaaatcctcagtcctcaggctgctcacagctcgtgccgtccactctcccccgagccagtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcctccccgtcagtgacccccgcgtcgcccgtctggcaagaggaccctcggaaaggcacagcggtcatcaccggggccgtcgtccgggcctggccctcccaagggaaagggccctcccgaaaacagcaaatgggacgttattaatggcttggccggaatttcctcaaggggtcccgcccggccaaaggggcccggatggaaaaaaaaaaattttcaccgcggggaccctgaaccccccccccccggaaaaagcccccccatttctcagaaaaatgccccccccgggaaaaccccccccccagggggggggttaaaaccccccctttttccccccccccccaagaggggcctttccccccccaagggttttaaaaaaagggggggggaaaaacacgggggcctttttccctcgggggggagtctttaaaaaaaacaaagtccccaaaaaaccccaaag

SEQ ID NO: 95837 - protein, 112 aa, Zea mays
  misc_feature: Ceres CLONE 1586217
  misc_feature: SWISSPROT Homolog: EC 1.3.1.33 Protochlorophyllide reductase
MALQAATSFLPSALSARKEGSVKDSASFLGVRLAADGLKLDTTALGLRTVRVSRSADIRAQTAAVSSPSVTPASPVWQEDPRKGTAVITGAVVRAWPSQGKGPSRKQQMGRY

SEQ ID NO: 95838 - DNA, 804 bp, Zea mays
  misc_feature: Ceres CLONE 1586219
  misc_feature: Translation starting site: 292
  misc_feature (682)..(682): n is a, c, t, g, unknown, or other
  misc_feature (695)..(695): n is a, c, t, g, unknown, or other
ggagctccccgcggtggcggccgctctagaactagtggatcccccgggctgcaggaattcgtctcacccctagaaaaaacgacgcccccatttcgaagctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatggtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgccgtgcagcctatgcatgtcgctgataccagcgaggctgctgctgttatcgcgaaggccaaggaaagcccaaaccggtgcgcaacctgtaggaagcgtgttgggttgacgggttttaactgccgatgcgggaacacgtactgttcgatgcaccgctactccgacaaacacgactgccagttcgactatcgaactgcagctagggacgctatcgccaaggcaatcccagtggtgaaggcggagtagcttgacnagatctgaggcangggcattgggtaacgaataatggttgcgatctgcaagaattcagcatgtctctttgctggcttatcattgaactgccccatctgtcttgctgtcaggtccccgggggtc

SEQ ID NO: 95839 - DNA, 810 bp, Zea mays
  misc_feature: Ceres CLONE 1586220
  misc_feature: Translation starting site: 186
  misc_feature: SWISSPROT Homolog: EC 4.1.1.1 Pyruvate decarboxylase
ctccccgcggtggcggccgctctagaactagtggatcccccgggctgcaggaattcgtctcacccctagaaaaaaacgctccaacccacccgacaaccatcctagtatacacgccaagtcgccagccagcatttcctcccgaaccatccttccactccctcgccgaccctccccccgcgcccgccatggacacggcgatcggctccgtcccggcagcctccgacgcggcgcgtcacccagcgccgtccgcgtccgccccgcgcgacgcgacgctgggccggcacctggcgcggcgcctggcggaggtgggcgcccgggacgtgttcacggtgccgggggacttcaacctcacgctcctcgacgagctggaggccgagccgggcggcgtccgcctcgtcggctgctgcaacgagctcaacgcggcgtacgcggccgacgggtacgcccgcgcgcgcgccggcggggtcggcgcctgcgccgtcaccttcaccgtcggcggcctcagcgccatcaacggcgtcgccggcgccttcagcgagaacctccccgtcgtgtgcatcgtcggcggaccccacagcaacgactacgggagtaacaggatcctgcaccataccatcggctttgcctgatttcacgcaggagctcaaggtgcttcagaacgtcacgtgctatcaggctgtggtgaacaacttggaagatgcgcacgagcagatcgatactggcatcttcacggcaatcaaggagagcaagcctgtttacattagcatcagctgcaacctcccttcgatcccaatcccaccttcagccggc

SEQ ID NO: 95840 - DNA, 787 bp, Zea mays
  misc_feature: Ceres CLONE 1586221
  misc_feature: Encodes the peptide sequence at SEQ ID NO. 95841
ggagctccccgcggtggcggccgctctagaatagtggatcccccgggctgcaggaattcgtctcacccctagaaaaaactagttgttcggcctttccatctgccgttcgcccagcgtgttctccctctagtgcggcaactgggcgaccgccgccgccgcttactccgggtgcccaggcattcgtccgtaccttctcaggccttcatcgcgtccttcgccggcgacgatcaccgacaaggatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccaaaatccggtaccaatatatcagtgattggactgaatggagttctgcgggggaatcctggagggatatatcacctccgaaaatccgaaaaaaagactttgaaaaaagcgggggccggtctttcccctacaggaaaaacgccgccacctttgttgaaaagattcccttgctaaaaaaaaaattctaaacccggggaaaatcccgccacaccccgggttttccccccgcctaagggggggcccttcttccctttaaaaaaaaacccctctttgatttttttccggggaaaaacccccaaaaattttttg

SEQ ID NO: 95841 - protein, 88 aa, Zea mays
  misc_feature: Ceres CLONE 1586221
MERTINSLMYKGSIPDAINQSRREKKLFVVYISGEDEASSSLEQSSLIDENVVEVIGRCCILLHLKQGNVDASQFSAIYPQNPVPIYQ

SEQ ID NO: 95842 - DNA, 844 bp, Zea mays
  misc_feature: Ceres CLONE 1586222
  misc_feature: Encodes the peptide sequence at SEQ ID NO. 95843
ctccccgcggtggcggccgctctagaactagtggatcccccgggctgcaggaattcgtctcacccctagaaaaagtcccttcctcccccaccttgactctcttctcccctcacacctttctggctttgctcctccgccgaggccccgagtcctgccggaattctagatcccggaggcaacttgccacgggctcctccgctccggtcggtgaatcgtactatcgtgctctcgacagaaagcccggtcgaaacccagccggaccaagccctgttcgccgtgcgcgcggtgccccaggccatatctgcgagatctgcaccgacaccgctactcctatcacgagcctgtatgtggatgctctcgtgatctctcggagtcccctggactgagcagcatctctgcggatgcgtcacctgcttagctggtggcctgccgagatgcaccgcattcgggtggtggaatgcatcgtgtgccagtccctggtggtggtgccgagtcaccggagcgtgtcagtgtatacgacgagaccgtagatgatgtcgtccaagttgcgcgcgctcacgtcttcctcgttgtcggcgactgcatgccttttggctctcagcccatcctagcgttcatgtctacgttgatggcgaagttccagtcagtcccatcaggggtaactttctgaccgaggttatgaaagtcatctttgcctatgtgatgctgacactcagtctcgaaagcacaggttggagacatccactcctgggacgttcacccttgtgcaccccgtaacaatgtacttcgtaccgttactgctcgtctgggtgcctcaccaatacgttaaggtccatcagccctg

SEQ ID NO: 95843 - protein, 31 aa, Zea mays
  misc_feature: Ceres CLONE 1586222
MHRIRVVECIVCQSLVVVPSHRSVSVYTTRP

SEQ ID NO: 95844 - DNA, 766 bp, Zea mays
  misc_feature: Ceres CLONE 1586223
  misc_feature: Encodes the peptide sequence at SEQ ID NO. 95845
  misc_feature (440)..(440): n is a, c, t, g, unknown, or other
ctcacccgcggtggcggccgctctagaactagtggatcccccgggctgcaggaattcgtctcacccctagaaaaagaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccggacaggcaccagccgtcggcggcctagcggcagcggaggggagcaccggcacctggtcgcgctcgccgtcgccgcgcgcgtcgccatggtcaccacccggtccgtgggtccagcagcagtagcggaaggtgatggagcgggagctgctgtaacagatgccggcgccgctggcggtggcggacgatgcatggaggacttnctcgactgcctcctcggcttgctcggcgcgttaggcatgacatgggctgcggcgcggccccagcggcagccgcgccccgcgctgcctcgcggggctgcggggggcgggccctgcgccaactgactcccggcgtttcggcggcggagctcagggccacccccgggccggatccgcggcaatggcgcctgggcggtcgcgtcactgtacacgctgcagggcaagaaaggcgtcacccaggatgctaggaccttccgggaaaacttctgtttcaagaaaagataccatctttttgtgggggggtttaacggccatggaccttttgggca

SEQ ID NO: 95845 - protein, 115 aa, Zea mays
  misc_feature: Ceres CLONE 1586223
  misc_feature (75)..(75): Xaa is any aa, unknown, or other
MVEAAAGRRTGTSRRRPSGSGGEHRHLVALAVAARVAMVTTRSVGPAAVAEGDGAGAAVTDAGAAGGGGRCMEDXLDCLLGLLGALGMTWAAARPQRQPRPALPRGAAGGGPCAN

SEQ ID NO: 95846 - DNA, 865 bp, Zea mays
  misc_feature: Ceres CLONE 1586224
ggagctccccgcggtggcggccgctctagaactagtggatcccccgggctgcaggaattcgtctcacccccccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctgcgcatgcgtcggcgtcggcgtcggcgacataaccgaaacgggaagcgggcgccggccagcgaccccgacaagctcttgagcctggctgccgtcgcccgcccatgaagctccccatcatcggggcactgcaccctgatgggggacatccccctacgtgtccctcgccgcgctcggcaaccaggtacggccccggacctgatgctgctccgcctcggcgccgtggccgaacgtggtgggtctcgttccccgcgcgtccccaaagggcgtgcttccgaacctacaaacaaagtttttttcttcccggcccggggttccctgggggtcggaaattcatttatggacgggggccaccggaattcggggttcggcgcccttaagggggaccactttcccgaaagggggcggtaaactgggtcaacctgggacccgggtcaaacgccaagaaaaggggcggttccaacggccgcgccgggaag

SEQ ID NO: 95847 - DNA, 1118 bp, Zea mays
  misc_feature: Ceres CLONE 1586226
  misc_feature: Encodes the peptide sequence at SEQ ID NO. 95848
  misc_feature (12)..(12): n is a, c, t, g, unknown, or other
  misc_feature (15)..(15): n is a, c, t, g, unknown, or other
  misc_feature (17)..(17): n is a, c, t, g, unknown, or other
  misc_feature (71)..(71): n is a, c, t, g, unknown, or other
  misc_feature (76)..(76): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
taatttttttgnaangngggggcggggggggggtggggggagggatatgtactactaccgccccgtcgagnttatnatnnnngatctcaccgcggtggcggccgctctagaactagtggatcccccgggctgcaggaattcgtctcacccctagaaaagctaggcgccgcgctgctgcggatcgcctccctcctccccagtccccgcgccccgccgccgccgccgccgcctcctctcgctccctccttttaccccgagcttaagctcgcgcgtacctgcctacctatccgtaagagaggaagaggggacaaggcccggtcggtcggtcggtcgaggggctctcggatctcgccgctgcctccccgtcgttcgttggggatctcgcgccatggccgccgtcgcgccgccccctgcccccgcgccgggacggttccgggctctggtccctgccaccgtccccgtcgcggatcaaaccaaccgccccgctggcaaaagctggtcgcttcgactcgcaacccccaggcgggggggaaaggaactccaggcctggttggtgtcatccggtcataaaggggggggcccgccgggcagggccaacccccttgaagggggggccgaacccccgcctgggagagcccgcgccattcccccccccggcggggaccccctaggaaattttttttgggggatagccccaaccccgtggtggttgttgaccgcgacccgcgccccgggaaattaactagtgtgcgggggggggccccacaccaaaagatttttttccctatctccatacacctacactgcggggtcataccgaatcttttttccgcggagggggatgaggctgtaggtagtttctcccacagagggagagtgagacacatatctccgccccccgcgggggggtgtatctttgcaccgcccgactcttgctgggggaaaactgtgggtgatgattcggggggatgctgagggggccgtatgagggcgcgcaagggggaaagcggcgcccgggggaacaccacacacggttttgagggcggtacaaacggttttgggggggggagcgaacccctttcctcgaaattgatcctgtgcggttaaacttccccccc

SEQ ID NO: 95848 - protein, 117 aa, Zea mays
  misc_feature: Ceres CLONE 1586226
MAAVAPPPAPAPGRFRALVPATVPVADQTNRPAGKSWSLRLATPRRGGKELQAWLVSSGHKGGGPPGRANPLEGGAEPPPGRARAIPPPGGDPLGNFFWGIAPTPWWLLTATRAPGN

SEQ ID NO: 95849 - DNA, 802 bp, Zea mays
  misc_feature: Ceres CLONE 1586227
  misc_feature: Encodes the peptide sequence at SEQ ID NO. 95850
  misc_feature (496)..(496): n is a, c, t, g, unknown, or other
  misc_feature (505)..(505): n is a, c, t, g, unknown, or other
  misc_feature (507)..(507): n is a, c, t, g, unknown, or other
  misc_feature (565)..(565): n is a, c, t, g, unknown, or other
  misc_feature (566)..(566): n is a, c, t, g, unknown, or other
  misc_feature (568)..(568): n is a, c, t, g, unknown, or other
  misc_feature (569)..(569): n is a, c, t, g, unknown, or other
  misc_feature (583)..(583): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
ctcaccgcggtggcggccgctctagaactagtggatcccccgggctgcaggaattcgtctcacccctagaaaagtgctcgtgcagctctaggctttttttgaggaagcggtaagcgcggagggaggacgggagagagagataggcgtgccttcgtcgtccgtgccggtgcgtggcgtggtggccgtgccgaccgtccgtccaccccctctcctcttcccggcgccggcgacagcgggagggactccctgggaggaatggccgtggtgagggctccgctcggcgcggtggcggtggccgctctcgtcgtcgccatcttcatgccggccgccgcagcggcgcaggcaccggcgcccgcgcccaccagcgacggcacattcatcgacctggggatcgcgtacatccttatgctggtggccctggtgctcacctacctgatccacccgctggacgcgtccctcccctacaagctctttttatctctgctccttttcgttnggtcatgcngntatgggtgctataggaattttaggtgcgcgagatgtttaggtgaggttgggaagtttnnanntgatgatgattgcnatcctttgatcttgggatgtatccaaggctccaagcccgtggtgttctggatgggtttggaattggatcggattcccattatcctttgtgctccagcccctgattttgctccnnnnnnnnnnnnnnnaaaaaaaaaaaaaaaaaaaggattccccgattttcttcgaaatccggattctcccgggtcttacccggaataccccgggccgttggccgggc

SEQ ID NO: 95850 - protein, 182 aa, Zea mays
  misc_feature: Ceres CLONE 1586227
  misc_feature (9)..(62): Pfam Name: DUF1070 Pfam Description: Protein of unknown function (DUF1070)
  misc_feature (81)..(81): Xaa is any aa, unknown, or other
  misc_feature (84)..(84): Xaa is any aa, unknown, or other
  misc_feature (104)..(104): Xaa is any aa, unknown, or other
  misc_feature (105)..(105): Xaa is any aa, unknown, or other
  misc_feature (110)..(110): Xaa is any aa, unknown, or other
  misc_feature (148)..(148): Xaa is any aa, unknown, or other
  misc_feature (149)..(149): Xaa is any aa, unknown, or other
  misc_feature (150)..(150): Xaa is any aa, unknown, or other
  misc_feature (151)..(151): Xaa is any aa, unknown, or other
  misc_feature (152)..(152): Xaa is any aa, unknown, or other
MAVVRAPLGAVAVAALVVAIFMPAAAAAQAPAPAPTSDGTFIDLGIAYILMLVALVLTYLIHPLDASLPYKLFLSLLLFVXSCXYGCYRNFRCARCLGEVGKFXXDDDCXPLILGCIQGSKPVVFWMGLELDRIPIILCAPAPDFAPXXXXXKKKKKKGFPDFLRNPDSPGSYPEYPGPLAG

SEQ ID NO: 95851 - DNA, 805 bp, Zea mays
  misc_feature: Ceres CLONE 1586229
  misc_feature: Encodes the peptide sequence at SEQ ID NO. 95852
ctggagctccccgcggtggcggccgctctagaactagtggatcccccgggctgcaggaattcgtctcacccctagaaaaagacgcagcacctcctgctgctgttcttcctcgtcctcggcgtcgctaccaacagcagccattcttccaccatcaacatcaccaaccgatgctcctacacagtgtggccggccgccacaccagtgggcggcggcatgcagctggagcctgggaagacctgggtgcttcaagtgcctggcaacacgcaaagtggccgcgtgtgggcgcgcacgggctgttcgttcgacggccccggaaagaaatcctgccagacgggtgactgcggcggcgtgctggcatgcactaccagcggccaaccgccgatgacgatggcagagttcaccctgagtgactccaacaacatggacgactacttcgacatcaccgtcgtcgacggctttaacttgcccatggactttctgccggtgccgtcgtccaaggggtcgtcggggtgcagcaggggtccacgctgcgccgccgacatcacgtcgcagtgccccgatgagctcaagtgccaggggggttgccgcagcgcgtgcaacggatcttcctgcgacgccagcacggtaaacagccaacacgtttttctacgctcggatgttcccccgacgcctatacctacgccactgattattgtccccgtaacatatttcgtgtccgtcaggaaacagattaccaaatcatttttctgtcccccccctcaattctggggttatggtctccaacttccaatttcacaattgtctc

SEQ ID NO: 95852 - protein, 197 aa, Zea mays
  misc_feature: Ceres CLONE 1586229
  misc_feature (1)..(180): Pfam Name: Thaumatin Pfam Description: Thaumatin family
MQLEPGKTWVLQVPGNTQSGRVWARTGCSFDGPGKKSCQTGDCGGVLACTTSGQPPMTMAEFTLSDSNNMDDYFDITVVDGFNLPMDFLPVPSSKGSSGCSRGPRCAADITSQCPDELKCQGGCRSACNGSSCDASTVNSQHVFLRSDVPPTPIPTPLIIVPVTYFVSVRKQITKSFFCPPPQFWGYGLQLPISQLS

SEQ ID NO: 95853 - DNA, 1097 bp, Zea mays
  misc_feature: Ceres CLONE 1586230
  misc_feature (13)..(13): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (61)..(61): n is a, c, t, g, unknown, or other
  misc_feature (76)..(76): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (495)..(495): n is a, c, t, g, unknown, or other
tttttgttttttntttgtttnnnnnaccacaacacgaacgggtaagtgaaacacactaacnaagataaagaggggntnnntttttaagctggagctcaccgcggtggcggccgctctagactagtggatcccccgggctgcaggaattcgtctcacccctagaaaaatcttctctccttttgctcggaacgcacactcaggccggtccccgatctccgatcccctcgtcgatccaagatgcagatcttcatcaagaccctcactggaaaagactatcaccctcgtagtggagtcttctgacaccattgacaacgtcaaggccaagatccaggaaaaggagggcattccccccggaccagcagccggctcatcttccgctgggcaaagaggctccaaggacgggcgcacattttgccgacttccacatccaggaaggagaggtgccttcccccttttttcttccgcctcagggggaaggattgcaaaatttttccntccaaaaccccttcatgggggaaagaacttttccccccccccaaggggggaaatcccttccgtaacacccccttcgtaaaaaagcgtttaaaaggggcccaaagattctccgggagaaacaagggggaggggggcttctcccccgccgggggaaacacacaaccaaggccgggggtttcacaatattttttttgcccccggggggaggagaaaacactccctctccctctaaaaaaagaatagagggggagggacctcacctctcacaccggggggggggctgggaataattaccccaaacactatttttttatgtagaaaagtggaggggagtgcgacacgcccccctccccccaccgcggttgggtggggggtgttgcccggcccctccctgaagggggggggggggggaattctttccaccataatatttttttttgtggaaaaaataaaccccctctataaagggcggggagaaagaatagtgtttcctcccccctttttatggggggcgcaggaagttctcctttggttgataaccgcttccgccataaaatggtggggggggggcggaaaaaaattccctccgaaagaaagggggg

SEQ ID NO: 95854 - DNA, 803 bp, Zea mays
  misc_feature: Ceres CLONE 1586233
  misc_feature (428)..(428): n is a, c, t, g, unknown, or other
  misc_feature (704)..(704): n is a, c, t, g, unknown, or other
aaagctggagctccccgcggtggcggccgctctagaactagtggatcccccgggctgcaggaattcgtctcacccctagaaaaaatcataaatagatggcttgcattgcaacacaagagagatgcttggtcgttgtagccaagttcgaattggcactcgtagcatctattctttccggtccggcggatgatcgatgttgatatgtgcggtcgtcggcataatatataatactcgacatcaaacagctagcactagtagggctgcatatatcccgtgggctcattgcgtgttcgatcgatcggatccccatacgatctactagctagctaagctacacgactcgaccgaggaggaggagcgcgctcaggccgtatagaaacttggagcatgtcgttaaccacccaagtgtttgggcctcccggctacangcgggtgggtggatctattacatcgtcaacgatactgatcaattgagtaaagctctgaaccgacctgatcaccctggtggtgttcatggttctcggcggagtgggacgaaccctgcaaggcgatgaaagaacccgttcagggacatgggccagggctagaaagatgcaggccgtatttctgctttggtggacatcgacaagcttaaagatgctgtggcgcagcagttccaagtggaggcgctgccccacgttcgtgctgtacaagacggcatacanaaaagggagggtcgtttggcgcccaaggggaacgacttcagagcccgcatcgacagcaactatgatttcattctccgatcgatcgatccattcgtgctg

SEQ ID NO: 95855 - DNA, 834 bp, Zea mays
  misc_feature: Ceres CLONE 1586240
  misc_feature: Encodes the peptide sequence at SEQ ID NO. 95856
  misc_feature (680)..(680): n is a, c, t, g, unknown, or other
ctggagctccccgcggtggcggccgctctagaactagtggatcccccgggctgcaggaattcgtctcacccctagaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgtgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtccacatcctctgctccgcgttcctggtcgtcttcgtcggcaccgtgtacgtgatgtcgcgccccaggccggtgtacctggtggactacgcctgctacaagccccccgccagctgccgcgtgcccttcgccaccttcatggagcacacgcgcctcatcagcgacgacgaacagagcgtgcgcttccagaacagggatcctggagcgctcggggctcggcgaggacacgttgctcccgcccgncaaacactaaatcccgcccaaccccagcatggaggcctcccgcgccgaggggcagctcgtcatctttctccgcatcgacgaacttcttccgccgcacgggggcttaagcccaagggactcgaacatcctcgttggtcaatggcagcctttttct

SEQ ID NO: 95856 - protein, 194 aa, Zea mays
  misc_feature: Ceres CLONE 1586240
  misc_feature: SWISSPROT Homolog: EC 2.3.1.119 Icosanoyl-CoA synthase
MPSGSVFSGSVNLKHVKLGYQYLVNHFLTLLLVPVMAATALELARLGPGELLSLWRSLELDLVHILCSAFLVVFVGTVYVMSRPRPVYLVDYACYKPPASCRVPFATFMEHTRLISDDEQSVRFQNRDPGALGARRGHVAPARQTLNPAQPQHGGLPRRGAARHLSPHRRTSSAARGLKPKGLEHPRWSMAAFF

SEQ ID NO: 95857 - DNA, 794 bp, Zea mays
  misc_feature: Ceres CLONE 1586242
  misc_feature: Encodes the peptide sequence at SEQ ID NO. 95858
  misc_feature (518)..(518): n is a, c, t, g, unknown, or other
tggagctccccgcggtggcggccgctctagaactagtggatcccccgggctgcaggaattcgtctcacccctagaaaaaatctagccctcttctccctgaccctgcgcccgcggctcggtgcggttaccgtttccttggcgcgcgcgtcagcactccgccgatgcacgcgccgttggaggccatgaacgggagggcgcggaggccggcggcggcgcgcggcgccgccccgaggaacgagaaagcgatggagaaggagcagaggaggccacccagctcgaagacggcgccggtgtccatgaaggcgtcgcccgcaaatgcgacgccgcaatgcatgaagaacaggaaaattgcactgcagcaggacgtggacaagctgaggatgaaactgcggcacgaggagaacgtccaccgagctctggagcgggcgttcacgaggccgctcggcgctctacctcgcctccctcctttcctgccgtctcaaacgttggagcttctggccgaagtcgccgtcctggangaggaggtcgtccggctggaggagcaggtcgtcaatttccgggcaggactgtaccgggagaccgtcatcaccacctcatggcggcgaagagcgtgtacttcccggacggttacccgagcacgccggcacggcacaagccacctgcacaaccgcagagtccagagctgtctacctcgacgcgccaaggctccgatcaagatgcggctgaatgggctgccatctttgaggcgagccacccatgcgatgtggacaccaagaaaggccgggtcgttccct

SEQ ID NO: 95858 - protein, 211 aa, Zea mays
  misc_feature: Ceres CLONE 1586242
  misc_feature (119)..(119): Xaa is any aa, unknown, or other
MHAPLEAMNGRARRPAAARGAAPRNEKAMEKEQRRPPSSKTAPVSMKASPANATPQCMKNRKIALQQDVDKLRMKLRHEENVHRALERAFTRPLGALPRLPPFLPSQTLELLAEVAVLXEEVVRLEEQVVNFRAGLYRETVITTSWRRRACTSRTVTRARRHGTSHLHNRRVQSCLPRRAKAPIKMRLNGLPSLRRATHAMWTPRKAGSFP

SEQ ID NO: 95859 - DNA, 806 bp, Zea mays
  misc_feature: Ceres CLONE 1586244
  misc_feature: Encodes the peptide sequence at SEQ ID NO. 95860
aagctggagctccccgcggtggcggccgctctagaactagtggatcccccgggctgcaggaattcgtctcacccctagaaaaaagcgaagaggagacgacgactgctctgcctttcttccctacaggaacaggacgaatcaatcaatcattcccctctgcagccgccggccctcagcaagcaagcaagggacagacgcggcggggatgggcagcggggtccgggcgctgatgcgccggaagcaggtagactccgagcggacgcgcgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctggctagccgttgcccttcggcaggaagcgcctatcattattcgtacatctgcgttggcgaaagagttgcatggttgattggctgggctttgatacttgaatacacgattggtggatcagccgttgcccgtggcatttctcctaatctaggcttattttttggaggacaagatagtctgcccatggatttagcacgacatgagatcccatggcttgatgtcgttgtagatccctgtgcttcttttcctcgtttcgccgtcacgggccttctctgtgtgggggataaagaaaggtcattttgtgcaaggagttgtggacggcctaaaatggcttggggaagtt

SEQ ID NO: 95860 - protein, 200 aa, Zea mays
  misc_feature: Ceres CLONE 1586244
MGSGVRALMRRKQVDSERTRAAGSAHQLRKELSVTQLVAIGVGSTIGAGVYVLVGTVAREHSGPALTLSFLIAGIAAALSAFCYAELASRCPSAGSAYHYSYICVGERVAWLIGWALILEYTIGGSAVARGISPNLGLFFGGQDSLPMDLARHEIPWLDVVVDPCASFPRFAVTGLLCVGDKERSFCARSCGRPKMAWGS

SEQ ID NO: 95861 - DNA, 1160 bp, Zea mays
  misc_feature: Ceres CLONE 1586246
  misc_feature: Encodes the peptide sequence at SEQ ID NO. 95862
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (358)..(358): n is a, c, t, g, unknown, or other
  misc_feature (794)..(794): n is a, c, t, g, unknown, or other
  misc_feature (818)..(818): n is a, c, t, g, unknown, or other
  misc_feature (832)..(832): n is a, c, t, g, unknown, or other
  misc_feature (857)..(857): n is a, c, t, g, unknown, or other
  misc_feature (858)..(858): n is a, c, t, g, unknown, or other
  misc_feature (868)..(868): n is a, c, t, g, unknown, or other
  misc_feature (870)..(870): n is a, c, t, g, unknown, or other
  misc_feature (871)..(871): n is a, c, t, g, unknown, or other
  misc_feature (931)..(931): n is a, c, t, g, unknown, or other
  misc_feature (1049)..(1049): n is a, c, t, g, unknown, or other
  misc_feature (1050)..(1050): n is a, c, t, g, unknown, or other
  misc_feature (1064)..(1064): n is a, c, t, g, unknown, or other
nttttttttnnnnttccctttgattggtgtgtggggggggggggtagtagttttttatttntnnntnnnnnnacaagctggagctcaccgcggtggcggccgctctagaactagtggatcccccgggctgcaggaattcgtctcacccctagaaaaaaccgctcgcaaaacctctcctgctcctacgcccgccccaaaccctagccccgacagcgcggcagctcgtggctatggccgcgtcagtcccgtcggcgggtggggcggggacgatgagccgcgacgcgttccgcgcggccgtgaccaacacgctggagcgccggctcttcttcgtgccctctttcaagatctacgggcgggnggttctcccggggggggcgttctttttttttttgattagcggaccccccccccccccgcgggtgtgcggcgcgccggtggggaaaaaaaaaaataaagaaccccccccccgcaccctattttatctgtttgggggggggtggggacgccccttaaccatttttatttatttcttcccttcagggagaaaggaaacgtagatttagataagttctgttgttttcatattataattatagagagaaattctaagaagaggcgggcaaacaaatcctcccccccccccacaacaaagatgtaatagattaaaaacctcatcacgagcttttttttttcttttccctggatgacctcatcgctattgccaagcgatcgcagactgaacgagtggcaccggcatcattaatattggaggtgtggcgctcctcacacctatntaacataaggaactgggatgaggntgagcacctgacgnccagaccacaccaaagaaggttggnnggtggtgggngnnccccaccaccaaaacaacccagacaggataagataaaaatacttcatataagaagctaangacagttaagtctataggtatatgtcactacatacctccgatagggagagtaggctggcgagtgctgtgaagcgtagagtcgtgcctcagtctggggtgccgagatcggcgatgattnnttgttagaagaagnacccacccgccaccacaacacacttaatacgacggagcaataggagggtactattctgaagaaagtgcctcgagaatgaaggggcgactacacaat

SEQ ID NO: 95862 - protein, 108 aa, Zea mays
  misc_feature: Ceres CLONE 1586246
  misc_feature: SWISSPROT Homolog: EC 6.1.1.14 Glycine--tRNA ligase
  misc_feature (43)..(43): Xaa is any aa, unknown, or other
MAASVPSAGGAGTMSRDAFRAAVTNTLERRLFFVPSFKIYGRXVLPGGAFFFFLISGPPPPPRVCGAPVGKKKNKEPPPRTLFYLFGGGWGRPLTIFIYFFPSGRKET

SEQ ID NO: 95863 - DNA, 855 bp, Zea mays
  misc_feature: Ceres CLONE 1586247
  misc_feature: Translation starting site: 107
  misc_feature: Pfam Name: DUF906 Pfam Description: Domain of Unknown Function (DUF906)
  misc_feature: SWISSPROT Homolog: EC 2.3.1.48 Histone acetyltransferase
  misc_feature (490)..(490): n is a, c, t, g, unknown, or other
  misc_feature (504)..(504): n is a, c, t, g, unknown, or other
ctggagctccccgcggtggcggccgctctagaactagtggatcccccgggctgcaggaattcgtctcacccctagaaaaagaagaaatttaattatgcagaaacagatgctgaggctgaatggtgggtccagtgcgacaagtgcaaagcttggcaacatgaaatctgtgctctttttaacagaaagtgtgaaggggcaaaggctgagtatacttgtgcaaaatgttttttgaaggaaaaggatagtggagatattcaggcactggagtcatccactgttcttggggcacaggagttacaaagaaccaagctaagtgatcatattgagcaaagactttcagagaggcttgagcaggacaggcaacagagggcgagcgcctctggaaaagttgctgaagaggtaccaggtgtgaaagggcttacagttagagtagtttcttcagccgaaaagatactgcaagtccaaccacgttttcgtggtttttttaaancaggaaagtatccntggggaatttcatacaaatcggagggcattcctcttgtttcaaaaaatcgaaggtgtggaatgtttgccctctttggcatgtatgtaccaaaatatgggtcaaattgcccccccccaaactcaaaacctgtttattctgcaaaaatttgattctggcaaaaaatttcgggccggaaattaaaattgccacggggaaaaactttccccccccttttgggtacaaggaaaaatttgaaagggggtttttggggaactccccaaaaaaaacgggggggttttaaaccgttctcaaaaggggggtcgccccctcccccaaaggagagaggaaatttgttttttaattgccccccc

SEQ ID NO: 95864 - DNA, 894 bp, Zea mays
  misc_feature: Ceres CLONE 1586249
  misc_feature: Translation starting site: 136
  misc_feature: SWISSPROT Homolog: EC 1.4.1.2 Glutamate dehydrogenase
ctagaactagtggatcccccgggctgcaggaattcgtctcacccctagaaaaactcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggggagaagccaatggattgttgtccagcacaagggtgaggagaagcaatttgcagctgaagagatctcctccttgggtcttatcaagatgcgtgagattgctgaagcttaccttgggaagcccgaatcaagaatgctgggggtcacagtcccctggccaacttccatggactcgcagaagggagggcccccaagggatgctgggggggaattgccttggcctttaaaggggctgggcgtttcatccaaggagagccaaagcgggttgccgggcaattgccctaagggtcctttgacaaggaaaggctttccccggtgttcgggagaagaaacatggccccccacccttttggacccttgggggggggggcccctcttgggagcgcgccccctcccccacccccctggggggggaagggagtttctttgggggggccaggggccccatcgctgggg

SEQ ID NO: 95865 - DNA, 1333 bp, Zea mays
  misc_feature: Ceres CLONE 1586252
  misc_feature: Encodes the peptide sequence at SEQ ID NO. 95866
  misc_feature (57)..(57): n is a, c, t, g, unknown, or other
  misc_feature (66)..(66): n is a, c, t, g, unknown, or other
  misc_feature (1251)..(1251): n is a, c, t, g, unknown, or other
gtttttgtttgtttttttttgcgggccccgcacctcgctcccctccatatttctaanaaaaaagtntatttatgctggaactccccgcggtggcggccgctctagaactagtggatcccccgggctgcaggaattcgtctcacccctagaaaaactcggaaccctagtcccctgctccattctcagccgccgccaatcccttcccgtgctccgcaaccgctgagcgagaagaatgattatggttcggcataggcgatggcccggctatcggtatctatctcggcacgacggactgcttgcgtcggcgtgaggcagcaccaccgcctcgagattattgccaacgaactagggaaaccttaccacggccctcgtacggtgccttcgccgactccgaacgccctcagcggaggatgcgtccaagaagctgggtcgccatttaaccccattcgcgccgcgggcgtggaatgcactggcgtctctcatcggggtgggagctacaaggtagggagacagccgggccccggtcgcggactcgaggtttatgggccccagcaaggagacagttccctcggcgctggcatcaaagagcgcgcagttgaaatgggtgttgccgggacgccacagggcccgcgggcgagcacccgcccgctggtggcagacgttgaaagggcacacccccgctcgcgattggggacgcctcgcggcacaggacacatgaacgtgcagacaacttttcctttgagagacggggggaggctgaggaagcgacagctggccactggacggacagaaccgaaggtcgcccggagggccacttacagaatggggtctcccctctaattcccaccatgcatatcgagagatgagtgagatacgccctatcacggacaccgtctcatgggtcgcccagatctacacagcgttacgacgggtaggtcgggcgaggagaagaaggtgcagtgctgggtggagttccttaagtgatatgtcgcgctccccgctctctaattcccccctgcgtgggtgacgctcgcgaatgcgacagaaagtgggcgcgcgcaaaagaggggtacagtcgtgaggacacattgccgtggagatcgctacatgccacatagcgaacaccgcgcttaggaggcacggagagggagtggcgaaacaacacaagacggcatctcgcccccaaccggcgcttgcgtaaacgctctgagtctatgtgacgtcgcttcgaacactgaactctcgaagctngagttgtgaagtgcgccccgcctcccgcccctattggtctgatgggaggacccaccgctacgccacgacgaggagcacgcgc

SEQ ID NO: 95866 - protein, 194 aa, Zea mays
  misc_feature: Ceres CLONE 1586252
MARLSVSISARRTACVGVRQHHRLEIIANELGKPYHGPRTVPSPTPNALSGGCVQEAGSPFNPIRAAGVECTGVSHRGGSYKVGRQPGPGRGLEVYGPQQGDSSLGAGIKERAVEMGVAGTPQGPRASTRPLVADVERAHPRSRLGTPRGTGHMNVQTTFPLRDGGRLRKRQLATGRTEPKVARRATYRMGSPL

SEQ ID NO: 95867 - DNA, 816 bp, Zea mays
  misc_feature: Ceres CLONE 1586261
  misc_feature: Encodes the peptide sequence at SEQ ID NO. 95868
  misc_feature (816)..(816): n is a, c, t, g, unknown, or other
ctggagctccccgcggtggcggccgctctagaactagtggatcccccgggctgcaggaattcgtctcacccctagaaaaaaaaaacccttccgccccgagccgaccggaaccctacccatcccgcagcgccgccggccgcccgccccgccccgccccttcaccccctacctcttcttgcgccgtcatcccgatcccctacgctcgctgaggcattatgggtaaatcaagcaagaagtccagtgttaaggctgcacctgctgctgtctcagttccagaggtgaaatctgcaaagaaggggaagagaaatgcagaagatgagattgagaaggccgtgagtgcaaagaagcaaaagactgtacctgaaaaagctgtgccggttaagaagcagccccctccaaagaaagttgagagcagcagctctgaggaggattcttcagattccgaagtggaggttaaggtccagccgaagaaggttattcaaccgaagaaaggtacacaacctgctaaacaggagtccagtgatgacagcagctctgagagctcctcagacgatgaaccttccaaaaaaccagttgccggttcaaaaaagcctcctgccagtagtagcagcagtgatgatagcagtgacagtgatgatagtagctctgatgaggaaccagcaaagaagcccacggtcctttcaaagaagcccactgtcctttcaaaaaaacctgtcacagcagtcagtaatggttcaaaacaggttaaacctgatagcagcagctctgacagtagctcagatgaggatgaaaaacctgcggctagcctaaagaagn

SEQ ID NO: 95868 - protein, 200 aa, Zea mays
  misc_feature: Ceres CLONE 1586261
MGKSSKKSSVKAAPAAVSVPEVKSAKKGKRNAEDEIEKAVSAKKQKTVPEKAVPVKKQPPPKKVESSSSEEDSSDSEVEVKVQPKKVIQPKKGTQPAKQESSDDSSSESSSDDEPSKKPVAGSKKPPASSSSSDDSSDSDDSSSDEEPAKKPTVLSKKPTVLSKKPVTAVSNGSKQVKPDSSSSDSSSDEDEKPAASLKK

SEQ ID NO: 95869 - DNA, 865 bp, Zea mays
  misc_feature: Ceres CLONE 1586262
  misc_feature: Encodes the peptide sequence at SEQ ID NO. 95870
  misc_feature (594)..(594): n is a, c, t, g, unknown, or other
  misc_feature (595)..(595): n is a, c, t, g, unknown, or other
  misc_feature (599)..(599): n is a, c, t, g, unknown, or other
  misc_feature (600)..(600): n is a, c, t, g, unknown, or other
  misc_feature (602)..(602): n is a, c, t, g, unknown, or other
  misc_feature (603)..(603): n is a, c, t, g, unknown, or other
  misc_feature (606)..(606): n is a, c, t, g, unknown, or other
  misc_feature (608)..(608): n is a, c, t, g, unknown, or other
  misc_feature (848)..(848): n is a, c, t, g, unknown, or other
ggagctccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggggtccccggagacgatccgcgacccgcgcggggttcgccgtgaagttctagacccgcgagggcaactggggacctgctggggcaacacttcccccgtccttttttttaaaaannccgnnannggnanaaaaaaaaaaggggggggggggggggtgtttctcatggatcggggtgggtgagaaaggagtggtattgtgataacgcttctggcggactttctcggggcgctgcatggtggggggggtgaggagttgatgggagttggcggcggccgtgggagtggctggtagtgcgggaggcaggggtgggagggggggtatgatattgatgggggtcgggcggcggtgcggggcgggggggggggganagtgttccggtggcgcg

SEQ ID NO: 95870 - protein, 124 aa, Zea mays
  misc_feature: Ceres CLONE 1586262
  misc_feature (18)..(125): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGVPGDDPRPARGSP

SEQ ID NO: 95871 - DNA, 1333 bp, Zea mays
  misc_feature: Ceres CLONE 1586270
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (70)..(70): n is a, c, t, g, unknown, or other
  misc_feature (803)..(803): n is a, c, t, g, unknown, or other
  misc_feature (1054)..(1054): n is a, c, t, g, unknown, or other
  misc_feature (1144)..(1144): n is a, c, t, g, unknown, or other
  misc_feature (1260)..(1260): n is a, c, t, g, unknown, or other
tttttttgttcgttctcccctttcgtggggggttgtggggtgggagggggcaaggggaggtnnncatganaaggggggtggggtagctccacgacgtggcggccgctctatactagtggatcccccgggctgctggaattcgtctcacccctagaaaaatctgagctcgccagaaaagaccctgactgtccgacacccgcaagccacaaagtgcaagcctcgtttgctacagggaatggctgagaaatgtctgtaccttggccggaaagcgcaacgctgcggcagtggcctgcgtctgcgccccgcaagcacgtccaaggacggggtagagttcatcgggtcttcgtcacctggggtttttgggggttaaattcaatttatagccaaactctgttccttaagaaaggaacattcttaacatttatgaacggaagtcgggcgcgcatttgggagagatggcaaattttctttctggaaccgggaagcaacccccccttcaaataggcgcgggggactaaggctgggggggggggttgactaacccggcataggcggagcttgctggggacggggatggccactgcgagggggcgtgatgaatttctgtcggatacaagaccccaccactccggcgcggccgggggccaagatagggcgggatcgggcccttctgggtctatagatcttgtgagcggcgtagcggcgcaggctattaggggggggatgtctatcgtctggcttatggccgggtgtgtagatatcgcgcccggatgcgggcgagaagacagatgtgggtggtcggnacagtgagccgcacttatgctagtcagagtaagaacgacgcttggacataacgctaagggtgagtgtaatttaggtgctaccaagcgcggagcggactacgaacaagggagagataataacatagtctagattcgtctttgacgtataggagttctgcatagattccatacgtcaactagggagaaaggaagtactccggtatgctactagcgccgtactatccgttgagcacaaccgtacacgtcacgtntcaggtcgatggtgctacctgaggtgagagtgacaagcatcgaggctacggaggtcaatagtgtctatagtacgtcgattagggcggatngtgacactgactgagagcgatacgtcgatgctcaggagagattgaatacgttgagagaacgagtctttacaaaaacatggtgaatcagatgtcacgtgctcataatagagacgcgntagattacccggtttaatatgaaagatcacaggccagcgtcacgcttcatgatatgcgacggtaggggcgaca

SEQ ID NO: 95872 - DNA, 884 bp, Zea mays
  misc_feature: Ceres CLONE 1586275
  misc_feature: Encodes the peptide sequence at SEQ ID NO. 95873
  misc_feature (884)..(884): n is a, c, t, g, unknown, or other
ggagctccccgcggtggcggccgctctagaactagtggatcccccgggctgcaggaattcgtctcacccctagaaaaactgtttcgtgaacctgggactcaactcgaactcgaaccactacgtcgcctgcctcctcatcttcctgctgcatttctccccccagttaaatccatccaattctaattcaactagtaattgtgaaggagaagaacagagctgcacagatggcgagcaacagctcatgtggtgaaaatgcgagaaagccacacacaccatccgctattgttattggtggtgggtttgcaggtcttgctgctgctgatgcgctcagaaatgcatccttccaggttattcttctggaatctcgtgatagaattggtggcagagttcacactgactactcttttgggtttccagtcgatttgggagcatcttggcttcatggcgtctgtgaagaatatcccttggcaccaataatttggaaggcttggacttccactgtaccgcacaagtggagacgattctgtgctgtttgatcatgatctggagagctatgcactctatgacactaatggacgtcaagtaccacaggagttggtagaaaagattgggaaaggtgtttgagaccaatactgggagagactggccaattggagggaaggaacccaatgaagatatgtctatcgcaaaagcccattgcaaattgttatgggatagaaaatccccagtttgacgccaagaagggaattgcctccatgaagtttcttccaggtggaatttttgtgcccgttatgggaggggtttggttttgcccacttgaacccaaaattccaattttcccctacacaggggcctggggaatcaaggaaagggcgccggctttn

SEQ ID NO: 95873 - protein, 103 aa, Zea mays
  misc_feature: Ceres CLONE 1586275
  misc_feature: SWISSPROT Homolog: EC 1.4.3.4 Amine oxidase (flavin-containing)
MASNSSCGENARKPHTPSAIVIGGGFAGLAAADALRNASFQVILLESRDRIGGRVHTDYSFGFPVDLGASWLHGVCEEYPLAPIIWKAWTSTVPHKWRRFCAV

SEQ ID NO: 95874 - DNA, 1333 bp, Zea mays
  misc_feature: Ceres CLONE 1586278
  misc_feature: Encodes the peptide sequence at SEQ ID NO. 95875
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (17)..(17): n is a, c, t, g, unknown, or other
  misc_feature (57)..(57): n is a, c, t, g, unknown, or other
  misc_feature (58)..(58): n is a, c, t, g, unknown, or other
  misc_feature (68)..(68): n is a, c, t, g, unknown, or other
  misc_feature (81)..(81): n is a, c, t, g, unknown, or other
  misc_feature (1143)..(1143): n is a, c, t, g, unknown, or other
nnntttttttttttttnttttttgtctgtcccctccccccccccggagggcgcgcannaaaacattantataaagaagaanattccccgcagagggcggccgctctagaactggtggatcccccgggctgcaggaattcgtctcacccctagaaaaatctccagcattccgccgttcccaccacgccactcgccagttcgtcactccctcctgtctccccccttgccgagacggcgcggacgcccccgtcgcccacccccgatggcgttcactctcctccaaaccgccaccgccctcggtccagagcttcctccgcggcccggacgctcggggggcgggccccggactttcaaccccaccccagctcaccccggtccgataggggtggggcagcacggtcgaacacgcgggaagttggcggcctccagggcttcgaatccggggcaggattggcgcagcacgcccgcaggttgggggggaaagggagggcgacgcggagggccggggggggcacccgaataaaagccacttggccacgggcggcccaagaagtgcaggtggtagcgacagggtgggggacgaacaatatgtatcctaattaggcggggcgccctgctgggggggccgggcggcagcaggtagtcaggccgcgacgggaagcgttggcgcgagagggcggggcggggctttgtatggtcggacgggcgactcggaagaaggtcacgccctgtctacaaatgacggccgtatatgagggcgtgccaaactataacgcccagagagagaataaaagtatagaggtcagcgtcggagactcagagacatattgagcgcgcaagaggagagagccccgcctacgaagtgtacggggtagaggcaagaacgccagctctgccggccgtttacggcgcggtgcgaaaaaggacgcgcagccaggatttgtgagaagcaggacgggtaccccagtggtaacgcgcgcaacgacggcggctcccgcgccggcgaggtgcggaagcgcgtgtgtggatcgtcgcgacagtggtagaggggggagcacgattgaggcgcgagtgtgccgcaactgactctagctgtgatggtgtgacgtgcgagacactctcgcgagtagaggccccgtacggngacggggaccatgcacggtgcggacgggagagcgtgggctgaccggacgtctcacgatgcgagagacccatgatgaacggggagcctccacagagagagagctgtggacgagtggacggacgggagcagcgagagtcgcgcctgtgtaggctcgtgtgtcgtctactcacatcgcgtcgatgaaagatac

SEQ ID NO: 95875 - protein, 86 aa, Zea mays
  misc_feature: Ceres CLONE 1586278
MAFTLLQTATALGPELPPRPGRSGGGPRTFNPTPAHPGPIGVGQHGRTRGKLAASRASNPGQDWRSTPAGWGGKGGRRGGPGGAPE

SEQ ID NO: 95876 - DNA, 1301 bp, Zea mays
  misc_feature: Ceres CLONE 1586279
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (75)..(75): n is a, c, t, g, unknown, or other
  misc_feature (76)..(76): n is a, c, t, g, unknown, or other
  misc_feature (792)..(792): n is a, c, t, g, unknown, or other
  misc_feature (875)..(875): n is a, c, t, g, unknown, or other
  misc_feature (977)..(977): n is a, c, t, g, unknown, or other
  misc_feature (1124)..(1124): n is a, c, t, g, unknown, or other
  misc_feature (1266)..(1266): n is a, c, t, g, unknown, or other
  misc_feature (1274)..(1274): n is a, c, t, g, unknown, or other
nnnnnnnnnnnntttccccctttgcttaacccctgtaccctattgtttggtcttgtgttttatggaaaaannngnnggctgggactccccgcggtggcggccgctctagaactagtggatcccccgggctgcaggaattcgtctcacccctagaaaaaacactcttctcttctccccggccgggccggaatctggccgccgaaccaagaatagcaagcggctctggaagttgggatccatggggtccaactcgtgcttcctccaccagtccaccctccgcgttggtcgataacgtctccgtgccttgagtggagcggctgggcaggggggttcttgttcctctgtaatggccataaagtagaaggacggccctataagaaatttgacctagttgggaattgaacggtcttgtgatggttggcccggggttcttgggtggtcgcgtccaagcactatccaccaccgcacgacgcgggtagggtgtaaggtaatggggacgccctccccgggcaggggcccaaggagatagagcaggacttttctttgggactgccgtgcacatataacgcccccgtccaaaggtgtctgcattcccccgcgtcgtatgtcgggaatttccctcccttccaggggcgcgcggtagaattgatccgcccggcgtcgaagggtcggtctcccgccttggcgatggagggcatatatctctttcggtggccggcgtccataccagataattggtggtggcgcctcttcgttatgtgggtgttcacacgactcccagcaccgtcgcgnctaatatatatggtaagcggcggtcttcttcatctgtacgttgtcgacaggctgacctccaccgcccctgcactggactatantcgcttacctgcgcattgtcagtcaggcgggcgcatatgcgtttcgccctcggtacgagcagagtcactacgggccgcggtgccggtgctggtcgagcgtcnggtgcgtgtgaaatcgtgggtatcgctcctacgtctaggcgtcactctgacacggcgcttgatgtgcctgtagttaccgtcctcgcgtttgataatgtaccgggggtgacagaaggagtctctcccgagtgcgtgttatatgcttcnactaacacgtcgcggcggtcggtgtctcacactcggtggtacctcttgtagcgcaccctggctgcgactcatcgctacgtcaacttcgatcaactacagagcggaggtgagggcgatccggcaggcgcatcacactccgtcnccagtagncgccgccacttgagcacggaccgggct

SEQ ID NO: 95877 - DNA, 1263 bp, Zea mays
  misc_feature: Ceres CLONE 1586281
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (67)..(67): n is a, c, t, g, unknown, or other
  misc_feature (71)..(71): n is a, c, t, g, unknown, or other
  misc_feature (72)..(72): n is a, c, t, g, unknown, or other
  misc_feature (79)..(79): n is a, c, t, g, unknown, or other
  misc_feature (81)..(81): n is a, c, t, g, unknown, or other
  misc_feature (846)..(846): n is a, c, t, g, unknown, or other
  misc_feature (877)..(877): n is a, c, t, g, unknown, or other
  misc_feature (964)..(964): n is a, c, t, g, unknown, or other
  misc_feature (977)..(977): n is a, c, t, g, unknown, or other
  misc_feature (998)..(998): n is a, c, t, g, unknown, or other
  misc_feature (1131)..(1131): n is a, c, t, g, unknown, or other
nnnnnnnnnnnnnnnnccccccccaaacaaacccaatacaaaaaagaaacaaataaaaaactatatntttnnggctgtnanggcaaagtggtgctccccgcggtggcggccgctctagaactagtggatcccccgggctgcaggaattcgtctcacccctagaaaaaaacaaaaaaaatctcagaacacacacacacacacacacctctatcgccccgacctcgacgcgacccctctcgcttggatccggacggcccggtccctccgccctcccatgcgcacggcgccgccgccgccgacatgacactcgactccctcgcccgcgccctcggccggtccgagcgctccttccgcccgcgccaggagagtatgccttctaaagttataatacccttgtccgggccccctatgctcctctgggaggtctgacatggcggctgctccttctaaggtttccaacttcggggggttttcttgtagtagtgtggccccccccccctacccaccggcctagtccctcctttcggtgtagaggtggagagcggggcagagatttttttttccgcagagttaacagttgaactggctggtgtattctacatagaagagaatatctccaaggaaggaagaattcacagcacgagccaacgaaaccgcaagccgacattgctaaaaaaaaacaggtgcccatccaggcaaagggtcggcaacagagtatggcacccgaaagacaagcccctcctatatcattacggagaataggggacggcgtcctcctcattggaaatcgactcatcctactcttcgcagaagtctaaaaacacgtaacccgtgcaacgcactccngctagagagacggcgttcacaagaccttacnacgcgaagctactacacgccacacaatacaaaggcggcgcttgaacgtgccatccatctaagcaatgacaagacacgttcctccacntcaaaccgctgcnatccgcgtccgtgcgcgaagntctagtcttacgcttcacgctctacatctctaaaaacacatactcggaacatatttctcttgtcagtacgcgagataaaagacagcggtcagatgaaaagaatcgccacattggccagaaaaacgactttccncctcatattacctcctcgtgtttgtatagatataaatccacaatcgcggcgtcaatcgactgtatcctaactccctcaccatgtacgcggaacccgcaggaaataagaccaaacatacactcaaaaaaagat

SEQ ID NO: 95878 - DNA, 816 bp, Zea mays
  misc_feature: Ceres CLONE 1586284
  misc_feature: Translation starting site: 308
  misc_feature (285)..(285): n is a, c, t, g, unknown, or other
  misc_feature (557)..(557): n is a, c, t, g, unknown, or other
  misc_feature (598)..(598): n is a, c, t, g, unknown, or other
gctcaccgcggtggcggccgctctagaactagtggatcccccgggctgcaggaattcgtctcacccctagaaaaagtcttcccccacttggaagttggaggaatcctttactcctccccacctaaaacaaaacaccgggataggtcggacaccattattgcgagtgcagcgagcttccccttccctgactcccacgggccacggtcctgctgctcgcctgctcctcccaagaaatgcctgcctggtgcggttcctgagggagacgatctccccatgatgcagggngaggaggaagaacacacgggagatggctcgggagcatccgcaaccgccgccggtggcagcggcggcggcgtcggcggccagctccaaaggccaagcatggttctgcaccacaggattgcccagcgatgtagtgatcgaggtgggagacatgacctttcatctccacaagttcccgttaatgtcgaggagcaagaagcttcacgacctcattacgaacaaggagtcgcgcgaggccagccggagaggcagaggagcagagcaagaagaggatnatgggggagatcagagaggaagaagcggaccttgtgctgangaaagaccaaggaaggcggacgtgcaccgcatccgccctcctggagttccccgggcggcgcgaaggcgttcgagctggccgcccaagtctgctacggcgtgaagctcgacctcacgccgggcacgggcgcgccgctgcgctgcgccgccgagcgcctcggcatgtctgacgaccactcggacgacaacctcgtctccggcgccgaccggttcatatcg

SEQ ID NO: 95879 - DNA, 844 bp, Zea mays
  misc_feature: Ceres CLONE 1586288
  misc_feature: Encodes the peptide sequence at SEQ ID NO. 95880
ctggagctccccgcggtggcggccgctctagaactagtggatcccccgggctgcaggaattcgtctcacccctagaaaaagtcccatcgttcctctctctctgccccgcctacgcctcgccccagacgcatcaaaccgctctcctctccctccctgccccctcgcaaccccgaagaagccccccacacgcaaggccgcaaacgcgccgcgcaccggaaggccccagggagcgacacgaggcggcctcattgcggcatggctgctatggccgccgctggcggcgtcgggctccatctcattggcgctgccacggccacgctcatcgcggcggtccttgttgcggccgtgctggggcgccgccgccgggcccgggcccaggcgcctccggtggaagggaaacccgcgccggatgcaggctgcgcggtcggtgacggcgcgggtcccgacggcgggacggacgtcatcatcgtcggcgccggagtggctggatctgcgctggcgtacacgctcggaaaggatggccgccgggtgcatgtcatccagagggatctgacagaacctgacagaattgtgggcgagctgttgcaacctggaagtcacttgagattaagtgagttaggcctgccagatcgtgtgcaagagattgatgcccaacgcgtgcttggttacacattattcaaagatggaagaaacacatagcttgcttagtccttacagcagtgccattctgatgtcgctggtacgagcattcacactgggaagtttatacagatgatgcgtcagatagctgcgtccttgcccatgctcaatgagtacagggactgctacacagctcatgaaaaaa

SEQ ID NO: 95880 - protein, 147 aa, Zea mays
  misc_feature: Ceres CLONE 1586288
  misc_feature: SWISSPROT Homolog: EC 1.14.99.7 Squalene monooxygenase
MAAMAAAGGVGLHLIGAATATLIAAVLVAAVLGRRRRARAQAPPVEGKPAPDAGCAVGDGAGPDGGTDVIIVGAGVAGSALAYTLGKDGRRVHVIQRDLTEPDRIVGELLQPGSHLRLSELGLPDRVQEIDAQRVLGYTLFKDGRNT

SEQ ID NO: 95881 - DNA, 869 bp, Zea mays
  misc_feature: Ceres CLONE 1586289
  misc_feature: Encodes the peptide sequence at SEQ ID NO. 95882
ctggagctccccgcggtggcggccgctctagaactagtggatcccccgggctgcaggaattcgtctcacccctagaaaaagctcactctcgctcccaactgccaccctgtttcccttctcccctgccccgccgttcccactccgcacccgcgcgccgcggcagcttagcttgccgcgagccctgccctgccctgccctgccctaccacccggcgccatcctgacctgtgtgtgctacggcgaggcagcaggagctcgcgctcagctcggtaggttgatgagctagcgacgacggccagtccgcccgaggcagcgtcgcgtaggggcggacgaggcgtctcaacggcaatgagggtgtacatcacggcgacggcgacggcgggcgaaggcgacgcgacgaagcccaaggcgccgccgccgcatcagcagcagcagcagcaggcgcggcgcgggtgccgctcggccgccgccacggggctcctcgccggtctgctcctcttcggcgccgcgctgctcgccatcgaggccggcgcctccctctgcccttcacgggcggcaggttgcctggactggcgagcggggctggggcgatggctctacggcgacggcggcgactcgacggaggattttatggagggattggaggcttcccaccagggaagccaccctgctggacccttgtgtgggtggaaaccgcccccggactccttggaaccgctcttgggcggaaaaggcccccatgctggggcttcctaccacccgggttgaccttgaaaaccctgggccaaaaaaaaaaaatggccatgctttttccaaaaatgggaccggaaaggtaaaatttcttccccggaaccccgggcgccctgttta

SEQ ID NO: 95882 - protein, 139 aa, Zea mays
  misc_feature: Ceres CLONE 1586289
MRVYITATATAGEGDATKPKAPPPHQQQQQQARRGCRSAAATGLLAGLLLFGAALLAIEAGASLCPSRAAGCLDWRAGLGRWLYGDGGDSTEDFMEGLEASHQGSHPAGPLCGWKPPPDSLEPLLGGKGPHAGASYHPG

SEQ ID NO: 95883 - DNA, 801 bp, Zea mays
  misc_feature: Ceres CLONE 1586291
  misc_feature: Translation starting site: 314
ggagctccccgcggtggcggccgctctagaactagtggatcccccgggctgcaggaattcgtctcacccctagaaaacccccgcctcgccctccgtcgtctcagcgtatgttgtgcatgtgaagagagagaggaagagggtgacgagcgagaaaaaagctaatagagtgataggttgacaagacgcattgaagctaaggccacgctataccaaagcaacctcaccatcgctcgcaagctactcgatcaaggacattattgtcgcaacgagctagctaggatccgcgcgttagtttcgcgaagcggtggtacatatggctcgcatcctcgtgctggctctggtcaccatcgcgagcctcctcctgccgccggtcgtcgcgagccagcaagcggcggccaagtgcgagtacagatagcactccggccaccggtacaagcacccggtgggcgtgcggaagatcgtggtggacgcgggcggcgccggcgatttcgtctccatccagcgcgccgtcgactccgtgccggagggcacaccgtgcgcgtcgtcgtgcagatcaacggcggccgtacatagagaaaggggtagtgccggcgtctaagccgtacgtcacgtttcaaggcgccgggcgcgacgtgaccggtggtggaatgggacgacgggccagcgaccggggcccccaagggcagccgctccgaccttcaaaacgcctcaataacatcccaactactatttcaacgctaaacatcaccttcaggggagcaacctttgcccaccgaacacccaattctttgccaaaaaaca

SEQ ID NO: 95884 - DNA, 886 bp, Zea mays
  misc_feature: Ceres CLONE 1586294
  misc_feature: Translation starting site: 145
  misc_feature: SWISSPROT Homolog: EC 2.4.1.13 Sucrose synthase
ggagctccccgcggtggcggccgctctagaactagtggatcccccgggctgcaggaattcgtctcacccctagaaaaactccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcaggccaaggcctggtgtctgggattacattcgggtgaatgtaagtgagctggctgtggaggagctgagtgtttctgagtacttggcattcaaggaacagctggtggatgggacatccaacagcaacttttgtgcttgagcttgattttgagcccttcaatgcctcctttcctcgtccttccagtgtcaaagtcatcggaaaatggagtgcaattcctttaaccgaacactggtgttccagttgtttccaggaaaaggaaagtttgtaacccctttggtggaacttcctcaagggcttataactatcagggggccaacgaataatttttaaatgaccaaaatccccaaaccctttcgtgggtctccaaaccttcccgtgaaaaagggccaaaggaatattcttccttgggtggttccctccaagaaaccttccctacctgggagagtttaacccacagggtttccacaaaagcttggtgtttggggag

SEQ ID NO: 95885 - DNA, 886 bp, Zea mays
  misc_feature: Ceres CLONE 1586295
  misc_feature: Encodes the peptide sequence at SEQ ID NO. 95886
ggagctccccgcggtggcggccgctctagaactagtggatcccccgggctgcaggaattcgtctcacccctagaaaaaagaactcagactcgagcgctccaaagcgagccaccgccgatctgctcctccctcttgaccctcctccgtgcgctgcgcaggcatgaggcgcctcctcggcggcgccctcgtcctttgtatcgccgcggtggtggagtccaagccgcctctcgactctctgggcataccaccgcaagatgaggcgtactacataggcggcgtgatcaaatgcagggacggatcgggcaggttttccagggaccagctcaacgacgacttctgcgactgcccccgacggacccaccagcccgggagatcggcttgcccctgagcgaaattctactgcaagaatgcagggcacactccagtcacgatcttctcgtcacgagtgaatgacggcatttgtgatttgctgtgatggggagtgatgaattttgacagccatggtaccctggaaaaaaaccttgctggggaggctgggaaaggggggcaaggggagaaaatttgaaaaaaaaaaaattggttccttaccaaaaaagggggggggtgtttttcggaaaaaccggaagggttgaaagggggaaaaaaaggggttttttcttaaaaaattagacccaaatttttggcacaatttgtaggggggaaaaagaaaaagccttcccggggccttttttgttaaactcccaagagggaaaaagaaatttttttgggaagcgcggggggggaaaaaaggctttttttaaaaagaggagggggggataaagaggaaccctaggcagtgggtggaatacccgccgcgtttgtgtaaaagaggggacctttttatccg

SEQ ID NO: 95886 - protein, 75 aa, Zea mays
  misc_feature: Ceres CLONE 1586295
MRRLLGGALVLCIAAVVESKPPLDSLGIPPQDEAYYIGGVIKCRDGSGRFSRDQLNDDFCDCPRRTHQPGRSACP

SEQ ID NO: 95887 - DNA, 858 bp, Zea mays
  misc_feature: Ceres CLONE 1586296
  misc_feature: Encodes the peptide sequence at SEQ ID NO. 95888
  misc_feature (858)..(858): n is a, c, t, g, unknown, or other
ctccccgcggtggcggccgctctagaactagtggatcccccgggctgcaggaattcgtctcacccctagaaaaagcgcaatcaaactgcggtggccaaccccggaagcggcggcgggcaaagcgcgcgacgcagagaagcgtaacttcaggccgccggtcgctctacgcatcctgctccgcgttctcgacggagatccaccggggacagcctttctttccccttcctcaatcaaggagatccaatttcgcgcgcgggtcgagctcgccttctcctccagtctccacctccaccagcgctcgaggtcgacggacgctactcgcagcagttcttctttgcggtgcggccgagaagaagctaaggctcaggcatgagcttccgggaccaggagagtggctgggaggatgggggcaggacgtcctccgcctccgacctgcagaagacgctcatcaacaccggggagctggtaccgtatgcctcccgcgggtggcgtgatgggctcgcggtcatccagcctcatggacggctgggctgctctgcgttctctctccgcgacgtcgctatctcgggccaacctctgcaccctttttgaccacgccagggtccccatcccagttcagttttcaaatgcggctactccctccgcccgggcagggacgccatccttgatgatggtcgggctttccccccttttaaggtccccccccttccgggcaattttcccaatttaaggggcgatgggtggggccgcctccctccaggggggccaaactttcttaataatttcgggcccaacaaagggggccctctcttgcactcgtttgaatattcaaaaacaataattggggggggccctccn

SEQ ID NO: 95888 - protein, 73 aa, Zea mays
  misc_feature: Ceres CLONE 1586296
MSFRDQESGWEDGGRTSSASDLQKTLINTGELVPYASRGWRDGLAVIQPHGRLGCSAFSLRDVAISGQPLHPF

SEQ ID NO: 95889 - DNA, 822 bp, Zea mays
  misc_feature: Ceres CLONE 1586302
  misc_feature: Encodes the peptide sequence at SEQ ID NO. 95890
  misc_feature (676)..(676): n is a, c, t, g, unknown, or other
  misc_feature (752)..(752): n is a, c, t, g, unknown, or other
  misc_feature (774)..(774): n is a, c, t, g, unknown, or other
ctccccgcggtggcggccgctctagaactagtggatcccccgggctgcaggaattcgtctcacccctagaaaaaccccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaacccacctctgtggtccttgctcaggggctgatcgctgaggggtgttaggttgtggcagctggtgctaatcctggtcagattactcgtggtatcgagaaacagcgaatgcactagttgaagaactacngaagttgtctaaggaggtcgagatagtgagcttgcagaatgtgctgctgttagtgcgggcatcactacgaattggntatatgatagcagaggcatgancaagtccgtcggaaaggggtggtaccctccaagaaaggagagtctgaa

SEQ ID NO: 95890 - protein, 135 aa, Zea mays
  misc_feature: Ceres CLONE 1586302
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTHLCGPCSGADR

SEQ ID NO: 95891 - DNA, 843 bp, Zea mays
  misc_feature: Ceres CLONE 1586305
  misc_feature: Encodes the peptide sequence at SEQ ID NO. 95892
ctccccgcggtggcggccgctctagaactagtggatcccccgggctgcaggaattcgtctcacccctagaaaaagacctgcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacggtgcgtgccacctagcctgctgccgcggcctgtgtgtagatcactgtcagctagctagctgcttttcgtcccgccggtggccgggtgtggttctgacttctgagctgagtcgtcgtcgtgatcgttcgtgcatgcatgtccgcacggattgggggtggcctgacagtctacgtcaacgccaacgggagaaagggcaagggcaagggcgtgtaccaattcgtcgacaagtacggcgcgaacgtcgacggatacagcccaatgtacaacgaggatgactggtctcccaccggcgacgtctacgtcggtggaaccactggggctctgatctgggccgtcaccctcgctgggatcctcggcgggcggcgccctcttcgtctacaacacaggcgccctctccggctaagggatataagtgcatgcgcttcctgcgattcgtcatgaaaaatcagggtgtctgtctattaatctagccctccatggatgctcaacctttcggaaggtaaaaataaaaaggggctacttctggattacaaaaattttggagggcgaaaaa

SEQ ID NO: 95892 - protein, 101 aa, Zea mays
  misc_feature: Ceres CLONE 1586305
  misc_feature (1)..(83): Pfam Name: PsbR Pfam Description: Photosystem II 10 kDa polypeptide PsbR
MSARIGGGLTVYVNANGRKGKGKGVYQFVDKYGANVDGYSPMYNEDDWSPTGDVYVGGTTGALIWAVTLAGILGGRRPLRLQHRRPLRLRDISACASCDSS

SEQ ID NO: 95893 - DNA, 830 bp, Zea mays
  misc_feature: Ceres CLONE 1586306
  misc_feature (249)..(249): n is a, c, t, g, unknown, or other
  misc_feature (251)..(251): n is a, c, t, g, unknown, or other
  misc_feature (252)..(252): n is a, c, t, g, unknown, or other
  misc_feature (416)..(416): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (701)..(701): n is a, c, t, g, unknown, or other
  misc_feature (703)..(703): n is a, c, t, g, unknown, or other
  misc_feature (713)..(713): n is a, c, t, g, unknown, or other
  misc_feature (719)..(719): n is a, c, t, g, unknown, or other
  misc_feature (738)..(738): n is a, c, t, g, unknown, or other
  misc_feature (747)..(747): n is a, c, t, g, unknown, or other
  misc_feature (751)..(751): n is a, c, t, g, unknown, or other
  misc_feature (752)..(752): n is a, c, t, g, unknown, or other
  misc_feature (777)..(777): n is a, c, t, g, unknown, or other
  misc_feature (781)..(781): n is a, c, t, g, unknown, or other
  misc_feature (790)..(790): n is a, c, t, g, unknown, or other
  misc_feature (806)..(806): n is a, c, t, g, unknown, or other
  misc_feature (809)..(809): n is a, c, t, g, unknown, or other
  misc_feature (812)..(812): n is a, c, t, g, unknown, or other
  misc_feature (815)..(815): n is a, c, t, g, unknown, or other
  misc_feature (825)..(825): n is a, c, t, g, unknown, or other
ctccccgcggtggcggccgctctagaactagtggatcccccgggctgcaggaattcgtctcacccctagaaaaagacgtcctccgctcggtcttttctggattctagctaacctggatgctaccgactgtgtgtattgtttttgaaagactcgaggaaaattccttgatttccctctttatcttctgcatcccactcccatttactgttctttgttccgttttctaatgagtcactgccgtctttcctntnnatctgctgcattccccaatcccattttaaattttatcgtcaacaatttcgtcttctcggtttctgacttatttcgggggcatttttttttttctttgtttcgagccctgtgagtcttgattcccaattttgaaacccccttgggcgggccggccgggcgggccngccgggttcattgaaacccgaaaggggatcccccgaacaaaggcgcggaaattccccccccttggtgttttttnnnnnnccccccccccccccccccccccccccnnnncccccaaaaaaagggagaaaaaaaagggcggcgcccccccccccctttttttttattccccccccccccccccaaaaaaaaagaggggggggtgttttttcttccccccccccccccggggggggggggggggaaacaaccccccccctctttggcgtcggttctaatatatattncncccccccccnacaccncgacgcgggggtggtgggnggtggaggngagnnggagtgttttctcctcttccccgcncggngccggccgncgccacgacactcacnctncgntgnccgaccgcgncggct

SEQ ID NO: 95894 - DNA, 850 bp, Zea mays
  misc_feature: Ceres CLONE 1586312
  misc_feature: Encodes the peptide sequence at SEQ ID NO. 95895
  misc_feature (392)..(392): n is a, c, t, g, unknown, or other
ccgcggtggcggccgctctagaactagtggatcccccgggctgctggaattcgtctcacccctagaaaaaacgccgtgactccgccgcaaagagagggagagtccacgctctgaagaagcaacggcgacgtccccgacgacgagcacagctgcacagcaaactagcagcgccctcgtcagttccgtctcgttcccaaccactcctggattcgattcgattgacccgtccgctccaaatcgaatctaatcagcagttttggagttgcggaagggagaaagagagaggagaggggcatggatcaggtgctcaacaaggtggggagctactggttcagcaaaagggccagcaaggaaatcgactccatcggcgacgacatcagctcgatctcaancagcattggagggtcagccaaatggatggtgaacaaaattaaagggaagatgcagaaagcactgccagatctcctcaaggaatatgacatgccagcagggctcttcccacgggacacgactaactatgagttcaatgaagagacaaagaagctgacagtggacatcccggcagcctgtgatgttggttacaaggactccgcagtgctgccggtcttcacctgtgtgaccggctacctttggaaaggggaagttttcccacatccgagggctggagaccaaaagggctgggtctggaccaaggtgactgccattcaggaccgaagggcccaaagggccattttcccgggaggggggggaaaaaaactctcgatacctgggtggccttttgaagggcggccatcatgatggtctccaccctaagacaaaggttctcaaaacaaatatacccggggcagag

SEQ ID NO: 95895 - protein, 167 aa, Zea mays
  misc_feature: Ceres CLONE 1586312
  misc_feature (32)..(164): Pfam Name: DUF538 Pfam Description: Protein of unknown function, DUF538
  misc_feature (33)..(33): Xaa is any aa, unknown, or other
MDQVLNKVGSYWFSKRASKEIDSIGDDISSISXSIGGSAKWMVNKIKGKMQKALPDLLKEYDMPAGLFPRDTTNYEFNEETKKLTVDIPAACDVGYKDSAVLPVFTCVTGYLWKGEVFPHPRAGDQKGWVWTKVTAIQDRRAQRAIFPGGGGKKLSIPGWPFEGRPS

SEQ ID NO: 95896 - DNA, 1142 bp, Zea mays
  misc_feature: Ceres CLONE 1586313
  misc_feature: Encodes the peptide sequence at SEQ ID NO. 95897
  misc_feature (13)..(13): n is a, c, t, g, unknown, or other
  misc_feature (14)..(14): n is a, c, t, g, unknown, or other
  misc_feature (37)..(37): n is a, c, t, g, unknown, or other
  misc_feature (174)..(174): n is a, c, t, g, unknown, or other
ataaggtaaaatnntaaataacacttgtttttttacnaacttaccactctataaacacgagtggggggtaaagttgagctccccgcggtggcggccgctctagaatagtggtcccccgggctgcaggattcgtctcaccccctagaaaaaggccagtgtcctccgcatctcccngtctctcctgttccgcctcccctccgatctccgccgcatcacctccctcgaaccctagacccacccgcgccccccattgcctccggccgccatgtctgccactcagcttctccgtcgctcccgcaagctgcagagtttgcaaaatgctgtaggttgtgagaatttttttcggcatttctccagtggttccggatcctttatcgccaaggaaatggggtttgaaaaagaccagaggtaccagattttcccagcataccagcctacaaaagagcttgaaaccatttccccttgggaagtaaatggaaacttgcactttggaaaaaaaacattccaaaaaggccttaccccccaaggggcccgccaaaattgggccccaaaggggttcaattttccccctggtggggaacaggggggagtttttttccccccccgggggaacattttttttccaagagatatttggggggaaaaaaccttgtggcctctctcccaccttttttaaaagaaaaaaatatttgggggagaaagcccccgcccttgtcacccacctctttttttgcgcccccgtcttatacccatcatattgcaaattttgttgtgacgggggggaagaaaaaaaaatatatttggggcgcgcccgagacgggggtggggcgtttttctgtccacctgcgggggcggaggcggtgcgggattattggtggggggtttttccccgcccccccctctacgggagaagagaagagattccctctctttgcgttggagggcggggggggaaaatacctttcgttcataagtagacaccctcctctttctttgaagataaaatgaagggcgccccccacctgcaagaaaaaaaggggggcctctctctctggggggaaaaaaatattgtttccgtgggggagaaaatggtgctctcgcggaaaaatttaatataatctggtggggggggtgctgttttc

SEQ ID NO: 95897 - protein, 136 aa, Zea mays
  misc_feature: Ceres CLONE 1586313
MSATQLLRRSRKLQSLQNAVGCENFFRHFSSGSGSFIAKEMGFEKDQRYQIFPAYQPTKELETISPWEVNGNLHFGKKTFQKGLTPQGARQNWAPKGFNFPPGGEQGGVFFPPRGNIFFPRDIWGEKTLWPLSHLF

SEQ ID NO: 95898 - DNA, 822 bp, Zea mays
  misc_feature: Ceres CLONE 1586316
  misc_feature: SWISSPROT Homolog: EC 3.4.21.92 Endopeptidase Clp
aagctggagctccccgcggtggcggccgctctagaactagtggatcccccgggctgcaggaattcgtctcacccctagaaaaaaagaaaaaaaaaatgaagataataaactgcggattctttctttctcttccattcttacgtttccatattaaagtgtagtttttttacttaaatttaataatattaatctaatatgcccattggtgttccaaaagtaccttaccggattcccggagatgaagaagcgacttgggttgacttatacaatgttatgtatcgagaaaggacactttttttaggtcaagagattcgttgcgagatcacaaatcatattacaggtctgatggtatatctcagtatagaagatggaaatagcgatatttttttgtttataaactcccctggcgggtggctaatctcaggaatggcgatttttgatacgatgcaaacggtgacacctgatatatatacaatatgcctcggaatagccgcgtccatggcctccttcattctgcttggaggagaacccaccaagcgtatagcattccctcacgctaggattatgcttcaccaacctgctagtgcttattatcgggcaaggacaccagaatttttactaaaagtggaagagttacacaaagttcgcgaaatgatcacaaggggtttatgcactaagaacaagcaagcctttttggggttgtatcggaagacatgggaaagggatgtttttatgtcagcagacgaagccaaagcttatggacttgtcgatattgttaggggatgaaatgattgacgagcactgcgatactggatccagtgt

SEQ ID NO: 95899 - DNA, 853 bp, Zea mays
  misc_feature: Ceres CLONE 1586317
  misc_feature: Encodes the peptide sequence at SEQ ID NO. 95900
  misc_feature (785)..(785): n is a, c, t, g, unknown, or other
ctccccgcggtggcggccgctctagaactagtggatcccccgggctgcaggaattcgtctcacccctagaaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctggtccaggtgatcctgcagcgacggcccttcatgtacgtggtgcgcgacctccgggagaagtacggggccatcttcaccatgcggatggtgcagcgcaccctcatcgtggtcacctccggcgagctcatccaccaggcgctgggggaacagggccccttgttcccgatccgggcccgaagaaagcccccacccgccttccttttcatcgttcggaaagtggaaccgtcaacctcgggggcccttacggccccccttgggggggtggttctgcgcccaatactttcttcgcccaaagatcgtggtcccccccaacctcggtcaaagggctttccccggggattccggggaatgggggccggggaaccccccctttgggggccgccttctggaaaccaaagttcaggggcggaaaggtgcccctggccggggtcttgggcccaattggccnaccccacccattctggaaggagttccccaatcttgaaattttggttttggggcccaaaaaatccccgc

SEQ ID NO: 95900 - protein, 217 aa, Zea mays
  misc_feature: Ceres CLONE 1586317
  misc_feature (195)..(195): Xaa is any aa, unknown, or other
MDVNDVLLVVLAAALAAMWWRRCSKTGGVDGLPPGPPGWPVVGNLVQVILQRRPFMYVVRDLREKYGAIFTMRMVQRTLIVVTSGELIHQALGEQGPLFPIRARRKPPPAFLFIVRKVEPSTSGALTAPLGGVVLRPILSSPKDRGPPQPRSKGFPRGFRGMGAGEPPLWGPPSGNQSSGAERCPWPGSWAQLAXPTHSGRSSPILKFWFWGPKNPR

SEQ ID NO: 95901 - DNA, 876 bp, Zea mays
  misc_feature: Ceres CLONE 1586319
  misc_feature: Encodes the peptide sequence at SEQ ID NO. 95902
  misc_feature (564)..(564): n is a, c, t, g, unknown, or other
tggagctccccgcggtggcggccgctctagaactagtggatcccccgggctgcaggaattcgtctcacccctagaaaaaaattcaatttcaaaccgcaatctcccctgccttgccttccttccccttcacagcttcatccaccgctcctccaatctccatcgccatcgccaaccctgagctgaaagcaaggccaacaagcatcatagcagtctcgctctcgcaccacgcgagtgagacaccaggcaaccaccacgagacagggacaccgacgggcgccatcctcatccaccaccaccctcccagcttccgttggcttcactcccactgcaggccccacttcactcgctcgcgccacagatctcgcctgccggaaccctaatgccgcaggtggacgcgccgggggagtaacgccgatgcagcgccgggtgggcatggcggacggcgaggccagggggcggacgctcggcgccgtcatcaaggagaaggatgaggagctcgcgctcttcctcgagatgcgccgacgcgagaaggaagcgcgtgctgcggcggcggcggcggcggcngaccatctcctgctctcttgcgactccgtggcgggggacgggatgctgctttttcggccgccgccacccggcgaggccaaaaccggtggcgtacaaagaggctgggtggcggattttaggagggccccctgccgaaacgaacaattttctccaatgcaaaacctggcaaaaaaaaccaataaccaactgggttcctgaaccccacccggaaacctccctaattcccccttctttaaaaatttaaagtccaaaaaggttccccggggggagcccaacgttggaaaccaccaaaaagaatctcttccaaattta

SEQ ID NO: 95902 - protein, 115 aa, Zea mays
  misc_feature: Ceres CLONE 1586319
MQRRVGMADGEARGRTLGAVIKEKDEELALFLEMRRREKEARAAAAAAAADHLLLSCDSVAGDGMLLFRPPPPGEAKTGGVQRGWVADFRRAPCRNEQFSPMQNLAKKTNNQLGS

SEQ ID NO: 95903 - DNA, 886 bp, Zea mays
  misc_feature: Ceres CLONE 1586320
  misc_feature: Encodes the peptide sequence at SEQ ID NO. 95904
tccccgcggtggcggccgctctagaactagtggatcccccgggctgcaggaattcgtctcacccctagaaaaagtccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttgttgagtgatggtggtgtccacttccgccttgaccaactacagttacttctgaaaagtgtcagtgagagaggaccaaaaaaattcgtgggcacatccctacccaggggcgtgaccttttggaagggaaacagtggttggtttccgtggaaaccctaaaaaaatgatctttttggaagcttcgagggcaaggggtatttgatgccccagattggcattctgggggggtgggaaagggaagttttgttttacccctgggaacccgtttattgaggaaattgaaccttggggaaatgtggggttaaaaaacgagtggcgtggtggaaagatcctccaacggggggg

SEQ ID NO: 95904 - protein, 181 aa, Zea mays
  misc_feature: Ceres CLONE 1586320
  misc_feature (15)..(178): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHFRLDQLQLLLKSVSERGPKKFVGTSLPRGVTFWKGNSGWFPWKP

SEQ ID NO: 95905 - DNA, 1192 bp, Zea mays
  misc_feature: Ceres CLONE 1586323
  misc_feature: Encodes the peptide sequence at SEQ ID NO. 95906
  misc_feature (17)..(17): n is a, c, t, g, unknown, or other
  misc_feature (907)..(907): n is a, c, t, g, unknown, or other
gggtggggtggccctcncctccactttgtgtggattggggaggagctaccgcgtactttttggggctgcggttttaatagtggagctccccgcggtggcggccgctctagaactagtggatcccccgggctgcaggaattcgtctcacccctagaaaaagagaactcgttcactcgctacatttccctccgcttgccgagtgctgcgcgggagcacgcgcccatggtgacgccgccgccggctgcgacggagtccgctcttcccaagtctggggcggtatccaatggctaccactttgcatccccttggcaacagagcgcgccgctcacggagcaccagaaggacactatagccggactctcccacgcatgtggcggatcgggcattcccacccaaactggaaaaaagttcagggaaagatgaaggcttgactgttcccgaaaaaaaatctgcattggaggaggtcgggtcaattgatgcccccttgatgaaatacacactcggttcttataagtggtttcccagaaaatgggaatccagcttacaaaattttgaaaacttgaggaaaaaaattcccactttttattaaaaataacgtttacagggaggccccgtccctcacacgtggtatacggttactcccctttaaaggcaacggtttgaagtgtattacattttgaagtcttttgtatggggaagagaaagttggggagtatccctttggagcactttacaaaggcgctttggctcttcacctggagggccaccaaaaaaaaagcctcttttggccacatgtgaataggcgccttgggccaaaaccaccaaaggcttattgttgggagtttgggaagaaaaatacacaaaagagtcgccgtgatgctcaaaaaacttgtgtgctacagaaaanagccaccttgtcccaaaaaaacaaaaggactcggccattttttacctgttgtggatatgaaaactttaacacaacaatatgtttagttttagaggcccaccccgtttttctttccctcccccctctaaacatctgtgaaacaccctccgggagaagaatgaggaaaatcgaggtgtttttttatcgctacgtgtagttgaacaaaccgcgccctcaaaaacctgtaatgtgtggtagcctcgcagaaatgtgttttggtaaaatacaacacacccgccgactttt

SEQ ID NO: 95906 - protein, 66 aa, Zea mays
  misc_feature: Ceres CLONE 1586323
MVTPPPAATESALPKSGAVSNGYHFASPWQQSAPLTEHQKDTIAGLSHACGGSGIPTQTGKKFRER

SEQ ID NO: 95907 - DNA, 841 bp, Zea mays
  misc_feature: Ceres CLONE 1586324
  misc_feature: Encodes the peptide sequence at SEQ ID NO. 95908
ggagctccccgcggtggcggccgctctagaactagtggatcccccgggctgcaggaattcgtctcacccctagaaaaactcttctcttctcgtctcccctccgccgcttccgttgctcgcagtgctgcctcccctcctctcttcactcgtcaggcccttccgccgtcccggaggctcgaacccctcggcccgcggacgggaccctaaacccgccccaccactcgcgcggggttcgcccgcgacgcatgcgcggcggcggctggtaccctcggcagccggcgatcgccggaaatctgcggggacagtgcggcggcttgcacgagtgccggacacggcgggagtggggaacgtaggggagatggcggcgggaggaaagggctgggcggagcgggtacgccgcggggcgaggaccgcttggttcatggtggccatggtggcctcgctgctcgtggcgtcgtcgccggcgctggtggcggcgggcgacatggcagtggcgctctggctcgaggcgcggctcggctgcttccgaggcgacggcctgcggggccacctccagcgctaccgttttcggaactcgcttgccgacatacctctcgtctccgtcgttcgatccatcgtcatcacctgtgtgtacctcatgtctgatacttctggcctctctcatggcccttaccttggaacaacacttttctgttcccttggctcctctgctcatctttgtaattaaaggcatcctggtttatagtcgggcgcaggaacattgggcctggagctctccgccgttctttccaagatcaccaggctcaatctcaagaaatctaggggggaatgctggtacttt

SEQ ID NO: 95908 - protein, 122 aa, Zea mays
  misc_feature: Ceres CLONE 1586324
MAAGGKGWAERVRRGARTAWFMVAMVASLLVASSPALVAAGDMAVALWLEARLGCFRGDGLRGHLQRYRFRNSLADIPLVSVVRSIVITCVYLMSDTSGLSHGPYLGTTLFCSLGSSAHLCN

SEQ ID NO: 95909 - DNA, 851 bp, Zea mays
  misc_feature: Ceres CLONE 1586326
  misc_feature: Encodes the peptide sequence at SEQ ID NO. 95910
  misc_feature (490)..(490): n is a, c, t, g, unknown, or other
  misc_feature (607)..(607): n is a, c, t, g, unknown, or other
ggagctccccgcggtggcggccgctctagaactagtggatcccccgggctgcaggaattcgtctcacccctagaaaaaaagcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatcgccatcggcctcgccgtgcggttcctcgcgccgcggcccgtcgaggttagcccgcaggcgtggcagctcctctccatcttcctctccacaatcgcggggctggtgctnggccctctccctgtcggcgcatggggccttctcgggctcaaagcggcggttgcacttggaagctccctttaacgccgccttttccgccttaacaaagaagggcatcgggctcaaggnaatttccttctttttcccgcggggggtttttaaaaaagggcctcgggaaaaaaaatcccccccaatttttttaaaaggggcctgggaaaaaaaaccccaagagcccttttccaaggggtttaccccccaagaagagggctgttttttggcccggggataatgccccaaaaccacggaaaaaaggccccaaaagagtctttttctccacaccccatataaaaagaggctcctccccctggggggg

SEQ ID NO: 95910 - protein, 153 aa, Zea mays
  misc_feature: Ceres CLONE 1586326
MELHLATIAHRPPLPVPARGHHLRRRLHHLPAPLSFQNTYSPSLSSPHHHRLSPTLRRHLRLPLLASQAPNSNPEPEPEPEPTGAKLLPLVISIAIGLAVRFLAPRPVEVSPQAWQLLSIFLSTIAGLVLGPLPVGAWGLLGLKAAVALGSSL

SEQ ID NO: 95911 - DNA, 876 bp, Zea mays
  misc_feature: Ceres CLONE 1586329
  misc_feature: Encodes the peptide sequence at SEQ ID NO. 95912
gagctccccgcggtggcggccgctctagaactagtggatcccccgggctgcaggaattcgtctcacccctagaaaaaaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcgccatgctctccgggggccacagccatggaatcgcccgcctcgtcacaaggtcgccggcggcatccacgcccacgctcgaagacttcttcgccttcctcttctcccccgacctcaacccacccatcgcgcaccaggttcaccaggacatgtcagcgccgttctctcactatttcgtgttccccgggcataattcctacctcactgggaaccagctcaatagtgactccagtgaactcccaattgtaaaggcgttgcagaaaggggttagagccattggaactcgatatggggccccaatcccttcaaggaaaatgggcaaatattcttcaagggagggaacattgaccggcccccagggaaaaaggaaccaaatggtttgaagtcccactaaaaaaataccccctttcggggcccctcaaaataatccctcctgggtaaataacccctgggagggataccccctcccacatccaaaatttccccgaggccttaaaagtg

SEQ ID NO: 95912 - protein, 186 aa, Zea mays
  misc_feature: Ceres CLONE 1586329
  misc_feature: SWISSPROT Homolog: EC 3.1.4.11 Phosphoinositide phospholipase C
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFPGHNSYLTGNQLNSDSSELPIVKALQKGVRAIGTRYGAPIPSRKMGKYSSREGTLTGPQGKRNQMV

SEQ ID NO: 95913 - DNA, 848 bp, Zea mays
  misc_feature: Ceres CLONE 1586330
  misc_feature: Encodes the peptide sequence at SEQ ID NO. 95914
tggagctccccgcggtggcggccgctctagaactagtggatcccccgggctgcaggaattcgtctcacccctagaaaaaacggataccccattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcgggtgggcgtggcgcccgaggtgggcaggggtcgtcgtcggcgaccacaatgctcagcatgcggcgcagctccctccggcgccccgccgcttgcgcgggggtccctcgcaacgaggggcccgccgtcgtaaccgagaactgtgggtggctcctggcggcgcccgaagacgagcagcttggcggtgaccacccggtgacttgatggcacctctgggcggctcgtccaggaaaaagggacgggggccccttcctgggatccccactgatgggacccgccccctggtcccaaaccatgaagggtacccaagccctggggggggagaaaaccccacacggaatgggtccccccccccaggttacccggcaggttagccc

SEQ ID NO: 95914 - protein, 102 aa, Zea mays
  misc_feature: Ceres CLONE 1586330
MSALLDLLMGIFRQQTLGGAALELAALAAPLWLAALVGLLIGWAWRPRWAGVVVGDHNAQHAAQLPPAPRRLRGGPSQRGARRRNRELWVAPGGARRRAAWR

SEQ ID NO: 95915 - DNA, 1277 bp, Zea mays
  misc_feature: Ceres CLONE 1586331
  misc_feature: Encodes the peptide sequence at SEQ ID NO. 95916
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (58)..(58): n is a, c, t, g, unknown, or other
  misc_feature (69)..(69): n is a, c, t, g, unknown, or other
nttttnntttttttttttttattgactaccaaatccccccgcgcccgcgcccctcttntgggataaaanaaattctggggctccccgcggtggcggccgctctagaatagtggatcccccgggctgcaggaattcgtctcacccctagaaaaattgctcatgtaagtaatcatgagcaatgggcgagataggcacggaccaccgccgcctaaccaaggccgaggccggcctcggtggcaaggatgagggcatccttcctcggctgccacgaggaggaggaggagacttccccgggggaccatgtgcggctgacggtgccctcgacggacgacccgtcgctgccggtggggacgttcccgatgtggagcatccggctcgtggttcatgcgcgttcatctagcttggtcaagcagtgcctcccactaccaaaaacgccccccccccatcatagagcgggggggggggggaaggtagtcttctcatggccaccaagccaatttaatggcccctgccggcctgacgagccccccggatctcgggttcaccctcaactttcatagaacggtctgcgaaggtggaagctcccaaacccgggcgggcgcccttcaacctctaacaggaaggcagaggggtggggacacccggcttgggggccaggccgcccaggacctttccgcggttctaggcgatacggctcgcgcggcgtaataactctcgcaaagcacgctcctgacgggagacgtcccttccgcggggcggagcaataaaataccacgattctaacgaatcgcatccctcatcatttaataaacgcaccgcacggcggggatattttactctcaacggttatctgaatttcgcggccgcgacatatgcgtgttgggatcgcgtccacatctcgacgggtatcgtatgcggccccttcgtggtgcgtgtgtctcttttctcgggcccgcttagtcgtccagtatctacctgcccaggatagcgggtgtagaacgatcacatataaaagcgtcatctaccctccctcgtactaatcctgcgtgatcccgcagaggggtaacgcctcccagtgggatgaccgaggcgggccgtattatgggcccacttaaggaagagagatgagtaagtagtcggtctcggccgagaaagtctcttgtgtgggttttctctgctggagttgattaggttcgccttttcggacgccagcaagagctagttgaggatgtcaaagagagttaaagctaggaataggagaactaacagtctatgtg

SEQ ID NO: 95916 - protein, 105 aa, Zea mays
  misc_feature: Ceres CLONE 1586331
MRASFLGCHEEEEETSPGDHVRLTVPSTDDPSLPVGTFPMWSIRLVVHARSSSLVKQCLPLPKTPPPHHRAGGGGKVVFSWPPSQFNGPCRPDEPPGSRVHPQLS

SEQ ID NO: 95917 - DNA, 875 bp, Zea mays
  misc_feature: Ceres CLONE 1586336
  misc_feature: Encodes the peptide sequence at SEQ ID NO. 95918
ctccccgcggtggcggccgctctagaactagtggatcccccgggctgcaggaattcgtctcacccctagaaaaattgaggatatattttgatccatctttgaaaaagtttgtcttggccaagaactctcctgtttctagaactaacacccctcttcatgaatctcctgatgcacttaaaacaaatgggactgaaatggatcacaaggctgctagaagatttgattcagtttcttctaatgtgggctcactgcagtctaaagtgcagttttgtcctgatggtgatgatgaagaagaaattgttttcaagccaacagcttatgagaagttttcaaaagtttcttcagatctgtcagttaatggatacgtccatcctgtaccagtgtctgctgctcgtgggccaaccaatgctagtttagtgcctgttcagaacactgcatcaatgtctgcaactcgtttaccatccaatccacatggcaactggtttgccatccaaatggtgggtcacttccaaataactgcatctctatcagctgcttggtattacaaacactgatcaatccgcttcccaggtcctcctgtttggttggaactgatttgggctgctcataactgagcaaaaatgttacctcctaagcattgctcccaaaaatttgaaactccatgcagtcctgtttgaagaagcttggtttccagccgggaaaaagcaattggggcccaaccaattgttgggccctccaacacaaggccccacagggtttaaacttttccccagaggttggtccccttaaaccactgtggtatctggcccctcaaggggttcaaagtgttttaagtaggacccccatatttttccaaaattttcccaaaaaaaaaa

SEQ ID NO: 95918 - protein, 183 aa, Zea mays
  misc_feature: Ceres CLONE 1586336
PRGGGRSRTSGSPGLQEFVSPLEKLRIYFDPSLKKFVLAKNSPVSRTNTPLHESPDALKTNGTEMDHKAARRFDSVSSNVGSLQSKVQFCPDGDDEEEIVFKPTAYEKFSKVSSDLSVNGYVHPVPVSAARGPTNASLVPVQNTASMSATRLPSNPHGNWFAIQMVGHFQITASLSAAWYYKH

SEQ ID NO: 95919 - DNA, 819 bp, Zea mays
  misc_feature: Ceres CLONE 1586338
  misc_feature (210)..(210): n is a, c, t, g, unknown, or other
ctggagctccccgcggtggcggccgctctagaactagtggatcccccgggctgcaggaattcgtctcacccctagaaaaactttccacctccccccaccccgctgtgctcatccatcgaccgcgacgagcccccgcccgccgattctactacgtttatttttttatttcatttgatttgattgcaagcaccgcagcaggaggaggagggngaagggagggatctttggaccgtcgttcggctggatggtggaggcggctcgttgatttgagggcaccgggtttcttggacctgcgtaggtaaaaaacaccagccccatttccctctcggccggcggatggacgcgagggaggtgtgaagcctggtcgctaactgatgctcgtggagagattcggaggagaggagcgcgccgtgcggaggcggtggaggaggaagcgccgacgatttggacagcgcagcgacggaaggggagcagcaggcggacgaggagcgagccgccaggaggacgacggccgtcgccgccgccgccgccatgggcgagtcgctgctcaccgcgctctccatggacaccgccacgggccaccacccgcaccaggggcccctccaccttcctctccatggacaccgccctccacgacgacttcggacctcttctccagccacaggggcccttccgccgctgcctacatgccgcggcgggcgccccccctgactcaaacttcccctagccgccgacccgtcttcgccacctctggcgtcgctcgacgccaacgtgacatgctagatgtcgggctcggcgggtcgagcactacgactcgga

SEQ ID NO: 95920 - DNA, 849 bp, Zea mays
  misc_feature: Ceres CLONE 1586339
  misc_feature: Encodes the peptide sequence at SEQ ID NO. 95921
ctggagctccccgcggtggcggccgctctagaactagtggatcccccgggctgcaggaattcgtctcacccctagaaaaaattttggttctagggagcccggacgaaggatcctcatgcggtgaccagagtgaagaaaggggattagaacgcctccatctcaaaacccacgaaagcactaaccctctcttcctaggtacaaccatgctcctccgcgtacttacatccctccgcagcgcggggaggcgcggcgcgatgatacagctgctcttcactctgctagcggcggacggcgccgtgtcggcgatgctactcttcaagacaccgttgcggaggctggccttgctcacactcgactcacctcaagcggggccgcaggtccgtcatggtgcgcactatcgcgggcactgtgcttgtcagtgctcgcatcctctctccacaccatgtccaagatacggtgtcacggcgagggggatctcaactgctcaggggtcgtggggctcacgcccaccgaccagttcctatctgcgcgacacttccgcgaggcgtcactcatgggatactcctcaatccttgctgcaaccattgagccgatgaacaactgggtcaaaaagaatagaacgttcaggaagaaatcgaaaaagggtttaaacagaataaggccctggaataacccaccaattggaaagctcaaatacaacaagccttgaccaaaaagaccattcccatgcccaggataaaacacaatgacatgtgctccaaaaaattacctagggatcacttcccaaaggcctaaaaaaacaatgcccggtccccccatgattccacccttgttgaacaatttacccac

SEQ ID NO: 95921 - protein, 88 aa, Zea mays
  misc_feature: Ceres CLONE 1586339
MSKIRCHGEGDLNCSGVVGLTPTDQFLSARHFREASLMGYSSILAATIEPMNNWVKKNRTFRKKSKKGLNRIRPWNNPPIGKLKYNKP

SEQ ID NO: 95922 - DNA, 934 bp, Zea mays
  misc_feature: Ceres CLONE 1586340
  misc_feature: Encodes the peptide sequence at SEQ ID NO. 95923
  misc_feature (394)..(394): n is a, c, t, g, unknown, or other
ctccccgcggtggcggccgctctagaactagtggatcccccgggctgcaggaattcgtctcacccctagaaaaaaattaggttcccagaaaactctgctcttgtcaggatatcgtctggcggctcgctctccacatccgttgatccatcccttccaactccaatcaactccgtctcaaactacaatccgtgggctcataaacaggcgtagctgttaccagaaacagaagctagattcccggattgctccgcttgatcgatggtgaatcgacccaaccgagtggcccatggccggaaccgagcggctgcaccgcccgattgacccgccgcggcccgcgggaagcctctccctcatgggctgtgctgggtggctcgcctggctagctgggaccacnagtacaacgactgtgagcggggggcgaacctgtccaaaagcttctcgggactccacgtattttgaccaagaggctgacgaactccccaaaccttaaacgacgtgggccaaaaagcctgtgaaaactaaccggcattccccagggggtaaacgggaaggcacccctggaaatcccaccggataacttccgggtaaaattccggaaaacccgggttaaacgccccttggaaaccctgaacttgcatcaattgggtggccgggcaattctggggggtccccctgattttattgttccccgggccttttgaaaaggcgcccgggaccaccccaagggattgggggaacacaaagagatttccggtgtgccaagggggggggtaaattttcccccggaaaaaaaagagtttaaagctgggcgaggctcgggattaaacaccactccggggaggataaacaattggggggaaatttttttggcgtgaaaaaccgccctgtcccccccgaaaagaaataggggggaatcccggcgggcaaaaaagag

SEQ ID NO: 95923 - protein, 67 aa, Zea mays
  misc_feature: Ceres CLONE 1586340
MAGTERLHRPIDPPRPAGSLSLMGCAGWLAWLAGTTSTTTVSGGRTCPKASRDSTYFDQEADELPKP

SEQ ID NO: 95924 - DNA, 1139 bp, Zea mays
  misc_feature: Ceres CLONE 1586344
  misc_feature: Translation starting site: 951
  misc_feature (1)..(1): n is a, c, t, g, unknown, or other
  misc_feature (63)..(63): n is a, c, t, g, unknown, or other
  misc_feature (64)..(64): n is a, c, t, g, unknown, or other
  misc_feature (1012)..(1012): n is a, c, t, g, unknown, or other
ntttgtttgtgttttgttgtgttgatctttgctcctcctcctccaatttttaaaaacaaaatnnaaatatcattcccagtggaggaactccccgcggtggcggccgctctagaatagtggatcccccgggctgcaggaattcgtctcacccctagaaaaagtcgtaggcggtttgcactagcgtttccgtgaggtgggcgaaggcgtccgtgaccgaccgaccgaccggagcttcatgcgccaggggcggcggcttcaccccgtcgtttgatgggcaacgcatgcagcggcgcccttagatccaagtacctgcacagcttcaagcacgccgcgtcgcagcgccacgactccgagtacagcgccagcgccagcgccgacgactcgcccaggaagcccacaccgcccgccaccacggacgcccacgcgccggcgccgcccgccgccgccatgaggcgcggcgcggctggcgcgacccccggacctcgggtccgttgctcggccacacaaacccccccaaccttccgcgacctcttacgcgcttcggcaggaaaagctccggggcaagggggcagttccgggaaccaccttaccctcttggaaccgaagtctccgcccacggggggaatcgaactttacccccctggcgaaggttccaatccttcccaaaggcgaccaaaagccttccattccacccccaaaggggagagggaacggttccggaaaccaaaaccttggggcccgcccccgcccggaagggagattccccacaggaatatccaattggtgcgagccccaacccttttctttttcctgggggggcccccaacaaagaaaacacgcttcgcgtttcccgccgctatattccaagaaggggggccggcccgttttaccgcaaggggaaccccggggggggtccttataccgtgtcccccaacaatttgcggtctcctatgggggagaactcctctttcgttgacccccgtggggggggtcgaaaaactttctttttctnaacacccgggaaattccaatacactaaggggcgggggaaacaactcaatatcgttgccaaggcgcccatagtgggtctttccttcggacgctctcaacaaggggaatctactttctcgtcgcggggg

SEQ ID NO: 95925 - DNA, 803 bp, Zea mays
  misc_feature: Ceres CLONE 1586345
  misc_feature (344)..(344): n is a, c, t, g, unknown, or other
  misc_feature (762)..(762): n is a, c, t, g, unknown, or other
  misc_feature (803)..(803): n is a, c, t, g, unknown, or other
ctggagctccccgcggtggcggccgctctagaactagtggatcccccgggctgcaggaattcgtctcacccctagaaaaaactcgtgtccgatggctcgcccccgccgcctcctctgacgacggtctgactgacccccgcctccccggagagcggctccgctgtctcgccggatatggcgccgcctcgtccccctcctaaccctggcgggggagcagcagccgcagctccacggggtggtcatcatcacgctccctcccgcggaccagccctccaagggcaagaccgtcaccgccttcgcctacaccaacgaccccccgccccctcgctcgcccccggatccgngttatggggtacccggcggcgacggaggctaggcggcggccgaggcgggcgctctcaacgcggtttggtggcgacgtcggcgctcgtgctgggcgcgctcgcggtcgccgcctactattgcttcttactcggacgtggccgtgcagttcctggggatggagcaggaggtagagcagaggaacgagaccaggtctttcctgctgccgctctaccccaatggcgcgtcagggccgcgcactgcgcgagttcggggacgtcaagctcgccgccaggagggtcgacgacggcggaagaaggctaggaacaggatggaggtcgcgtaggcggccacggcgaggacatatccacgggcgtgctcccgatcaagggcatgtcttccccgatgggcagtattaacatctatctttatgggcacctnccagacataccttctgatgtgatactgaagcgactgacgtn

SEQ ID NO: 95926 - DNA, 1041 bp, Zea mays
  misc_feature: Ceres CLONE 1586346
  misc_feature: Encodes the peptide sequence at SEQ ID NO. 95927
ctccccgcggtggcggccgctctagaactagtggatcccccgggctgcaggaattcgtctcacccctagaaaaagcgccgccaccgccgccgtctagcattttcctacacccaatctgatctgaccaagccctctgaacacccccgcccatcctcctcctcctcctccgccgccgccgcccaagatgggcttcgacgtgggcctcgtcccctacaaccccgacgggggggggccacctgaagttgccgccgcgccgccttccctcggtgggggctcctcggctgtccccgtcgctcccttctcccgctccgacaagctgggccggatcgccgacggggagcgcaactcgcccggcccccgggggttgggggggggtcggcacccccccgttgggtttgcggggggtggggggagacggggaggtgtcgcgcccggcgggggaatggctgcgttgccggcggcgtggcaaggggcgagcgggcggcccgggggcgggtcgcgtgtcgtgggacctcggcgcggggcgtcgaccgggggggggggggccgagggtcccgccgggggggctgggcgccgggggaggggggtgcgggggggttgggggcgcggcgggagggcggcggtggggggaggtagggggcgggggggggtcgtgccgcgcaccggcgggtggagggggcgtaggtaagtggggagctagtgaggcggcgaggagcggaatatacgggcgcgaggttcgaagggagacttgcgaggggcgggggcgagggcggcggtggcggtgctgggtaggtgctgaagctgggtggggcgagggcgcggtggcggttgggatgaggggggggataggagacgggggggcgggtaacagtgggtgaggaggaggaggtgaatgatgtgggagtgggagggggggcacgtgggcgcggaggggcgcggatggtgcgggcggttggcgcggggtggcgggtatagcgagtaggggtggtgccgcggggggcgcgctggcgacgggggcgcgggcgtagccgttgcggcttg

SEQ ID NO: 95927 - protein, 167 aa, Zea mays
  misc_feature: Ceres CLONE 1586346
MGFDVGLVPYNPDGGGPPEVAAAPPSLGGGSSAVPVAPFSRSDKLGRIADGERNSPGPRGLGGGRHPPVGFAGGGGRRGGVAPGGGMAALPAAWQGASGRPGGGSRVVGPRRGASTGGGGAEGPAGGAGRRGRGVRGGWGRGGRAAVGGGRGRGGVVPRTGGWRGRR

SEQ ID NO: 95928 - DNA, 863 bp, Zea mays
  misc_feature: Ceres CLONE 1586349
  misc_feature: Encodes the peptide sequence at SEQ ID NO. 95929
tggagctccccgcggtggcggccgctctagaactagtggatcccccgggctgcaggaattcgtctcacccctagaaaaagacccgggctccttcatcctcgacacctcactccggcggcgcgggtccgcagtgctgcacatcgcgagccgcgcggcacagccgcacttgttgtccttcgtgcgtggggtgcggttcgacgcggagcggcgggatggcggcgagcgcgcgggacagcaccgatgcagcggagcgagttgtggatgaccacgacggctgggcgtcggacgccgagatggacgtggagatggatgtggtggaaggcgagttccacgaccgcgatgccgaccggagggacggcggcgcggatggtgatgatgagtacttgctgctcactaggataagggacacatcagcagctgaagcaagggcaggaaaggatatacaaggtataccatgggagaggatacacatagccaggcaagattaccgaaaagctaggttggaaccgtataagaactatgaaaatttccctcgatcaggagagctcatggataagctgtgcaagcaagtggagaaaagcaacaagtattatgaatttcaccacaaccctagatcaaggaagccatcaattctcctttttcagcttaaggatttttttaggggcaacctccaaaggaagaatgtctatttttaggtcaaattcccccaggtaagcccactgggtcatcatttgtcttcacaaatttatccaaagggttccttggacttcctccgggggaattgtttgcctcccaacgggaataaggtattccggggccgggttttatctaagaaaggggtttccccctggggtggttccaag

SEQ ID NO: 95929 - protein, 160 aa, Zea mays
  misc_feature: Ceres CLONE 1586349
MAASARDSTDAAERVVDDHDGWASDAEMDVEMDVVEGEFHDRDADRRDGGADGDDEYLLLTRIRDTSAAEARAGKDIQGIPWERIHIARQDYRKARLEPYKNYENFPRSGELMDKLCKQVEKSNKYYEFHHNPRSRKPSILLFQLKDFFRGNLQRKNVYF

SEQ ID NO: 95930 - DNA, 895 bp, Zea mays
  misc_feature: Ceres CLONE 1586352
  misc_feature: Encodes the peptide sequence at SEQ ID NO. 95931
ctcaccgcggtggcggccgctctagaactagtggatcccccgggctgcaggaattcgtctcacccctagaaaaaatctaacgtactccaggctccagctgatttgtccacgcggcatggcgacggccagcgccgcttcaagcttcctcgtcccggcgactgctatcgccccgacaccctctgcatgcccatccacggttcccaagaacaagaagaatgctgccggccggcggcggcgcacattgcagtgcagggccagcggccggcggggcgacgacgaagacagccgcctcctctggctgccccggcgggaagtgctgaccggtctgggcggcgtggccgccagcttcgtcgggtacccggatctggcttccatcgccctggaagcgaaccccgtggagagctgccggcggggcgagaaggtgacggagaagctggtggagtgctcggacccgaacagagacttcccgtgcccgccggcgtcacgggttcccccatcgtggacttcacgcccgaaggcgagggtggaccccgttcgcaggccgggcgcaccctcctggacccggagtaccaggagaagtacaggggaggcggtgggggaaaaatgcgggcccctggaacggggtcaaaaccccctggaccttcgcgggcgcaaggcggccgtcccaccagttcctaactgcggacggggaactacccggctgggaaccgaacggaaaaagaaaccggcccctttcgacgtgggaacttttcttgggggaattttccccggccgggggcaccccccagggaaaattttaactttttaacgaggggggccccctccgggcgaggttcatttggggggaaaaaaccacctttgggcgcttgccccttttttgtggaacctgggggaa

SEQ ID NO: 95931 - protein, 230 aa, Zea mays
  misc_feature: Ceres CLONE 1586352
MATASAASSFLVPATAIAPTPSACPSTVPKNKKNAAGRRRRTLQCRASGRRGDDEDSRLLWLPRREVLTGLGGVAASFVGYPDLASIALEANPVESCRRGEKVTEKLVECSDPNRDFPCPPASRVPPSWTSRPKARVDPVRRPGAPSWTRSTRRSTGEAVGEKCGPLERGQNPLDLRGRKAAVPPVPNCGRGTTRLGTERKKKPAPFDVGTFLGGIFPGRGHPPGKILTF

SEQ ID NO: 95932 - DNA, 868 bp, Zea mays
  misc_feature: Ceres CLONE 1586353
  misc_feature: Encodes the peptide sequence at SEQ ID NO. 95933
  misc_feature (854)..(854): n is a, c, t, g, unknown, or other
ccccgcggtggcggccgctctagaactagtggatcccccgggctgcaggaattcgtctcaccccctagaaaaagccctctagtgactagttcacgtcagttgctgctccccccaccttctcctcctgctcctgccctcggtttctgatcagcgaacatgggaacccgcggcgtcgccctgctgctcctcgcggcggtgctgctcctccaggcgctcctccccgcgtcgtcggagggcctggtgcgggtcgcgctgaagaagctgcccgtcgaccagaacggccgcgtcgccgcgcgcctctccgccgaggagaggcagcgcctcctcctccgcggctccaacgctctgggctcaggcggcgacgacgactccgacgtcatcgcgctcaagaactacatgaacgcgcagtactttggggagatcggcgtcggctcgccgcagcagaagttcaccgtcatcttcgacaccggcagttccaacctctgggtgccatcctccaagtgctacttctcgatcgcttgctacttccactcgcgctacaagtcagggcagtcaagcacttacaagaagaacggaaaacctgctgccattcgctatggaactggttccattgctggttttttcagtgaggatagcgttacattaggtggatctggttgtgaaaggatcaggaatttattggaagctacaaagggagccaggggctttacctttcatgggttgcaaaaatttgatgggcatttccttggggctagggctttttcaagaaaacctctggtttgggaaatggccaaccccccagggggtggggtaataaccagtggggggaaaaaacaagggtcttctattcaagnggaaaccccttggt

SEQ ID NO: 95933 - protein, 237 aa, Zea mays
  misc_feature: Ceres CLONE 1586353
  misc_feature (84)..(235): Pfam Name: Asp Pfam Description: Eukaryotic aspartyl protease
  misc_feature: SWISSPROT Homolog: EC 3.4.23.40 Phytepsin
  misc_feature (233)..(233): Xaa is any aa, unknown, or other
MGTRGVALLLLAAVLLLQALLPASSEGLVRVALKKLPVDQNGRVAARLSAEERQRLLLRGSNALGSGGDDDSDVIALKNYMNAQYFGEIGVGSPQQKFTVIFDTGSSNLWVPSSKCYFSIACYFHSRYKSGQSSTYKKNGKPAAIRYGTGSIAGFFSEDSVTLGGSGCERIRNLLEATKGARGFTFHGLQKFDGHFLGARAFSRKPLVWEMANPPGGGVITSGGKKQGSSIQXETPW

SEQ ID NO: 95934 - DNA, 887 bp, Zea mays
  misc_feature: Ceres CLONE 1586354
  misc_feature: Encodes the peptide sequence at SEQ ID NO. 95935
  misc_feature (887)..(887): n is a, c, t, g, unknown, or other
aaagctggagctccccgcggtggcggccgctctagaactagtggatcccccgggctgcaggaattcgtctcacccctagaaaaagtgcagagcgagacgcgtcgcctcctcccttcccccaccccgccgccgccctcgcgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactccctcatcgaggaggaggaggggctcaacgaccacaacggcggcgggaagtgcgccgagatccagaacgccatctccgaaggagcaacatcgtttcttttcaccgagtaccaatatgttggtatcttcatggctatcttcgctgttgtgatcttcctcttccttgggtccgttgagggattcagcacgaagagccggccctgcacatttaggaaggacaagtactgcaagcctgctctgttcactgcactcctttaacactgtggtccttcttggctgggagccctcaccctctcgggtctctgggtttccttggcatgaaaaatggccacttatgcggaatggcaagaactacccttggaaacgtagagaagggtggtgggcaaaggttttttatccctgcttttccgcctccgggggccggttatgaggtttcctcgcgtggcaacagagggggacgttggggcttcctggacactcacaatataatggttcttaaagacgtgtttaacgggggggtgacctgggagagggcttcttttagatgcccccctccn

SEQ ID NO: 95935 - protein, 137 aa, Zea mays
  misc_feature: Ceres CLONE 1586354
  misc_feature: SWISSPROT Homolog: EC 3.6.1.1 Inorganic diphosphatase
MAILSALATEVLIPVAAVIGIAFAVVQWVVVSRVKLSPAASGGSGGKAGYADSLIEEEEGLNDHNGGGKCAEIQNAISEGATSFLFTEYQYVGIFMAIFAVVIFLFLGSVEGFSTKSRPCTFRKDKYCKPALFTALL

SEQ ID NO: 95936 - DNA, 1103 bp, Zea mays
  misc_feature: Ceres CLONE 1586359
ttttttttcttttttttttatttttttaccctttttgctgtttctcgttaaaaaaagataaaaaaatttgttttaaaaaactggaactcaccccggtggcggccgctctagaactagtggatcccccgggctgcaggaattcgtctcacccctagaaaacttttccgctccagacacagcagcccctcttgtaccagtaaaccgtgctgctatcccccgctagccgccgcgctgctgcggctcgcctccctcctccccagtccccacgccccgccgccgccgccgccacctcctctcgctccctccttttaccccgagcttaagctcgcgcgtacctgcctacctatccgtaggagaggaagaggggacaaggcccggtcggtcggtcggtcggtcggggggctctcggatctcgccgctgcctccccgttcgttcgttcgttcgttgggatctcgcgccatggccgccgtcgcgccgcccccggcccccgcgccggcaccggttcctgctcctgctcctgccaccggccctggtcgcggatcaaaccacggaatctgctgcagaaagctggtcgctcgaactcgcagccccaagcctggcgggacgcaaacacaagccttggctgcttgcccacccccccaaaaaaaggggcggcccgcgggccgaagcccaagcccggcctggaaaccggtggggcggaatcccccccccccggaagaacccgttccccaattcaaaccgcccccgggggggaaaattcccgaaagaaaaccttctttacgcgggggaattcccccaaaaacccttgggattttttaaattccttaacccccagggccggttaatttttaccctaaacggggagaagggctttaaccgaaacaagtttttccccctatgaaaaaccgtaaagggggggggataataaattttttttccgcggaggaataattttcttttaaaaatttttctcaaaaattggggaagatgggacaaaaaatttgaccccccccagcgcggggtaatataagcggagaaaatatactttctaattggggaacatatggggggtataagggctcccccctatataccggaggga

SEQ ID NO: 95937 - DNA, 875 bp, Zea mays
  misc_feature: Ceres CLONE 1586361
  misc_feature: Encodes the peptide sequence at SEQ ID NO. 95938
ctggagctccccgcggtggcggccgctctagaactagtggatcccccgggctgcaggaattcgtctcacccctagaaaaagccaacggaaacgcggccagtttgccagcacagcaccaacacggccctgccggcatcgtctttctgcttctgcaaaagacgaacaaatcaaaagggtgatcatctcggtgcccaccaaacctcaacaaccaagtttcatgtctaatctcgacgttcagcttccatctgctttgatctgtttgttgaggcaaatgctgaggctctggtgttggtcctggaacgaggattacgtgcatgtgcgcatctaagagcgcaatgatagaaagactttgactacagtccagggtctgaataaagaatccagttataacaagatcctcaaagatctgaaaaaggaattctgctgcaattggtactgtagttcaggaccccagagctaggccaggtcattcagcctccaaggtgatcaaacacaagaacgcccttcacgtcccccataatgcagcaatttccccgtgtgtatttccctgtcttcaaaagcgggcggcgcccataatcctggcccaaggaagcatcaataagcaagttaaggaaaggggacaaaaaaaatgggcttggcattccgggctggcaacaagacaactggaaacgatagatggcttcccaggccattcaaaagaacaatgccccaaaaaaaaaactcccccatttgaaaaactccctaacgcccaaaattagccaaggatatattcccttttcccttgcccccccagaaaaacaggggggcgcccccggttccctcctcccaagaggggacccccattttttttggggctgcccctagaagtaaaaata

SEQ ID NO: 95938 - protein, 36 aa, Zea mays
  misc_feature: Ceres CLONE 1586361
MSNLDVQLPSALICLLRQMLRLWCWSWNEDYVHVRI

SEQ ID NO: 95939 - DNA, 840 bp, Zea mays
  misc_feature: Ceres CLONE 1586362
  misc_feature: Encodes the peptide sequence at SEQ ID NO. 95940
  misc_feature (635)..(635): n is a, c, t, g, unknown, or other
ggagctccccgcggtggcggccgctctagaactagtggatcccccgggctgcaggaattcgtctcacccctagaaaaagtccaccaccgccgcctccttccagctgggtggaagaaacatgtcgcgaatggcgcccccgtctccgcctcagtccctgaagcccccgacgctgcccttctccccgcccaaaaagccaccgccgatgccggtgtacaaggacctgcacttcaaccgcgacctctccgccaccaagaagctccaggccggagtggacctggtggcacggttgttgggggtcaccctggggcccaaggggaggaacgtggtgcttggcaacaagtatggccctcccaagattgtcaatgacggggagaccgtccttaaggagatcgaattggaagatccattagaaaatcttggagtgaagctggtccgacaggctggagcaaggaccaatgatattgcaggagatggttgtaccacatccataatccttgcccaaggcctcattgctgaagggatgaaggttcttgcagctggaatcaacccagttcaggtcgcacgtggcattgagaagactgctgctgctttggtgtctgagctcagactgatgtcgcgggtgatttgagaccatngaattgcacatgtggctgcagttagtgcgggaaatgattatgctggtggaaatatgatttatgatgcttttcaaagagaggtagacaaggaaatggtgagaattgaaaatgggaagaggcccggaggaccgttctggaggttctgggagggatggcaatttgaacgcgggtaccctctctccttacttggttaccgaacggggga

SEQ ID NO: 95940 - protein, 166 aa, Zea mays
  misc_feature: Ceres CLONE 1586362
MAPPSPPQSLKPPTLPFSPPKKPPPMPVYKDLHFNRDLSATKKLQAGVDLVARLLGVTLGPKGRNVVLGNKYGPPKIVNDGETVLKEIELEDPLENLGVKLVRQAGARTNDIAGDGCTTSIILAQGLIAEGMKVLAAGINPVQVARGIEKTAAALVSELRLMSRVI

SEQ ID NO: 95941 - DNA, 810 bp, Zea mays
  misc_feature: Ceres CLONE 1586363
  misc_feature: SWISSPROT Homolog: EC 2.4.1.12 Cellulose synthase (UDP-forming)
ctcaccgcggtggcggccgctctagaactagtggatcccccgggctgcaggaattcgtctcacccctagaaaacacgttcgaggcgctgtcggagacggccgagttcgcgcggaagtgggtgccgttctgcaagaagttctgcatcgagccccgcgccccggagttctacttctcgctcaaggtggactacctcaaggacaaggtgcagcccaccttcgtgcaggagcgccgcgccatgaagagagagtacgaggagttcaaggtccgcatcaacgcgctggtggccaaggccatgaaggtgccggcagaggggtggatcatgaaggacggcacgccgtggcccgggacaacacccgcgaccaccctggcatgatccaggtgttcctgggccacagcggcggccacgacaccgagggcaacgagctgccccgcctcgtgtacgtctcccgtgagaagcgcccgggctttcagcaccacaagaaggccggcgccatgaacgctctgatccgcgtctccgccgtgctgaccaacgcgcccttcatgctccacttggactgtgatcactacatcaaacacagcaagggccatccgggaagccattgtgcttccttcatggaccccccggtcgggccggaagggctgctacctgcagttcccctcagaggttcgacggctttaaattgcccaaccgatacccgaaaaggaaccccgtcttcttcgaaataaaatgaaggggctggaagggattccgggcccgggctactccggggacgggggggggttccggggccagggcttttaggggtaca

SEQ ID NO: 95942 - DNA, 951 bp, Zea mays
  misc_feature: Ceres CLONE 1586365
  misc_feature: Encodes the peptide sequence at SEQ ID NO. 95943
tccccgcggtggcggccgctctagaactagtggatcccccgggctgcaggaattcgtctcacccctagaaaaaacctcatctgctctccttttgatcggaacgcaccaccggccggtctccgatctccgatccccgatcccctcgtcgatccaagatgcagatcttcgtcaagactctcagtggaaagactatcgccctcgaggtggactcctctgacaccattgaccacgtccatgccaagatacacgacagaggaggcgttcccccggaccagcagggggtcatcttcgctggcgagccgctcgaggacgggcgcacacttgccggctacaacatccggaaggagaacaccctccaacttgttctccgcctcaagggaaggctggcgatttttcgttcaggaccctcacctggaaggactatgccccctcccagggtggaaggctttttgacccccgtcgaaaaaccctcgaggggcccaaaatccaagaagcaaagggagggggatccccttcccggaacctagatgccggggttctttttgttgggcggggggaaaccaaacctcccaaggaaacggggggcccaacaccttgggcccggagggtacccaaccatttcattgaaaagggacaaagcccccccctcccccaccttgggggggtttcgcctgttttccaaggggggcgggggtgatccacaatttctttcccggggaaagaacgtcgggtcgggggcaagagagacatttccccccttcggaaggagtccaaagctttttctggaaaacccgctgtggaaacatgtggccgggggcccaagggtccccggggacaaggggggggggatccccccccccggaaacgggtgggggggggtattttcttgtcgggggggaagcccctcccggggaagggggggcccgctgtgtccagacccaaaattattta

SEQ ID NO: 95943 - protein, 123 aa, Zea mays
  misc_feature: Ceres CLONE 1586365
  misc_feature (6)..(74): Pfam Name: ubiquitin Pfam Description: Ubiquitin family
MQIFVKTLSGKTIALEVDSSDTIDHVHAKIHDRGGVPPDQQGVIFAGEPLEDGRTLAGYNIRKENTLQLVLRLKGRLAIFRSGPSPGRTMPPPRVEGFLTPVEKPSRGPKSKKQREGDPLPGT

SEQ ID NO: 95944 - DNA, 1333 bp, Zea mays
  misc_feature: Ceres CLONE 1586366
  misc_feature: Translation starting site: 394
  misc_feature (1)..(1): n is a, c, t, g, unknown, or other
  misc_feature (18)..(18): n is a, c, t, g, unknown, or other
  misc_feature (1024)..(1024): n is a, c, t, g, unknown, or other
  misc_feature (1049)..(1049): n is a, c, t, g, unknown, or other
  misc_feature (1215)..(1215): n is a, c, t, g, unknown, or other
  misc_feature (1223)..(1223): n is a, c, t, g, unknown, or other
  misc_feature (1281)..(1281): n is a, c, t, g, unknown, or other
  misc_feature (1292)..(1292): n is a, c, t, g, unknown, or other
nttttttttttttttttntttttttaatatacaccacaccaacacacaccaatgaaaagcgcggccacccacctatacaaaaatggagcttcccccggtggcggccgctctagaactagtggatcccccgggctgcaggaattcgtctcacccctagaaaaagcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcgggggcccatctgcgcgtccatgtccatgtcctcctccaacccgccctacgacctgacgtccttccggttcagccccatcaaggagtccatcgtgtcccgcgagatgacccgtcgctacatgaacggacatgatcacctacgccgacaccgacgtcgtcatcgtgggcgccggcttccgcgggggctgtccttggcgccgtaacaaacctcccccaagggaacccctcgccggggagccattcgcccactcggtgggaggcaaatccggggggttcatcaccgggacggggcgggcccccgatggggcttggggacggggggccaagccttgtttttcttccgggacccaattgggggggggtgggccgggcaaaaagacccgggagcggccaaacccctctgtggtttccccctgtggggaaagacaaaaaagctcttggtgtagcccgagagtggtggtccgcctttttacgcgaaaaaagcccaagaagggggtgccccccagaaaaagatgggaaaacctgttttcgccgagggtggggtgggggtcctaccatttcaaacagaggggttgagctatcgggcgccccagcagcggagtggcgtagcccttttgctcaaacgacggtgatgtccccgaacacccgggnggccactgcaaaatagaaaaagagncgccctctggcccatcagcccgccgggaggagggaggaggactagctctctccacaaaaagacgagtgtatagagaaaagctgttggtgtgttgttcaagaaacacagccacgcgatgtggggtggcccccctttgtggtgaaagagagagaacactcctctacantatctttnttcacaagggggaggacaagagaggggagaccacgccataatgtgagaagtgaggacnactgtacagcnaatcccaccaaaaaagcggggatgggggggcgtctcccggt

SEQ ID NO: 95945 - DNA, 840 bp, Zea mays
  misc_feature: Ceres CLONE 1586367
  misc_feature: Encodes the peptide sequence at SEQ ID NO. 95946
  misc_feature (244)..(244): n is a, c, t, g, unknown, or other
  misc_feature (763)..(763): n is a, c, t, g, unknown, or other
ggagctcaccgcggtggcggccgctctagaactagtggatcccccgggctgcaggaattcgtctcacccctagaaaaaggggtgcgacgcgccgtgagttaccgaattacccctctatccgcctcccccctcttctaacaagtcgtcgcctcggcccggcttcgcctccctcggcgcgacgacctctcccccaggagagcctaccccctccctcattccccgcgcgacgaggccgcttaatggnagggtcgcggccggcctcggccgggctcgctccaggctctcgtcgtcgccgccgccatcctcctcctggccgccgtgtccggggtcggcgctggatcccccgatcggcccgcgccggggccaccgctgttcctcccgctcacgcgctcgtaccccaacgccagccggctcgccgcctcgctgcggcgcggcctcggcgacggggtccaccccaacgcgcgcatgcgcctccacgacgatctcctcaccaacgggtactacacgacgaggctgtacatcgggacgcccccgcaggagttcgcgctgatcgttgactccgggagcaccgtcacctacgtgccctgctcctcctgcgagcagtgtgggcaccaccaggatcacgatttcaccctgaccctctcagttcatattcaccagtaaaatgcaacgtttgattgtactttgtgacggggacaaaaaacagtgcactttatgaagagcagtatgctgaaatgagctccagcagtgggggtgctttggntgaggacatagtgtcttttgggccgagaggagggactttaagccacggcatgctattttttgggctgggaaaattct

SEQ ID NO: 95946 - protein, 65 aa, Zea mays
  misc_feature: Ceres CLONE 1586367
  misc_feature: SWISSPROT Homolog: EC 3.4.23.4 Chymosin
MRLHDDLLTNGYYTTRLYIGTPPQEFALIVDSGSTVTYVPCSSCEQCGHHQDHDFTLTLSVHIHQ

SEQ ID NO: 95947 - DNA, 1170 bp, Zea mays
  misc_feature: Ceres CLONE 1586368
  misc_feature: Encodes the peptide sequence at SEQ ID NO. 95948
  misc_feature (5)..(5): n is a, c, t, g, unknown, or other
  misc_feature (6)..(6): n is a, c, t, g, unknown, or other
  misc_feature (58)..(58): n is a, c, t, g, unknown, or other
  misc_feature (59)..(59): n is a, c, t, g, unknown, or other
  misc_feature (83)..(83): n is a, c, t, g, unknown, or other
  misc_feature (895)..(895): n is a, c, t, g, unknown, or other
gattnntgtgtgtttttttttctcatcaggtataagtccgccattcattattgcgcgnnggggtattccttcctactcaacgngacggaactcaccgcggtggcggccgctctagaactagtggatcccccgggctgcaggaattcgtctcacccctagaaaaaaatccatccggagaagctagagtccaggtctcactcgcgaccgagagccacagagaaatgggggcccctgctcgtccctggcgccggcacgtcttcctcgtcgtgtcgctgcagctgctccttgtggcgccatggcaggacgagacggccgctcgagctctcaatttcaccaggcaggatttccccagggccttcgtctttggtgccggcacgtcagcttatcagtacgaaggggcaaccgatgaagacggaaggagcccaagcatatgggacaactttactcatgcaggtaggatgccggacaaaagcactggcgacctaggggcggacggctaccacaaatacaaggggagaccgtgcagcttgatgaggggacactggcccttggaggccctacccgccttctcccattttccttggggccccggggcttaatttcccaagaagggaaagaaaggaggccctttccaaccccccaaaggggggcccctccgagggttattttacaaaccaaacccctgggaatcacaaatgggagagcctctaggttaaaagaacccccgaggggaaaaatatttggggagaaaattactccacccggttggggacacacacctctttggtgttccccccccaccccgtgtgggggaatttatacccccccctttccaagaaaaattcccccgtggggggaaggggaaacccaaaattttaccccccccccggggcgnctgggggcctataaaggacccccccccagagagaaaatgggggggggggaaaacaaaaactctttcccaaaagggcgcggttaacccccccggaaaacctgtgtgtgggcctttctccctccggaagaatttctcggcgcggaaccccggggggttggaagggccaactgtgtgaaccccacccctggtggaacagaaagcccgaaaaaggttcaaaactttctattttcccgccaccctaagaaaaaagaagggggggctctttccccccgccg

SEQ ID NO: 95948 - protein, 125 aa, Zea mays
  misc_feature: Ceres CLONE 1586368
  misc_feature: SWISSPROT Homolog: EC 3.2.1.21 Beta-glucosidase
MGAPARPWRRHVFLVVSLQLLLVAPWQDETAARALNFTRQDFPRAFVFGAGTSAYQYEGATDEDGRSPSIWDNFTHAGRMPDKSTGDLGADGYHKYKGRPCSLMRGHWPLEALPAFSHFPWGPGA

SEQ ID NO: 95949 - DNA, 848 bp, Zea mays
  misc_feature: Ceres CLONE 1586369
  misc_feature: Translation starting site: 218
ctggagctccccgcggtggcggccgctctagaactagtggatcccccgggctgcaggaattcgtctcacccctagaaaaagccaagggaaacgcggccagtttgccagcacagcaccaacacggccctgccggcatcgtctttctgcttctgcaaaagacgaacaaatcaaaagggtgatcatctcggtgcccaccaaacctcaacaaccaagtttcatgtctaatctcgacgttcagcttccatctgctttgatctgtttgttgaggcaaatgctgaggctctggtgttggtcctggaacgaaggattacgtgcatgtgcgcatctaagagcgcaatgatagaaagactttgactacagtccagggtctgaataaagaatccagttataacaagatcctcaaggatctgaagaaggaattctgctgcaatggtactgtagttcaggacccagagctaggccaggtcattcagctccaaggtgatcaacacaagaacgccctcacgtccaccatagtgcagcaattgcccgtgtgtatttcctgtctcagaagcggcggcgccaagatccagccaaggagcagcagaagcaagtaaggaatgtgatcagaaaagtggctagcaattcggctgcagcaagcaactggacgatgatgggcttcaggcagtcagaggacaatgcacaggaagaaacaatcacattggacgactcctaacgccaacataggcaagtatcatccctttcgctgcccctcgaagaccagttggccaccgttcccctctccgaacggaacgccaatttttgggctgccttgaagtaacatttggaaggaaggcgtcccccggcgc

SEQ ID NO: 95950 - DNA, 868 bp, Zea mays
  misc_feature: Ceres CLONE 1586370
  misc_feature: Encodes the peptide sequence at SEQ ID NO. 95951
aagctggagctccccgcggtggcggccgctctagaactagtggatcccccgggctgcaggaattcgtctcacccctagaaaaatttttcggtggaccagctttcctcgcttgggctagaatggggaacttgcatgggtggggtggaccactgtcacaaaactggttggatcaacaattggcattgcagaagaaaatactatcccggatgattgagcttgggatggtccctgttcttccatcgttctcaggaaatgtcccagctattttcgcaaaattatttccgtcagccaacattacgcgacttggtgattggaatacagttgatgctaatcctaagtggtgttgcacttatcttcttgatccttctgattcattgtttatagatatggggcaggcttttatcaggcaacagataaaagagtacggcgatgtaaccaacatctataactgtgacacattcaatgagaatactccaccaacagatgaaccggcatatatttcatcacttggttctgctatctatgaagcaatgtcccgaggtacaagaatgcagtatggttaatgcagggtttggttattctactcagatgctgcattctggaaggagccacaaatgaaagcactacttcactctgttccaattggtaggatgatagttcctcgatttatttggctgatgtcaagcccattttggaaatgtccctctcagttttacgggcgtaccatacatcttggtgcatgttacccaacctttgggtggaaccattgaaaatggttgggcaaacttggattccaattttcatctcggcccccattgtgatgccccgtacacagttacaatttcacaaatgaattgggcctttggct

SEQ ID NO: 95951 - protein, 186 aa, Zea mays
  misc_feature: Ceres CLONE 1586370
  misc_feature (4)..(185): Pfam Name: NAGLU Pfam Description: Alpha-N-acetylglucosaminidase (NAGLU)
  misc_feature: SWISSPROT Homolog: EC 3.2.1.50 Alpha-N-acetylglucosaminidase
AGAPRGGGRSRTSGSPGLQEFVSPLEKFFGGPAFLAWARMGNLHGWGGPLSQNWLDQQLALQKKILSRMIELGMVPVLPSFSGNVPAIFAKLFPSANITRLGDWNTVDANPKWCCTYLLDPSDSLFIDMGQAFIRQQIKEYGDVTNIYNCDTFNENTPPTDEPAYISSLGSAIYEAMSRGTRMQYG

SEQ ID NO: 95952 - DNA, 818 bp, Zea mays
  misc_feature: Ceres CLONE 1586376
  misc_feature: Encodes the peptide sequence at SEQ ID NO. 95953
  misc_feature (761)..(761): n is a, c, t, g, unknown, or other
ctggagctcaccgcggtggcggccgctctagaactagtggatcccccgggctgcaggaattcgtctcacccctagaaaaacctgctggccgctgccctttccttcccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggctctcgtcgccgctaccccgtcgcgcgccgtcgtccccgtcgccgtccgcctcctcgcgcgccaagcctcggaagccctcgccctctcccgcggccttccccaccgacgccgacgactcgctcgacaacccggatctggggcccttcctcctcaagcaagcgcgcgacgccatggtgtcgagcgagggcggtggcgccgcgcgcgcactcgagttcgccgagcgcgccgccatggcgctcgagcgacgcggcgagggcgccgagctcgagctcgcatgagcctccacgtcgccgccgccatccactgcggcctcggccgccacgctgacgccatccccgtcctcgagcgcgccgtcgcagtcgtcacgccgccgccagtagcgcttgccgacggcgatgccgtagcccgaggcctgtgcaaccgggcgcgacgaccaccagcagctgcagcctgcgtagctgacaaaaaggggctaggaantgtcccctcgccgccttcctcggctggatgcagctcggcgaaccgaccgcatgcctg

SEQ ID NO: 95953 - protein, 112 aa, Zea mays
  misc_feature: Ceres CLONE 1586376
MPGLAASDNSPPAPAPPPRRLSSPLPRRAPSSPSPSASSRAKPRKPSPSPAAFPTDADDSLDNPDLGPFLLKQARDAMVSSEGGGAARALEFAERAAMALERRGEGAELELA

SEQ ID NO: 95954 - DNA, 899 bp, Zea mays
  misc_feature: Ceres CLONE 1586383
  misc_feature: Encodes the peptide sequence at SEQ ID NO. 95955
ctggagctccccgcggtggcggccgctctagaactagtggatcccccgggctgcaggaattcgtctcacccctagaaaaactcagactcctcccggaccagctgacctccgctccattcaccccacaccttcttcttcgtcgtcgtcttcccctgctgcggttagcctggccgtggccgcctcctgctcttcgatctcacgctgcgatggagcggtacgaggtgatcagggacatcggctcgggcaacttcggggtgacaaagctcgtccgggacgtcaggaccaaggagctcttcgccgtcaagttcatcgagagagggcaaaagattgatgagcatgttcagagggagattatgaaccaccggtccctgaagcacccaaacaatattagattcaaggagggtatttctcagacatcttgggaaagaaaatgtctgggacaaaattttaaagttggtgaatgggaagctacccacgtaagtgggtcttcaaacggttacttttgaaggcttttaaagaaaaaaaaaaaaaaactttttttatttctttgccgggtggaacagaaaagtttgaaccccccctgggaaaaatggggccggggggaaggcaacttctttttaaaacccccattctttttcccccttaaaacgaaagcccccttttttttttataaaaagaaaagaaatttgtgtcttggaatattccctataaaatttttttccccgccccctggggaacccccggtcttaaggggtgggggggggggctaaccccacaaaacactttcgggggggaaaaaaaaaaaaaaaatatttttttttgggggggggggcacccccccccctttggaaaaaataaaaaaaaatggcgggggggggggggccgtttaaagaaaaccg

SEQ ID NO: 95955 - protein, 99 aa, Zea mays
  misc_feature: Ceres CLONE 1586383
  misc_feature: SWISSPROT Homolog: EC 2.7.11.1 Non-specific serine/threonine protein kinase
MERYEVIRDIGSGNFGVTKLVRDVRTKELFAVKFIERGQKIDEHVQREIMNHRSLKHPNNIRFKEGISQTSWERKCLGQNFKVGEWEATHVSGSSNGYF

SEQ ID NO: 95956 - DNA, 847 bp, Zea mays
  misc_feature: Ceres CLONE 1586385
  misc_feature: Pfam Name: GDA1_CD39 Pfam Description: GDA1/CD39 (nucleoside phosphatase) family
tccccgcggtggcggccgctctagaactagtggatcccccgggctgcaggaattcgtctcacccctagaaaaatagtatattttaaataaaaataaagctcgacgtcgtcgtcacctctctcgccgtccacgagtcacggcgagcggcgtcgacggcgggcgggggtcctggccgttcactgccatgcctgaccccaccaccaaacccccttcgccacgcccccgccgtcgccgcaagctctgcggcctctgcctcggcaccgcgctcctcgcgctcctcgtcgccgcgctcgtccatgtcgtcgccccgcttccgcgcgccgcttccgcctccgcgcgcttctccgtcatcatagacggaggcagcacgggcacccgggcccacctcttcctcacggggcacgacggcagcccggatctggcgctatccaccgtgatgcgcgtctccccgggcctctcgtccttcgcccccgacccggcgcgggccgggggagtcttttgaaccgctgatagatttttgcgaagggaataagattggaccgcgcggggcagcgccccctgggggaagccggaggtgccaacctcatgggccccccgcagggctggcgccctgctccgaggagcgcccccaaggaaggcaatcttagccttcctgcagggaaccttccttacaaaccccctgggggttccgggttccaaaggaaccccttggggcccaagggggaatcccccaggcttcccggatgaaaaggaatctcttatggcttgggggtttggacaccaaaaattaatggcctccttgggagaaaaaacctcgtgggagggggagattcccctaacacaaaaa

SEQ ID NO: 95957 - DNA, 773 bp, Zea mays
  misc_feature: Ceres CLONE 1586394
  misc_feature: Encodes the peptide sequence at SEQ ID NO. 95958
  misc_feature (636)..(636): n is a, c, t, g, unknown, or other
  misc_feature (653)..(653): n is a, c, t, g, unknown, or other
  misc_feature (654)..(654): n is a, c, t, g, unknown, or other
  misc_feature (663)..(663): n is a, c, t, g, unknown, or other
  misc_feature (666)..(666): n is a, c, t, g, unknown, or other
ctggagctccccgcggtggcggccgctctagaactagtggatcccccgggctgcaggaattcgtctcacccctagaaaatcccatgctttctcttggtaggtgttctctgcctgcctcctccaaccccggcccctcactagaattcttgtcgcaagcacacaccatgatctgttacatgctgtggttagcggcatgctgcctcctcctcttgtacagcgttcgattcaggtccggctggagccatggcaacggccccaggagctaccccgtgattgggtgcctggtcgacttctacaagaaccggtggcggctgctggactggtacactgagctgctggcggcgtcgccgacgcagacgatcgtggtggaccggctgggcgcccggcgcaccgtggtgaccgcgaaccccgtgaacgttgagcatattctcaagagcaacttcggcaactaccccaaggggaagcccttcaccgacatcctcggcgacctgctgggcaccggcatcttcaacgtcgacggcgagctgtggtacgcgcagcggaagctggtgagccacgagttctcggcgcgcgcgctccgggagctggagttcgccgtgctcgaagacgaagcgcgggagcgccttgtgcccgccntgggcctgggcgctgcnncgcgcgacntcntggacatgcaggacctgctcgggcgcttctcgttcgactcatctgccgcgtgtcgctgggcgtttgacccgggtgcctggacctgcatttgcggcgcgaagctggcc

SEQ ID NO: 95958 - protein, 203 aa, Zea mays
  misc_feature: Ceres CLONE 1586394
  misc_feature: SWISSPROT Homolog: EC 1.14.14.1 Unspecific monooxygenase
  misc_feature (158)..(158): Xaa is any aa, unknown, or other
  misc_feature (164)..(164): Xaa is any aa, unknown, or other
  misc_feature (167)..(167): Xaa is any aa, unknown, or other
  misc_feature (168)..(168): Xaa is any aa, unknown, or other
MICYMLWLAACCLLLLYSVRFRSGWSHGNGPRSYPVIGCLVDFYKNRWRLLDWYTELLAASPTQTIVVDRLGARRTVVTANPVNVEHILKSNFGNYPKGKPFTDILGDLLGTGIFNVDGELWYAQRKLVSHEFSARALRELEFAVLEDEARERLVPAXGLGAAXRDXXDMQDLLGRFSFDSSAACRWAFDPGAWTCICGAKLA

SEQ ID NO: 95959 - DNA, 812 bp, Zea mays
  misc_feature: Ceres CLONE 1586395
  misc_feature: Encodes the peptide sequence at SEQ ID NO. 95960
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
ctccccgcggtggcggccgctctagaactagtggatcccccgggctgcaggaattcgtctcacccctagaaaagtgcgcgcgctgcgcggtcggtcgctcccctcctctgtccgcgatctcggctggccgcctgggcttggccctcgccccgctcccgtctccggttccggcggccgagccagatttgctcgggtcttcgtgccagcgacgatgaaggacaagcgtggactcgaggacgccggcgacgggcgccctgatgccaagaggccgcggcctccggctctggccagtgttattgttgaagcgctaaaggtggatagtctgcagaggctctgctcatcattggaaccaattcttcgtagagtagtcagtgaagaagtggagcgtgcactgggcaaacttggccctgcaacaatcggtggaaggccttccccaaagagaattgaaggtccaaatggaagaactctgcaactcgaattccgaacaaggctgtcacttcccctttttactggaggaaaagttgaaggggagcagggagctgcaattcatgttgttttgtttgatgctggcactggctgtgtgtcctgactcatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 95960 - protein, 125 aa, Zea mays
  misc_feature: Ceres CLONE 1586395
MKDKRGLEDAGDGRPDAKRPRPPALASVIVEALKVDSLQRLCSSLEPILRRVVSEEVERALGKLGPATIGGRPSPKRIEGPNGRTLQLEFRTRLSLPLFTGGKVEGEQGAAIHVVLFDAGTGCVS

SEQ ID NO: 95961 - DNA, 938 bp, Zea mays
  misc_feature: Ceres CLONE 1586397
  misc_feature (339)..(339): n is a, c, t, g, unknown, or other
  misc_feature (368)..(368): n is a, c, t, g, unknown, or other
  misc_feature (906)..(906): n is a, c, t, g, unknown, or other
  misc_feature (907)..(907): n is a, c, t, g, unknown, or other
ctggagctccccgcggtggcggccgctctagaactagtggatcccccgggctgcaggaattcgtctcacccctagaaaaaactgcgtccctgtcaggcctgctaagctccagccaaaaaatcgttggcctcggtctggtgcctgctcctcctgccgtcctcgctcctccccacctcccgcggcctcccacgcgacatgattgcattgcgggctgccgcggagctcagctctcctgtcctgccaccaccacgccgctgacgatgccttcctctcgcctgcctctgcctgcgcacaaccgaaacggctagcccgcccttcctcccctcccctttgcttccngcacaagaattggggcgggcgttccttcntccgataaagtgccgagccaagggtgactggtcccgaggagcgtggcgtggaccatgggggaagaagggcagttggttccgccccgtcaagaaaggtcttccgccccgaatcccagggaaaaaaaagaaggaaggcttaggggggaaatcagcggcttgcaacccccccccggggaaatttggaccccccttcccccccccgggaaaaaaaaagtttttggggggccaccccccccgggggctcccccccaaatttcccccccaaaaaaaaaaaaaggggggggggcccccaaaccccccaggggggggaaaaaacaaagttttccccccccgggaaagagccccctctgtggtttgtttgccccccacaaaagagagggggggggccccccccgggggggcacccacaaaaaaaacccccccaaaaaaaaaaacaacccccccctctcagatgtttcttggggggaggggcggaaaaaaaacccacccgccctcaaaaaaaaaaaaaattgggggggagggggaattttttaggggnntttttcgcccccccctgggggtaaataaaaa

SEQ ID NO: 95962 - DNA, 861 bp, Zea mays
  misc_feature: Ceres CLONE 1586398
  misc_feature: Encodes the peptide sequence at SEQ ID NO. 95963
ctggagctcaccgcggtggcggccgctctagaactagtggatcccccgggctgcaggaattcgtctcacccctagaaaaaaagatattcagtgtccacacagatgcatgccagtttggagttggggctattttgatgcagcaagatcatcctttggcattcttgagcaaggctttgggtcccaaaaatcaaggtttatctacctacgaaaaagaatacatggctatattactagctgttaatcagtggcattcttatttgcaattggctgaattctggatttacacggatcatatcagtttaactcagctgaatgctcaacgcctgcatacgccttggcagcagaaagtatataccaagttggtcggacttcagtacaaaattgtttaccgcaagggcaaggataatgcagctgctgatgctctatcgcggttacctcacccaacagccagctgccatgctatttctactagttccccagcctggctacaggatgttattgctgtctatgataagaaccctgaagcacaaaagttgttagcatccctctcggttcagtccactcctaatggaaccattacattgcaccaggggagtcattcgctataagggtagaatatggttggctgggaattctggagttgcaacatccagttattgctgccatgcacgactcttgcaattggagggcattcagggggtcccctgttcccaatggtcaactgaaaaaagttgttttacctggccctggtaagaaaccaaacaggtccaagaattatgggccaatccctgttaacagggggcccagccaagcaaaggggggaaacgaagttcctttaccccaggtctttctctccaccca

SEQ ID NO: 95963 - protein, 201 aa, Zea mays
  misc_feature: Ceres CLONE 1586398
  misc_feature: SWISSPROT Homolog: EC 2.7.7.49 RNA-directed DNA polymerase
GAHRGGGRSRTSGSPGLQEFVSPLEKKIFSVHTDACQFGVGAILMQQDHPLAFLSKALGPKNQGLSTYEKEYMAILLAVNQWHSYLQLAEFWIYTDHISLTQLNAQRLHTPWQQKVYTKLVGLQYKIVYRKGKDNAAADALSRLPHPTASCHAISTSSPAWLQDVIAVYDKNPEAQKLLASLSVQSTPNGTITLHQGSHSL

SEQ ID NO: 95964 - DNA, 866 bp, Zea mays
  misc_feature: Ceres CLONE 1586404
ggagctccccgcggtggcggccgctctagaactagtggatcccccgggctgcaggaattcgtctcacccctagaaaaaaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacgggggagctcgccgcgcggtggcgggaggtccacggcagcaacaactgggagggtctgctggaccccatcgacggcgtgctcctccaggagctcattcgctacggcgagttcgcccagggcacctacgacagcttcgactacgaccggcttcttcccctactgcggcagctgcaagttacccgggcgaggacctttcttccacgaagttcgggcctcggggggcatcgggctatacaaggcaaccccggttaccttctacgcccaccttggaaaggaaccttcaaggttcccccaactttcggggaattaagaaacgggcccgccacaacgcccaaaatatgttgggaacgggaagtcccggggcacgtttttcttcccgggggtaacgggggggaccctgtgtt

SEQ ID NO: 95965 - DNA, 839 bp, Zea mays
  misc_feature: Ceres CLONE 1586405
  misc_feature (222)..(222): n is a, c, t, g, unknown, or other
  misc_feature (239)..(239): n is a, c, t, g, unknown, or other
  misc_feature (249)..(249): n is a, c, t, g, unknown, or other
  misc_feature (256)..(256): n is a, c, t, g, unknown, or other
ctccccgcggtggcggccgctctagaactagtggatcccccgggctgcaggaattcgtctcacccctagaaaaaagtccccaccaggcaatcaagaacaccacctaccgctgacttgtcaattcctgtctgtgcgcgcgcgcgcgcgtggcgccggccgagcggccgttgacccgatgaccggcgcggcggccgtcgatcccccggcgcctcggccgcggcnggctgacggtcctcccngctcatcgcngctcatncttctacgacgtcctcggggagggccctttcgggcatccgaggactccggtcccgcaccggggcgggggggcgccccttgcttcccgaattccctggggcttttcattcggcccctcccccaagtcccccctgggggtcccccctccccgggggaggggccctttggtggcccacgggccccaaaaatttcccccccaacccggggtttttttccccccccaccaaaaaaacccccgggggggaaacctggggggcccccccgggggggggggtggtttccccccccccacccctttttttttgggccccccccccccccccggggggggggggtttccccccccccgggggggggggttccccccacaaaaggggggcgccctggggggggagaacttttttaaaaaaaaccccccctttctctccgcgggggggggggtttttctccaaaaaaaaacaccccccccccccccgcggggggggggggggggggtgggggtttttttttctcccccgggggggggccgtttttttgggggggggggggcgcctctccctccccctaagaggggggggggctct

SEQ ID NO: 95966 - DNA, 820 bp, Zea mays
  misc_feature: Ceres CLONE 1586406
  misc_feature: Encodes the peptide sequence at SEQ ID NO. 95967
  misc_feature (617)..(617): n is a, c, t, g, unknown, or other
ctggagctcaccgcggtggcggccgctctagaactagtggatcccccgggctgcaggaattcgtctcacccctagactgattctgatagtgaagcatcggatgttagcggctctgatggagaagacacctcatggatttcatggtattgcaacttaagagggaatgagttcttctgtgaagtcgacgatgattatattcaagacgacttcaacctttgtggtctcagcagccaagttccttattatgattatgctctcgatctcattttagatatcgagtcatctcatggtgatatgttcactgaggaacaaaatgagctcgtagaatcagctgcagagatgctttatggtctgatacatgcacgatacattctgaccagtaaaggactggctgcaatgctggagaagtataagaactatgacttttggcggtgcccgcgtgtttactgctgtggtaaccatgcctgccagttgggacatcagacatccatcgatctagtaccgtgaagatatactgccccaaggtgtgaagacatctactacccaccgtccaagtaccaagacatcgacggcgcatactttggggaacacgttccctcatctggtccctgatgacntacgaagcactcaaggcacaagaagctcttgcaacgcctttggtcctcccgggctttttggctccaagctccaccaagcctggaacctccagggtttgggcctttaaacccccccaaaaacctggcacttggggggattgcggggagaatttgccaaaccccttgagaaacttgtcaaataaaaacccccctttggcgggggg

SEQ ID NO: 95967 - protein, 70 aa, Zea mays
  misc_feature: Ceres CLONE 1586406
  misc_feature (1)..(70): Pfam Name: CK_II_beta Pfam Description: Casein kinase II regulatory subunit
MFTEEQNELVESAAEMLYGLIHARYILTSKGLAAMLEKYKNYDFWRCPRVYCCGNHACQLGHQTSIDLVP

SEQ ID NO: 95968 - DNA, 773 bp, Zea mays
  misc_feature: Ceres CLONE 1586407
  misc_feature: Encodes the peptide sequence at SEQ ID NO. 95969
ctggagctccccgcggtggcggccgctctagaactagtggatcccccgggctgcaggaattcgtctcacccctagaaaaagatcccgcaggcagtggggtcgatcaacgcggtcgtgggccaggccttcttcgtgcccctgtacgacctcttcctcacctacggcggcatctttcgcctcaactttggccctaagtcgtttcttattgtctccgatccggctatcgctaagcacatcctgagggagaactccaaagcttattccaagggaattcttgctgagatattggagtttgtgatgggtacaggtttgatcccagctgatggggagatttggcgtgttcggaggcgcgctatcgtccctgcactgcatcagaagtatgtgactgcgatgattggtctctttggggaagcttcacaacggctctgcgagaaattggacaaggcagcagtggatggggaggacatggagatggagtcgctgttctctcgactcacgctggatgtcatcggggaaggcggtgttcaattatgatttttgactcattaatctacgattaacgggataagtcgaggccagtggtttgtaacccctaaaggaaaccaaaaatgcgttaacaacttcctcctttaaccaacattgggaaaataccccttttgggaaaggacattttccccccccgggaaaaaaaaaggggcacacaaaaccctcccaagggggaaaaaaaaaggaaccccccccaagaaaaaaaaatttgccccctttcgcgaaaa

SEQ ID NO: 95969 - protein, 78 aa, Zea mays
  misc_feature: Ceres CLONE 1586407
  misc_feature: SWISSPROT Homolog: EC 1.14.14.1 Unspecific monooxygenase
MGTGLIPADGEIWRVRRRAIVPALHQKYVTAMIGLFGEASQRLCEKLDKAAVDGEDMEMESLFSRLTLDVIGEGGVQL

SEQ ID NO: 95970 - DNA, 1221 bp, Zea mays
  misc_feature: Ceres CLONE 1586408
  misc_feature (9)..(9): n is a, c, t, g, unknown, or other
  misc_feature (17)..(17): n is a, c, t, g, unknown, or other
  misc_feature (55)..(55): n is a, c, t, g, unknown, or other
  misc_feature (56)..(56): n is a, c, t, g, unknown, or other
  misc_feature (58)..(58): n is a, c, t, g, unknown, or other
  misc_feature (59)..(59): n is a, c, t, g, unknown, or other
  misc_feature (1221)..(1221): n is a, c, t, g, unknown, or other
gtttttttntttttttnttattattaattctcttaccgcgcacaccacactaaanntnnggcgtttatatcaagctggagctcaccgcggtggcggccgctctagaactagtggatcccccgggctgcaggaattcgtctcacccctagaaaaatacaaccgcgcactccaaacgcgcacgcgctgttcgttcctcggccgctctctccaccccctccttctccgcccccaacagatctccgccggccgtgcggttccttaattcgccttctccgggactgtcggatctccgcggcggctgaggatgggcaacttgctgcgtgacgccgaaagcagccgacgacgccggcggcgggcaagaagcccaaggagctgaagcagaagaagggtaaagaagccgaaaccccttctcgatcgagtacaaccgtttcggggcaggcgagcgcgcccaaactgggtggtgctgccggggatcccacggggccggggaacatctcggcgcggggaacaagcttcggggccgggagcttcgggccgcggggaagttttcgggggttaccttaccctctgggcacaaaaccgcgcccctcaggggggagggggccctgggcccttgtaaaggttcccttcctccccaaaaaaaaaaggcttcccggccacccggctcgtgttgaaccctttcgaagggaaccttgcccgcccgggggagaatatggtgtgggtaaaaaattaacttagttggcgcgccaagcgctttctcctccaaagagggtacacctcccccaatacatgatgttggtttagctcggcgtttttcacagggaggagacgccgcccgtgtgttatccgaggagggggccccggatacaataatttggctcgcggaggggccccaccctaccttgacacaatgggagaaaaacattcaattgaccaagaggagagtgttggggataagcatctctttttcctaagaccctcgtgataatgcggggagccgccccgcgggagaaaccatctaccacctggtgtgaggcgtgtggcggcggcgctcccgtcttgtggtgtcttgttccgcggcaccttctgtttttggggaggccgccttcggaaaatgttggcccacataaagtcatggtggaagtgtgttgagaaagggtgtttctctctcactcccgccaaatatttttctgtgtctgttaacacaaagaaaaaataacn

SEQ ID NO: 95971 - DNA, 888 bp, Zea mays
  misc_feature: Ceres CLONE 1586412
  misc_feature: SWISSPROT Homolog: EC 5.1.3.2 UDP-glucose 4-epimerase
ctggagctccccgcggtggcggccgctctagaactagtggatcccccgggctgcaggaattcgtctcacccctagaaaaaattccatcgtcttcgcttccactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgccatggcggtggagaagacgctgcccggcgcgagtgcggggaggaccgtgctggtcactgggcggggcgggctacatcggtagccacgccgtgctgcagctcctcctcgcgggcttccgcgccgtcgtcatcgacaacctcaacaactcctccgagctgggccgtccgccgcgtcgccgcgctccgcggggggaccactcccgcaaaccttctctttccacaaaaattgatcctccgtgaccaagggaccactgggaaaatgggttttttgctttcttcccagaattttggaagccgggccatttccccttcccccgggaattgaaaagcttgggggggggaaaaacgcttacaagaaaccccttttttttttttttttggcccaacccaccgtccttttggggcccgaaaaaaattttttcttaaaaaatttttttgtttgtttttccccgggtttgcaaaaaaaaattgggggggttttttaaaaaaaacgaggtgggggggttttttggggggtccccccccaaaaaaatctctccccctttgggaagaaaaaaaaattttcccccctgttgccccccaaaaaacatttctt

SEQ ID NO: 95972 - DNA, 796 bp, Zea mays
  misc_feature: Ceres CLONE 1586413
  misc_feature: Encodes the peptide sequence at SEQ ID NO. 95973
  misc_feature (796)..(796): n is a, c, t, g, unknown, or other
ctggagctccccgcggtggcggccgctctagaactagtggatcccccgggctgcaggaattcgtctcacccctagaaaaacccgtgctcctctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaataccttctcgtactatgatcaggtccttgacaccactgccatgctcggcgctgtccccgaacgctactcatggactggaggagagattgggtttgacacctacttctccatggccagaggcaacgccactgtccctgctatggagatgaccaagtggtttgacaccaactaccactttattgtcccggaattgggcccaaacaccaagttctcctatgcttctcacaaggctgttaacgaatataaagaggctaaggcgctcggtgttgataccgtgccagtacttgttgggacagtctcgtacctgttgctctcaagcctgccaaggggtgtggagaagggattcccctctctttcctttctagcagcatccttccagtctacaaggaggtcattgctgagttgaaagcagctggggcttcatggattcagtttgatgagcccactcctgtccctcgacctggatcn

SEQ ID NO: 95973 - protein, 194 aa, Zea mays
  misc_feature: Ceres CLONE 1586413
  misc_feature (2)..(194): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASHKAVNEYKEAKALGVDTVPVLVGTVSYLLLSSLPRGVEKGFPSLSFLAASFQSTRRSLLS

SEQ ID NO: 95974 - DNA, 827 bp, Zea mays
  misc_feature: Ceres CLONE 1586415
  misc_feature: Translation starting site: 186
  misc_feature: SWISSPROT Homolog: EC 5.5.1.4 Inositol-3-phosphate synthase
ctccccgcggtggcggccgctctagaactagtggatcccccgggctgcaggaattcgtctcacccctagaaaaaacacacaacccaaagcagccacagcagcctccttcctcctctcactctcgctcgcgctgcgctcgctacctcgcttcgcattccattcgaaaagaggggaggaaaggcaagatgttcatcgagagcttccgcgtcgagagcccccacgtgcggtacggcccgatggagatcgagtcggagtaccggtacgacacgacggagctggtacacgagggcaaggacggcgcctcacgctgggtcgtccgccccaagtccgtcaagtacaacttccggaccagaaccgccgtccccaagctcggggtgatgcttgtggggcgccgaggcaacaacgggtccacgctgacggctggggtcattgccaacagggaggggatctcatgggcgaccaaggacaaggtgcagcaagccaactactacgggctccctcacccaggcctccaccatcagagtcggcagctacaacggggaggagatctatgcgccgttcaagaacctccttcccatagtgaacccagaccacattgtgttcggaggctgggacattagcaacatgaacctgggccgactccatgaccagagcccaaggtgcctggatattggacctggcagaagcagctcaggccccaccttggagtccatgggggccacttcccgggtatttatgaatccggaacttcttcgcgggcttaaacagggctctccgcgcccaacagtgggtctcctaggggcaccaaagaaaggaacaggggggaa

SEQ ID NO: 95975 - DNA, 2151 bp, Zea mays
  misc_feature: Ceres CLONE 1586419
  misc_feature: Encodes the peptide sequence at SEQ ID NO. 95976
agctacacgctttcgaggctagggttgcctcctcctcctcgccgtccacatggcgcgaatcctcatgcggctcctcctcctcgccgcggcggcggcggtggcggcgggggacggctgcctcaactccggctgcgtcgcgctgggctcctacctcgtcgcccggagccagaacctcacctacatcgccagcctcttcggcaaaaacgactaccacacgctggcgccctacaaccccggcaccaccaacctggactacatccaggccggccagagcgtcaacatctccttcatctgcgactgccacaagttccccaactcggacgccacctacctcggcggctccttcccgcacaaggttgtcaccggcgacacctacggcggcatcgcccagaactacaacaacctcacctccgccgcctggcttgccgtcaccaacccgtatcccacgaacaacatccccgacaccaacaccgtggtgaacgtcacggtcaactgcacctgcggggacccgaagatctcgtcggactacgggttcttcctcacctacccgctcatgggccagaccctcgccgccgtcgccgccaactacagcttcaactcgtcgtcgcagttggacctgctccgcaagtataaccccggcatggacaccgctacatccgggctcgttttcatccccgtcaaagatggcaatggaagttaccatcctttaaaaccaccaggaaacggaggttctataggagctatagtaggaggagttgttggtggtgttgctattctggtcctgggcgtcttgttatatatcatgttctataggcgaaaaaaggcaaacaaggctgccttacttccatcttctgaagattctacccaacctgctactacatccatggataaatctgccttgtcaaccagtcaagctgatagtagctctggagttccaggaattactgttgataaatcagtagagttctcgtatgaagaactttttaatgccacagagggatttagcatgagtaacaaaatcgggcaaggtggttttggtgctgtctattatgctgagctcaggggcgagaaagctgccataaagaaaatggatatgcaggcttctcacgagttccttgctgagttaaaagttttgacacatgttcatcatttgaatctggtgcgcttgattggtttttgcaccgaaagttccttgtttcttgtctatgagttcatcgagaatgggaacttaagccagcatttgcgcggaactggttatgagcctctgtcttgggctgccagggttcagattgcactagattcagcaagaggtcttgagtacattcatgaacatactgtcccagtgtacatacatcgggacatcaaatcagcaaatatcttgatagacaagaactaccgtgcaaaggtcgcagattttggtttaacaaaacttacagaagttggtaatacatcactacccacacgtggaatcgtgggcacatttggttacatgcctcctgaatatgctcggtacggtgatgtttctccaaaggtcgatgtttatgcctttggcgttgtcctctacgaacttatttcggccaaagacgccattgtcagatcaaccgagtcttccagtgattcaaagggattggtttatctgtttgaggaggctctcaacacaccggatcccaaggaaggccttcaaagactgattgatccggcgctcggcgaggattaccccatcgactcgatcctcaagatgacggtcctggcaagggcgtgcacgcaggaagaccccaaggcaaggcccacgatgagatccatagtggtggcgctgatgacgctgtcgtcaaccagcgagttctgggacatgaacgcgatccaggagaaccaaggtgtcgtgaacctcatgtccgggagatgactcctgtccctgtgggctgtggtatatattattgtacgtcctacctgccttcccctgggcaattgtacattagggctcatttgtacggcccgttgacggccagagaggagggccactgtaggtatttacaatgtaatatcttgtcactcaagggttttctcccgtgtttaggctccctttggaacaaaaaggaaatttcctgaacctgtgttttttgctgtattttttaacaaaaaaaaaaaaaaaaa

SEQ ID NO: 95976 - protein, 617 aa, Zea mays
  misc_feature: Ceres CLONE 1586419
  misc_feature (318)..(589): Pfam Name: Pkinase Pfam Description: Protein kinase domain
  misc_feature: SWISSPROT Homolog: EC 2.7.11.1 Non-specific serine/threonine protein kinase
MARILMRLLLLAAAAAVAAGDGCLNSGCVALGSYLVARSQNLTYIASLFGKNDYHTLAPYNPGTTNLDYIQAGQSVNISFICDCHKFPNSDATYLGGSFPHKVVTGDTYGGIAQNYNNLTSAAWLAVTNPYPTNNIPDTNTVVNVTVNCTCGDPKISSDYGFFLTYPLMGQTLAAVAANYSFNSSSQLDLLRKYNPGMDTATSGLVFIPVKDGNGSYHPLKPPGNGGSIGAIVGGVVGGVAILVLGVLLYIMFYRRKKANKAALLPSSEDSTQPATTSMDKSALSTSQADSSSGVPGITVDKSVEFSYEELFNATEGFSMSNKIGQGGFGAVYYAELRGEKAAIKKMDMQASHEFLAELKVLTHVHHLNLVRLIGFCTESSLFLVYEFIENGNLSQHLRGTGYEPLSWAARVQIALDSARGLEYIHEHTVPVYIHRDIKSANILIDKNYRAKVADFGLTKLTEVGNTSLPTRGIVGTFGYMPPEYARYGDVSPKVDVYAFGVVLYELISAKDAIVRSTESSSDSKGLVYLFEEALNTPDPKEGLQRLIDPALGEDYPIDSILKMTVLARACTQEDPKARPTMRSIVVALMTLSSTSEFWDMNAIQENQGVVNLMSGR

SEQ ID NO: 95977 - DNA, 880 bp, Zea mays
  misc_feature: Ceres CLONE 1586420
  misc_feature: Encodes the peptide sequence at SEQ ID NO. 95978
ctggagctccccgcggtggcggccgctctagaactagtggatcccccgggctgcaggaattcgtctcacccctagaaaaaaacactcaaggccacaaaccaaatgctgctaactactccagctagctagcaacaataatggcggcctgccgtccctccggcctcagcgtcttgtgcagcctctaccgtctctacatctgcatgctgttcatccatgtccctcgggctcactcgctgtccttcgacctcagcttctccaaaccccagagcccagacctctcctcccagaagataaacttcaacggcgacgcgtaccccactccagaaacgctcgagctgacgcgaaaccagcatgaccaaagcagcaccaacagcatcggccgggcgacgtacgcgcagccggtgccgctgtgggatggcgccaccggcgagacggccagcttcaccaccaccttcaccttccggatcaggccggactcgtggagcccgtaccccggcgacgggatggcgttcttcctcggccactacgggtcagatatccccgtccagagcggcggcggcatgctcgggctcgtcccgacccacaccaacggcaccggaaacggcaacgtcgtcgccgtcgagttcgacaccttccagaacccgacgaacgacgacatcagcagcaaccacgtgggcatcgacgtcgactccctcaactccacggcgttcaagggaaccaacctcgccgaacaaagaaactcacgtcccggttacctgaaggcggcccaccgtaagggtacgaaaaacttcaccagggttgcttccccctttggaacttcaacggtcaaagaaacacgttcctaattaccgtcaaaagccaacttggttgaattctcaaa

SEQ ID NO: 95978 - protein, 235 aa, Zea mays
  misc_feature: Ceres CLONE 1586420
  misc_feature (29)..(235): Pfam Name: Lectin_legB Pfam Description: Legume lectin domain
MAACRPSGLSVLCSLYRLYICMLFIHVPRAHSLSFDLSFSKPQSPDLSSQKINFNGDAYPTPETLELTRNQHDQSSTNSIGRATYAQPVPLWDGATGETASFTTTFTFRIRPDSWSPYPGDGMAFFLGHYGSDIPVQSGGGMLGLVPTHTNGTGNGNVVAVEFDTFQNPTNDDISSNHVGIDVDSLNSTAFKGTNLAEQRNSRPGYLKAAHRKGTKNFTRVASPFGTSTVKETRS

SEQ ID NO: 95979 - DNA, 1173 bp, Zea mays
  misc_feature: Ceres CLONE 1586424
  misc_feature: Translation starting site: 267
  misc_feature (22)..(22): n is a, c, t, g, unknown, or other
  misc_feature (23)..(23): n is a, c, t, g, unknown, or other
  misc_feature (759)..(759): n is a, c, t, g, unknown, or other
ttgtgtggtttgtttttttttnntagtttctatttgtccacccctatagacccacaacacaaccgggccgaccataggaggaaagagctccccgcggtggcggccgctctagactagtggatcccccgggctgcaggaattcgtctcacccctagaaaaaatcacagacacacaccgctgcttcaagaaaccaccgagagcccaaccgcacaggcaggagagagagcagggagccagggacagtagcgtggggccggggagcaacgatggaggggaaggaggaggacgtgcgcctgggcgccaacaagttctcggagcgtcagcccatcggcacggcggcgcagggcgccggcgccggggacgacgacaaggactacaaggagcccccgccggcgccgctgttcgagcccggggagctcaagtcctggtccttctaccgcgcgggcattcgccgagttcgtcgccaccttcctcttcctctacatcaccgtcctcaccgtcatgggcgtctccaagtccaccctccaaagtgcgccaccgtcgggcattcaaggagcaatcgcctgggtccctttccggagggggatggatttcttttcgccgcttcgttcttacttggcacccgaccgtgcatttctcccgggagggaacaccttcaaaccccaagctggtggaaccttttcgggggcttgagttttcttttggggccaagggaaaaagccttggtcccccctggaacactaggggcgccacaacctntccctaccagttttactccaatgtggcaaaaaggtccccggggaggtgtgcccaaattcctgagttgggaagacaccctcggttagttggggttggaaaaaagggaccttcccccaagacacaggggaggcctttgtttacccattgggggcaaaacacaggcactgggtggagacgccccccaaaatgtttttgtgagcgcccaccccccggggagtgtacccacccacaatggggcgggaattgcggcccactttggggaccccccgataaaaaacatgttatgggggcacaccctagacaaatcgccggggggggagaacacggccgggtgttctctcctcgcggcacaccctcaatttgccacaagaaagggaaataccaccccgaggggaagataccccccaggggtgc

SEQ ID NO: 95980 - DNA, 896 bp, Zea mays
  misc_feature: Ceres CLONE 1586428
  misc_feature: Translation starting site: 157
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaactcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttactttggtagcacgatcaagaatgctgtggtcacagtccctgcctacttcaatgactcacagagggcaggcacaaaggatgctgggggtgaatgctggcccttaatgtgctgcgtatcatcaacgaagccaacggctggcggtaatcccctaatgggctttgacaagaagggcttaccagggttcggtggaaaaaaaattcccccccatctttgatccttggaggggggggacccctttggaagggtcccccctcccctccccctttggagggaaaggaattccttggaggggtccaggggcccccaacctgggggggacaccccaca

SEQ ID NO: 95981 - DNA, 1329 bp, Zea mays
  misc_feature: Ceres CLONE 1586430
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (40)..(40): n is a, c, t, g, unknown, or other
  misc_feature (43)..(43): n is a, c, t, g, unknown, or other
  misc_feature (53)..(53): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (562)..(562): n is a, c, t, g, unknown, or other
  misc_feature (570)..(570): n is a, c, t, g, unknown, or other
  misc_feature (644)..(644): n is a, c, t, g, unknown, or other
  misc_feature (652)..(652): n is a, c, t, g, unknown, or other
  misc_feature (680)..(680): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (699)..(699): n is a, c, t, g, unknown, or other
  misc_feature (700)..(700): n is a, c, t, g, unknown, or other
  misc_feature (712)..(712): n is a, c, t, g, unknown, or other
  misc_feature (1070)..(1070): n is a, c, t, g, unknown, or other
  misc_feature (1290)..(1290): n is a, c, t, g, unknown, or other
  misc_feature (1291)..(1291): n is a, c, t, g, unknown, or other
  misc_feature (1292)..(1292): n is a, c, t, g, unknown, or other
  misc_feature (1293)..(1293): n is a, c, t, g, unknown, or other
  misc_feature (1294)..(1294): n is a, c, t, g, unknown, or other
  misc_feature (1298)..(1298): n is a, c, t, g, unknown, or other
  misc_feature (1309)..(1309): n is a, c, t, g, unknown, or other
nttttggggnnnnnnnnacccccccccccnncnaccccanccncaccccccanacaaccannnncnccnnnctagactccccccggtggcggccgctctaaactagtggatcccccgggctgctggaattcgtctcacccctagaaaaacaaaaaatagattacctgcaaggacaaaattcaaccttcatttggttaaggaaagacgcgcaatggaagagggagtatggaagaatgtcaaagtaagaatgcaatgcccccttgttggcctcaaacacacaaaaatggcctgaaagagggggtggaacccatgagctggatgggaaactggcaggggcctggggaataaatcctgaggggaccagtccttggacatggaattcaggggtttttcttgggggggtataaagggggtgggggcttccaaccacctgaaatgaaaaatggaagttttaccacggacctggggtccaaatgttctgtgtgggggggaaagaaaaaaaccaagtgcttttcataaggatgtatccaggtaagggggttggggtgggcgccccccaaanagaacccnaaaatcaagggggaattggttgttgtgtggcgggaacaaaaggggtgggggtatatattttaaaaacaaagganacaaaaanacccccccaaaaagaaggggaaaaaaanaaaaaaaaaaaaaannnannaaaaaaaaaaanacaaggaaggagccacaaaataaatagaaataactagtgtctcgctgaggaaatggaaaaatatctggggtagtggggcaaaggttgttccccaacaaacaaactggggtggggtttattaaacatggttgacgaaaatacaaaaatatggctcgaaatacagtgaggagttagtgagcgtttccgtgtggggtgataggaggtaggtggagacaacaccctctcataagggagccactatggggggggcgcccgggggccccaacctgggggggagaagcgtaggaggagtactggtgtgtgagaagtaagagaaaggtggtggtgggtggttaacactaagccctatgccttcacntttgttgtgtgatagtggagatctatgatgtttgggtagggggcgcaccaacatgggcgtagtgtggtataggagagtagccaccggtgtggggggttttggcactgggtgtaatgggaaaacgtgatacccagggtgtgaaggggggggtgaggagggggtgggcacgccctctatcttaatgtgtgtgagtggtgtgtgaggctacgaagcaacgtgnnnnngttntggtggtgtgntgatcagttctttaacagtg

SEQ ID NO: 95982 - DNA, 817 bp, Zea mays
  misc_feature: Ceres CLONE 1586432
  misc_feature: Encodes the peptide sequence at SEQ ID NO. 95983
ctccccgcggtggcggccgctctagaactagtggatcccccgggctgcaggaattcgtctcacccctagaaaaagtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagagggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttggggtggtggtaccgggactcagcttttccctctcacaagcacaagggccacccctgctgttcctattggaggatgttacaggcttattgatatccccatgagcaactgtttcaacagtggcataaacaagatatgtgttatgactcagttcaactcagctttctctaaccgtcacattcatcgtacctatcttgggtgggggggatcaaactcactgatgggatctgtgaggtgctggctgcaacacaatgccctgggaagctgcttggtggttccgggcacagcagacgccgtaagaaaattatctgggtactttgagatattacaagcctaaagcttagaaaactttttatttttgtaagaaatcaactct

SEQ ID NO: 95983 - protein, 138 aa, Zea mays
  misc_feature: Ceres CLONE 1586432
  misc_feature: SWISSPROT Homolog: EC 2.7.7.27 Glucose-1-phosphate adenylyltransferase
MLAQTLLSSEHPFGGIMLILMKSLPSFWGGGTGTQLFPLTSTRATPAVPIGGCYRLIDIPMSNCFNSGINKICVMTQFNSAFSNRHIHRTYLGWGGSNSLMGSVRCWLQHNALGSCLVVPGTADAVRKLSGYFEILQA

SEQ ID NO: 95984 - DNA, 960 bp, Zea mays
  misc_feature: Ceres CLONE 1586433
ctccccgcggtggcggccgctctagaactagtggatcccccgggctgcaggaattcgtctcacccctagaaaaaacctcccgtcgtcactccaccgccgtccccttgagcgctcgccccaacctggggacgctcgccccagccgatccgatccgtctcaactccattaaaaaaatctctcctttccccctccctatccaggaaaaggagaaggtaccacctcggtcgatcttccctccatttactcctccgggcgaggtcccgattcgatcgaaggcggcggagagagatgaggaagcgtgagcgagagaacccgtgcgggatctgcgggcactaccacaagtacaggagggggggaagtggtgctccctcgttctttcccttcccacccccaccacctcgctcaacaaccccggattctgggggcccttgcctcctcccaaccaggcgccccgtacgccatgtgttgtcataactgagggtcggtgggcggcccacgccgccgcacttccaagttttcccacaagcggcgcccgcccgttgggggcgctgatgggtaacctcgttgtagaggtggcgccggagactctaaagactctgcccaatggaagtcgttccacaggatgggggggcgcggcgctttcctcttggatgggtcttccggttcgccccctgtcttggtaatgcccttgcccccccggcccttcaatggggcgcggctgctcgcaaattggggtaaatggcccccccactccacaaaggcaggccgtggcccgtgcgtgggtaggagccgcgtaatcgccctaaggccgggtaggggcaagctgggttgggtggtttagtacagaccacgcgtcggttttgccgggctcgcgcgccgaggccttttatcccctctgagtgggcggtgggatgtgagggttccccttgcggccgcactgtgttcctgctcggggtggga

SEQ ID NO: 95985 - DNA, 830 bp, Zea mays
  misc_feature: Ceres CLONE 1586437
  misc_feature: Encodes the peptide sequence at SEQ ID NO. 95986
  misc_feature (767)..(767): n is a, c, t, g, unknown, or other
ctggagctccccgcggtggcggccgctctagaactagtggatcccccgggctgcaggaattcgtctcacccctagaaaaaaaccgaagcagcgacagagttcctccctcccacacgctcggcgctctctccgccagaaatctcgtcgctggtagaagagactcgtgccatttgtcatgtcaggaggatcttcaccatcatcaaggcgaaacagctttaattctttgtctaaggacctagaccttccatcagagcaaggttgtctctccattgttgtacttggggcatctggtgaccttgctaagaagaaaactttcccagccctctaccacctctttgagcagggattcatacaatctggagaagtccatatatttggttatgctagatcaaacctttctgatgatgggttaagagaacgcattcgtgggtatctcaaaggagccccagaagatctttcagattttttgcaactaataaaatatgtcagtggttcctatgatactgggagaggatttgagaaactgaacagggcaatatcagagtatgaggtgtcaaagagttcaggaagctatcgcaggctcttttatttggcattgcctccatctgtctacccttcagtgtgcaaaatgatcagaacatattgcatgaatccatcttctcaccttggatggaccagagtcattgttgagaagccctttggaaaggacctgggattccgctgaagaattaagtgccccactttggggagctattcgaggaacaccnactatacagaatagaccttacccggggaaaagagtagtcaaaaactgccttggtcctccgttt

SEQ ID NO: 95986 - protein, 182 aa, Zea mays
  misc_feature: Ceres CLONE 1586437
  misc_feature (33)..(179): Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
MSGGSSPSSRRNSFNSLSKDLDLPSEQGCLSIVVLGASGDLAKKKTFPALYHLFEQGFIQSGEVHIFGYARSNLSDDGLRERIRGYLKGAPEDLSDFLQLIKYVSGSYDTGRGFEKLNRAISEYEVSKSSGSYRRLFYLALPPSVYPSVCKMIRTYCMNPSSHLGWTRVIVEKPFGKDLGFR

SEQ ID NO: 95987 - DNA, 860 bp, Zea mays
  misc_feature: Ceres CLONE 1586439
  misc_feature: Encodes the peptide sequence at SEQ ID NO. 95988
tggagctccccgcggtggcggccgctctagaactagtggatcccccgggctgcaggaattcgtctcacccctagaaaaactcagactcctcccggaccagctgacctccgctccattcaccccacaccttcttcttcgtcgtcgtcttcccctgctgcggttagcctggccgtggccgcctcctgctcttcgatctcacgctgcgatggagcggtacgaggtgatcagggacatcggctcgggcaacttcggggtgacaaagctcgtccgggacgtcaggaccaaggagctcttcgccgtcaagttcatcgagagagggcaaaagattgatgagcatgttcagagggagattatgaaccaccggtccctgaagcacccaaacataattagattcaaggaggtaatttctcagacatcttggaaaggaaatgttctggtacgaatttgaagttggatgattggtagctacacacgtaagtgtcttcaaactgttacttttgatgcttttaaagaagaaaaaatacagactttttatattctttgcctgttgaacgagatgtttgagccacacttgtgaacattgtgctggtgactgcacgttcttagaaacccattcatttacccactaatacgtatctctcattttttttaataaaaggagttggcctttgtcttggacctattccctagaaacatctttccattcatcattggacacctgctttaaactgaatgtcaaggtctaatcatcaccaaacattttctagggttgaaaaattaaggtggtcccttggttttttcagggccgggcctaaccccccacgcattttggcaataaggtatggggaaaaatgccgggc

SEQ ID NO: 95988 - protein, 80 aa, Zea mays
  misc_feature: Ceres CLONE 1586439
  misc_feature: SWISSPROT Homolog: EC 2.7.11.1 Non-specific serine/threonine protein kinase
MERYEVIRDIGSGNFGVTKLVRDVRTKELFAVKFIERGQKIDEHVQREIMNHRSLKHPNIIRFKEVISQTSWKGNVLVRI

SEQ ID NO: 95989 - DNA, 1242 bp, Zea mays
  misc_feature: Ceres CLONE 1586440
  misc_feature (25)..(25): n is a, c, t, g, unknown, or other
  misc_feature (38)..(38): n is a, c, t, g, unknown, or other
  misc_feature (40)..(40): n is a, c, t, g, unknown, or other
  misc_feature (43)..(43): n is a, c, t, g, unknown, or other
  misc_feature (975)..(975): n is a, c, t, g, unknown, or other
aaaaaaaaaatcccctgggtccccnatcagaaaaaatntnatnctcctcaatcaaaaatatgcggagttcaacacaactggaactccccgcggtggcggccgctctagaatagtggatcccccgggctgcaggaattcgtctcacccctagaaaaacacaaggctgaacgcttgaaccagaacctccaaagcaccaaccccagcagctttagctcctcctcatcgcaaccacagcgccgtcccctactcttccagcgaccaactgctgtctctccggcgactgcagaaccgtctctgcaggtgcaaggagggacccaggagatcagtctggggctgctcaacaaagaccgcagccaccttgtctccgggaagccgtaaagccctcgagatgccgctctgtcatcactgctaaagtcacccaggggcgtcctgcgactcctggcagccaaacccccaagccaaagcccacccagatgggcgtaccccaggcctgaaagcgctcggtgaagcttctagaactatggagagcgggaaaaatacccgaaagccgccatctatttgaattgcgaacccggaccacccctttccgcttacacgcatatgaggagaaccccaccggatgaccgttgaaacctccctcttatccctccctaagggcctcaggggcccaattgatcggcacactaaaatgtctgaccctcgccagccctcccgcggcaattgtgaagccctttggacaccatcaaatgcggacgccctccccatagtgtctttggaaattgacaacctaatagcttcagcactagagcggcaccttcatggcctcatctctcagaatgtagagcgtatataactcttttgacatcgtgggaactcagcggcggtcccaatagtaagagcgcggcccacgcgagggtatagcgctgtatgcatggcggggatagatgaagaggtgcaacgaaaatcgtgcgaggngggtacagacctatgcttattattatatccacaattaggcgaaaatcaggaatcctctcaatcggtgagacaaaatgaatgagcgcgtcaggttcgcggccaaaaagtctggtactcccccctaccacgagctctagtggagaacactacacgcacacgagatgcagagatacagcatcttaccgcacagcaagacactcgatccacaatgaacggctcaccgtgtctgaggggggaacgacaaatagtcgacgtgcataataaacg

SEQ ID NO: 95990 - DNA, 815 bp, Zea mays
  misc_feature: Ceres CLONE 1586443
  misc_feature: Encodes the peptide sequence at SEQ ID NO. 95991
  misc_feature (733)..(733): n is a, c, t, g, unknown, or other
ctggagctccccgcggtggcggccgctctagaactagtggatcccccgggctgcaggaattcgtctcacccctagaaaaaatccctcaccctttgcaaaaatcacagcggcaggggtcagcaaaaatctccatgcccacgctcggcctagatctcccgcgaaccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctgctcgccaggttccggcggctcgagtcgctcgcgctcaaggggaggccccgcgccgccatgtacgggctcatccccgtagacttcggcgcctacgcggcgccctgagtcgccgagctcgccgcgccgctcgactgcctcaggcgctccacctgcgccgcatgaccgtcaccgacgagggacatcgccgtgctcgtccgcgcgcgcgggcacatgctacaggtgctcaagctcgacaagtgctccggggttctcacggacgcccctcgcctcgtcgcccgctcctgcagatctctgaagactttggtnctgggaagatgtatattgccgatgaaagaagcggatggctcattgactccgcggggaacatttctggtctggggacactgac

SEQ ID NO: 95991 - protein, 108 aa, Zea mays
  misc_feature: Ceres CLONE 1586443
MGGEVPEPRRLSRSLSFGCGGVPEEALHLVLGYVDDPRDREAASLVCRRWHRIDALSRKHVTVGFCYAVEPARLLARFRRLESLALKGRPRAAMYGLIPVDFGAYAAP

SEQ ID NO: 95992 - DNA, 869 bp, Zea mays
  misc_feature: Ceres CLONE 1586446
  misc_feature: Encodes the peptide sequence at SEQ ID NO. 95993
tccccgcggtggcggccgctctagaactagtggatcccccgggctgcaggaattcgtctcacccctagaaaaaaagggagaaaatgttatgcttgcttgccttgagggaagcgtcgccgtctgcccacacccgcaccgcacccaaccgcagcggagccgggagccgaaggccgagggtattcttccttcgccgctaagcacgcctcctctccacaggcagccgacccaggggaagcgtcgccgtctgcccccaccccgaatctgatgcttcatcgattggttctaatcctcactacctccatattcatgcacgagattgcgggtgattaggagcagggaccaatcatattgaactcagatttggagcggagcaggaggggagccattgcccgtgttctgattgctgctagaggtcgagggatggtaggggtgctgtcgaatcgcgtggatcgggacgacctcaaggccggggatcacatctacacttggcgggccgcctacatctacgcccaccacggaatatatgctggagatggcatggttatccatttttacaagggcagctggaacatgagattgggaacaggaaacattcttgggactgggttccctttaaagctccctctccgggcagcaactggagggttcttccctgcccagaaaaggggggccacctaagtcaagtcccgaaggggggtcattcacctccttgccccccaattggcttcctaaaagggggggccggccctgtcacttctttggaactacccttgggtcgccctggctttttttcccctcgccaaaaacacgggggaaggaaaagtggcccccttgggctggcctttggacccccatgtgaccttttttag

SEQ ID NO: 95993 - protein, 85 aa, Zea mays
  misc_feature: Ceres CLONE 1586446
MVGVLSNRVDRDDLKAGDHIYTWRAAYIYAHHGIYAGDGMVIHFYKGSWNMRLGTGNILGTGFPLKLPLRAATGGFFPAQKRGAT

SEQ ID NO: 95994 - DNA, 857 bp, Zea mays
  misc_feature: Ceres CLONE 1586449
  misc_feature: Translation starting site: 195
  misc_feature (693)..(693): n is a, c, t, g, unknown, or other
  misc_feature (809)..(809): n is a, c, t, g, unknown, or other
ccccgcggtggcggccgctctagaactagtggatcccccgggctgcaggaattcgtctcacccctagaaaaattcccgttccccaattcgaaatcgagtcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtccctcaatggaaggaggtgatcagcacaggagtcgtgccccgattcattgagttccctacacgtgaggaccatccacaactccagtttgaggctgcatgggcgctcaccaacattgcatcaggcacatcagagaacactaaggtgggtggttgagaagtggtgctgttgcccatctttgtnaagctccttcactccaatagcggagaattgttcgtgaacaggctgtatgggcttttaggtaaatgttgctgggtgactccccaaagtggcctggatcttgggcctaggcccatggnggggctatttccctttgcttgcaccgccttaaatgagcatgcttaact

SEQ ID NO: 95995 - DNA, 859 bp, Zea mays
  misc_feature: Ceres CLONE 1586451
  misc_feature: Encodes the peptide sequence at SEQ ID NO. 95996
  misc_feature (584)..(584): n is a, c, t, g, unknown, or other
  misc_feature (859)..(859): n is a, c, t, g, unknown, or other
tggagctccccgcggtggcggccgctctagaatagtggatcccccgggctgcaggaattcgtctcacccctagaaaaacagtgtcctccgcatctcccgtctctcctgttccgcctcccctccgatctccgccgcatcacctccctcgaaccctagacccacccgcgccccccattgcctccggccgccatgtctgccactcagcttctccgtcgctcccgcaagctgcagagtttgcaaaatgctgtaggttgtgagaatttttttcggcatttctccagtggttccggatcctttatcgccaaggaaaatggtgttggaaaaagaaccagaggtaccagattttcccagcaataccagcctacaaaagagcttgaaccattctcactaggagtaaatggaaactgcacttggagaagagcatccaacagccttaccccaagtgctgctagttggctcaatggttcattctcatgtggacaggtagtttcagcacggacattctcaagtagtgcagacctgcctccacatcaagaaattggaatgccttcactttcacctaccatgactgagggaaacattgncaagtgggcttagaaggatggagataaggtctccccctggcgaaggtctctgtgaagtgggaactgataaagccactggtggagatggagtgcatgggaagaggggctatctgctaagatactccatggagatggtgcaaaaggagattaaagtgggtggaggcaatggctataactgtgggaagaggaagtggaccttggagaagttttagggattataagccgccatcctcagctgaaacctgtagctcctggctgaaccaaaggctcaaccn

SEQ ID NO: 95996 - protein, 135 aa, Zea mays
  misc_feature: Ceres CLONE 1586451
  misc_feature: SWISSPROT Homolog: EC 2.3.1.12 Dihydrolipoyllysine-residue acetyltransferase
  misc_feature (132)..(132): Xaa is any aa, unknown, or other
MSATQLLRRSRKLQSLQNAVGCENFFRHFSSGSGSFIAKENGVGKRTRGTRFSQQYQPTKELEPFSLGVNGNCTWRRASNSLTPSAASWLNGSFSCGQVVSARTFSSSADLPPHQEIGMPSLSPTMTEGNIXKWA

SEQ ID NO: 95997 - DNA, 847 bp, Zea mays
  misc_feature: Ceres CLONE 1586453
  misc_feature: Encodes the peptide sequence at SEQ ID NO. 95998
  misc_feature (605)..(605): n is a, c, t, g, unknown, or other
tggagctccccgcggtggcggccgctctagaactagtggatcccccgggctgcaggaattcgtctcacccctagaaaaaagccgggtcgagaggtggggagcagagggttcaagggaggggacaggtcgagcagctcacctttctctgctcgagaacgagaggagctcccgtcttttgcttgctgtgccgggcgctgctgaaggttcagctcagtccgatggcgttgagcggcagagctctgctcttgttcaagctgctgctgctgctgctggcgtgcctgctcttcctcttggagctgtcccgaggcaaggaagaagcattcagcctgaggaacctcccgcccttccacaaggccagcagctaccccgcggggtgcccgacgacgtacgactacatcatcgtcggcggcggcaccgcggggtgcccgctggcggcgacgctgtcgcacaggtacagggtgctgctgctggagcgcggaggctccccgtacggcgaccgcaacgtctcctacatgcagaacttccacatcgggctcatgaacatgggcgcgggactcgccgtcgcaggccttcatctccaccgacggcgtcatcatgcccgggcnagggtgttggggcggtgggacctgcatcaatgccgggcttctacagccgggggcagcccaagctttatcccaggagcccggctgggattgaggacttggtgacaaatcataccccttgggtagaggaacaagattgtccaggtggcctaaagatcgccgctttggcaggcggccctaccgggatgggctgcttacaagcaggtgtagccccccttcaatgggtacccctaacaatcatgtct

SEQ ID NO: 95998 - protein, 162 aa, Zea mays
  misc_feature: Ceres CLONE 1586453
  misc_feature: SWISSPROT Homolog: EC 4.1.2.10 Mandelonitrile lyase
MALSGRALLLFKLLLLLLACLLFLLELSRGKEEAFSLRNLPPFHKASSYPAGCPTTYDYIIVGGGTAGCPLAATLSHRYRVLLLERGGSPYGDRNVSYMQNFHIGLMNMGAGLAVAGLHLHRRRHHARARVLGRWDLHQCRASTAGGSPSFIPGARLGLRTW

SEQ ID NO: 95999 - DNA, 1204 bp, Zea mays
  misc_feature: Ceres CLONE 1586455
  misc_feature: Encodes the peptide sequence at SEQ ID NO. 96000
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (33)..(33): n is a, c, t, g, unknown, or other
  misc_feature (1054)..(1054): n is a, c, t, g, unknown, or other
ttttgttttttttannnttcgaagacccgcacnatcgatcccctaagcagtataaaaaggaataacaaaaaacaaaatggaactccccgcggtggcggccgctctagaactagtggatcccccgggctgcaggaattcgtctcacccctagaaaaagcctacggcatattcccccgaggccccgaaccaaaccaaactaaaccagcccagatcagcgaaacacactccgctctcccgagaccggacacatggcggcggcggcggtgacgtccaacggcggcgcagtggccgcaaatgggccggcgcccggccggctggcctccgtgtacagcgaggtgcagacgaaccggctcctgcacgcccttcccctcccctccgtcctccgctccaacttctcggtcgtcgacggccccgccagctccgccgcgggcaaccccgatgagatcgccaagctcttccccaacctgttcggccagccctcggcgtcgctggtgccgtcggccgagccccgcggcgaccaggccgctcaagaacggcgttggtgctcttccggtggacaggccgccggggcgggccacaatggtcatcttgcgggcatcttttgaactattctaacaggaagcgtggcaaaaaggcagccaccctttggtatggggatttaaagggggaggccccaagcttggggaatcattgaaaattgccaaaggttttggtaaggacactttcactttttcaaaacctttttgggggggtaatcccccctaaccacggaaaaaatcttggggggggggggaaaatttttggggaaaatttggaaatctcttgggcccaattgtgggaaaagggggggaaacaacaagaaatattggcaaaaacaccccccgcggggaaacgcagagttttttataaaggtcaaaaggcctctgtaaaaaaaaaaaagcggggcctacaaaaagaaaggcccttgggagaattttgggggagatgcgagaccctttggtttgggtctacaatacggaggaggggggtgatatagaaattctcaaaaaccccncccaaatggggcccgggggccctctctttgggggtgcaaaataatacattttaaaggggctaaagtggaaaaaattggtaaaaacacccccggggggtttatattggggggtgggccccccaaagagagaatatccgtgggtggggggag

SEQ ID NO: 96000 - protein, 118 aa, Zea mays
  misc_feature: Ceres CLONE 1586455
  misc_feature: SWISSPROT Homolog: EC 2.7.1.90 Diphosphate--fructose-6-phosphate 1-phosphotransferase
MAAAAVTSNGGAVAANGPAPGRLASVYSEVQTNRLLHALPLPSVLRSNFSVVDGPASSAAGNPDEIAKLFPNLFGQPSASLVPSAEPRGDQAAQERRWCSSGGQAAGAGHNGHLAGIF

SEQ ID NO: 96001 - DNA, 838 bp, Zea mays
  misc_feature: Ceres CLONE 1586458
  misc_feature: Encodes the peptide sequence at SEQ ID NO. 96002
ctggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatgggttctatcaagatgcgtgagattgctgaagcttaccttggtagcacgatcaagaatgctgtggtcacagtccctggctacttcaatgactcacagaggcaggccacaaaggatgctgggggtgattgctggccctaaatgtgctgcgtatcatcaacgaggcaacagctgcagctatcgccttatgtctttgacagaaagctaccagtggtcggtgagagaatgtcctcatctttgaccttgggaggtggaaccttttgaaggccccctccctccccattggaggaaggaatcta

SEQ ID NO: 96002 - protein, 171 aa, Zea mays
  misc_feature: Ceres CLONE 1586458
  misc_feature (9)..(172): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMGSIKMREIAEAYLGSTIKNAVVTVPGYFNDSQRQATKDAGGDCWP

SEQ ID NO: 96003 - DNA, 846 bp, Zea mays
  misc_feature: Ceres CLONE 1586459
ctggagctccccgcggtggcggccgctctagaactagtggatcccccgggctgcaggaattcgtctcacccctagaaaaaagccaccggccagcgtcgttcgctttgtagcagtccagctctgcgcccggcgccgcagccccgcatcgcgcacaggcacaacttctacggtcctgccgctgatcgccgcacgtggccgcgccgccgcctccctcacccgagctcgaccgcgcttctccagctcgccgcctcgacggtcgctgcctcgacacctcccccgcgtgggcatcagccgggagcagagagccctggtccctggaggcgcgtcgcgttacggcgggggcgcggcctccccagccccccttggtgatcggtcctcccccggcagactcgcctcctcggtcttgcgctcctgcgcggctgcgcgcccagcgccgtgcccggtggcggcggcgaccggcgacggtcagcccccgacagtcaggacttccgactccggcccttccccctcagccccctctgtccgttccagtcccagctcgagcttggaggttgaaacaacaagcaagatattttgaaatagcccccgccacgaaattcttcagccatccgtggagggggttcagtcaggggaagactcgactcagggaacaagagcaccagcggaacagaaaggagtcatggccggatgaggtggaacttgctgcggaacaacaagttcgctaaattgttcacggggaaaaaaagaaggaactctttgaatccctggggaaggaagaaattcgccttaaaaggggcctacgggggccttaacacgcttgaacttcctccaaaacttcctggccgt

SEQ ID NO: 96004 - DNA, 868 bp, Zea mays
  misc_feature: Ceres CLONE 1586460
  misc_feature: Encodes the peptide sequence at SEQ ID NO. 96005
aagctggagctcaccgcggtggcggccgctctagaactagtggatcccccgggctgcaggaattcgtctcacccctagaaaaacttcccttttacgcggttccccctaactcccagctctctcgttcaggcgcgctctctctagccggcgacgattgggcgaccggcgccactcaacgccaggtcttcgtgaaaaccatcgccggcgatgagtttcaaccagtctactgtcaaggggcaggccaggagggagaggcctagggctcgccctcatggcctgacgcagcagaggaggcaggaaataaaggaagcctttgatctgtttgatacagataactctggaaccattgatgcaaaagagctcaatgttgccatgagagccttgggatttgagatgactgaagagcaaattaggcaaatgattgctgatgttgacaaaagatggcaggtggaggcgatcgactacgagggagttgagcacatgatgactgccaaaatcggagagagggatagtaaagaggagctttcaaaagcattccgcattattgatcaagatgggaaaatggaaagattttctacattgatatccagaggattgccaaagagctggggtgtaaaatctcaccctcgatgagatcccaaagacatgggtggcaagagggctgataaaaaatgggggacgggtgaaatagaactttggaccagtttcttccgggattgatggaaggaaggaccccgcttttgggcctacccagggtggcaatttttatcttgccgaagtggcctttgaccgcctttcccaggttttgttttaatgaaccccaccccgggggcggtgggtgttaaaattccaaccgcgggggtgctgg

SEQ ID NO: 96005 - protein, 141 aa, Zea mays
  misc_feature: Ceres CLONE 1586460
  misc_feature (31)..(59): Pfam Name: efhand Pfam Description: EF hand
  misc_feature: SWISSPROT Homolog: EC 2.7.11.1 Non-specific serine/threonine protein kinase
MSFNQSTVKGQARRERPRARPHGLTQQRRQEIKEAFDLFDTDNSGTIDAKELNVAMRALGFEMTEEQIRQMIADVDKRWQVEAIDYEGVEHMMTAKIGERDSKEELSKAFRIIDQDGKMERFSTLISRGLPKSWGVKSHPR

SEQ ID NO: 96006 - DNA, 871 bp, Zea mays
  misc_feature: Ceres CLONE 1586461
  misc_feature: Encodes the peptide sequence at SEQ ID NO. 96007
ctccccgcggtggcggccgctctagaactagtggatcccccgggctgcaggaattcgtctcacccctagaaaaagggcccgcagttgaaaccgccagccgttccttcccacgctcctccccgcccccggtccgccccccacctcaattccacaccccgcggcgaggccgcggggcgcccacgcccaaacgccaaaaccctagctccccacccacccacccaccccaagcaccgcggggccgccgcgcgctcgcccacggtcgccacggatgcgcgcggcccgctcgcggacctcgacgacgccccgctcgcgtgccgcggctgttccgccatggacgagcccgagaaagtgaggggcagggaggatgcggcgtcgggccgcgaggctggcggcgccgaggaggccggggatgggttccagctcgtgatccatggcaagaagaagaagagggcggccagcggccaagactgcgggactgtgcgggcgttgaccagggagaaaggagccgcgccggcgccggggggccaaggccaaggtgccctttccacgatccaagcattccccggccgcggggactatacaaaatccgagtgggataaactacaagccattcaaggcatggtctggctgggaacgcagcgaagacggcacccgacgtgtttcaccgggtggaaaaactgcctgggtgaaaagttcggtggacaaaaaggttccctgacagaaaaaccaggggaacccagcctgatttagaaggaaacacccattttcccccggggtcaagaatacacaaggggttaaaaaaaatttggctaaaaagttggaaaagccgaaactgaaatttgccctgtagaaactgagagcaaaatacaaa

SEQ ID NO: 96007 - protein, 139 aa, Zea mays
  misc_feature: Ceres CLONE 1586461
MDEPEKVRGREDAASGREAGGAEEAGDGFQLVIHGKKKKRAASGQDCGTVRALTREKGAAPAPGGQGQGALSTIQAFPGRGDYTKSEWDKLQAIQGMVWLGTQRRRHPTCFTGWKNCLGEKFGGQKGSLTEKPGEPSLI

SEQ ID NO: 96008 - DNA, 857 bp, Zea mays
  misc_feature: Ceres CLONE 1586462
  misc_feature: Translation starting site: 198
  misc_feature: SWISSPROT Homolog: EC 2.3.1.119 Icosanoyl-CoA synthase
aagctggagctccccgcggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtgggggggaggccacctacgacctcgccaccgtgctcgccttcctcgccggtctcgccttcaccatctccgtctacatcatgtccagggccaggcccggtgtacctcatcgacttcgcatgctacaagccggccgacgaggctcaggtgtccaaagcggagttcatccgacttggggcgcaagtccggcaagttcgacaaggacagccgggcgttcccagtcgcggtctgctgggccaagtcggggatccgggacaagtcgtaaatggccggcctgcgtgtttcgaggccaacgccagctgggcccaccatggaaggaggggccccccccaagggttccacgggccttgtttcccggggcctggaacaaactgtttccaaaaaggggcct

SEQ ID NO: 96009 - DNA, 895 bp, Zea mays
  misc_feature: Ceres CLONE 1586463
  misc_feature: Translation starting site: 148
  misc_feature: SWISSPROT Homolog: EC 1.1.1.95 Phosphoglycerate dehydrogenase
ggagctccccgcggtggcggccgctctagaactagtggatcccccgggctgcaggaattcgtctcacccctagaaaaagccctgcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctcgcggcgcgcggcggggccggggccggcgcgcgtctccgcgtgaggtgcgcgatcttgtcgtcgcccgcgcccgtggcgcccaccgagtcgaggccggcgcgccggatctccccgtccgcgccggacggcgcgctgcggcccaagccggcgggtgctggtctcccagaagctgaacgaggcctggctggccgtgctgcggcagttcgcggacgtggaatgcgcctacggcatgtcccccgcggagctcctcgccaaggaggcgcaggtccacccgctccatcgtgcggagcgggccccaaggggactccggaaggtgcctggaagcccgggcaggggcccggctgccgggtgggtgggccccccccgggcgttcggggaatggtaaacgttcgaccttcccggcccgccccccaaaggtccggggggccttcattcgccaaagaagccccccgtcccaaatacattcgccgcgggcaaaacaacgggttccccgttggttcgccccgggggcgggggagaactctcaaaggggggaaccgggccgctcaaggccgggtaaatggggaaaggaagcagggtccggggggggttcctccggggggaaaaaaaccttgccccgttatgggccttcgggagaagtggggggcaaaag

SEQ ID NO: 96010 - DNA, 826 bp, Zea mays
  misc_feature: Ceres CLONE 1586464
  misc_feature: Encodes the peptide sequence at SEQ ID NO. 96011
  misc_feature (506)..(506): n is a, c, t, g, unknown, or other
ggagctccccgcggtggcggccgctctagaactagtggatcccccgggctgcaggaattcgtctcacccctagaaaaacgcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggnagaccctgtggaaaacattggagctaaaatgggtcaggcagctgcagctaggaccaacgatcttgctggagatggggacaccaccttctgtgtcctggctcaggggctgattgctgagggtggttaggccgtaacaactgggggctaacctggtcaaattaccccgggggattgagaaaacagcttaaagcccttggttgagaaattccggaaagtgtcttaagggggttgaaaaaaaggggacctttcaaaagttttccttccatttagggggggggaccacactcttgaaaattgggaaactgggaattccgaagggt

SEQ ID NO: 96011 - protein, 138 aa, Zea mays
  misc_feature: Ceres CLONE 1586464
  misc_feature (97)..(97): Xaa is any aa, unknown, or other
MASTFGATSTVGLMAAPTGKNVRLQRRANFRVKAAKELYFNKDGSAIKKLQTGVNKLADLVGVTLGPKGRNVVLESKYGSPKIVNDGVTVAREVELXDPVENIGAKMGQAAAARTNDLAGDGDTTFCVLAQGLIAEGG

SEQ ID NO: 96012 - DNA, 915 bp, Zea mays
  misc_feature: Ceres CLONE 1586470
  misc_feature: Encodes the peptide sequence at SEQ ID NO. 96013
  misc_feature (481)..(481): n is a, c, t, g, unknown, or other
gagctccccgcggtggcggccgctctagaactagtggatcccccgggctgcaggaattcgtctcacccctagaaaaaaaaaaatcagactcctcgtttccctccctatcctctctcgtcacgccgttgtcgtcccgttgctcgattcgaaggcgcgacccttcgccatcgctcttgcctcgccttgccggcggcgccaatacccgtgctcgcgtcggagcgcccaacttccccacggtggccgttccgccgcggcgcacgcaggtgggcgatgcggtcggatgagtgggcggcggcggcggcggcggcagtgtttcgtggaaaggaggaggaggggggccttgtgctttcccgcggcgttgctgtctccgccgcatacgcccctcggagccggtgatggccccgaccgcggagtcgtcttccccgtcgccgcaaacgtcgcccccgcacgggcccatccccccggggctgaagaatctcancaatacctgctacctcaactgcgtcctacagtggctcgggttcaagccgccccttggcaaggttctgcctttgcctctggccactccgacatttggcaagaagggggtcccccataagggaaaagggaagtgccccgttctgcctggcttgaagcgggaagatcgcccccggcttgctttcgggcaaattgctggggggcgctctccattcccccggccaaagggaaaaacccgctggcagggcccccctatttgggtgaaacacccttaaggggggggggggcccccccgaagggaatgcccccccaagatttccccctccgcctttttgggggaaaaagagccctgttaacacagggggtggggcccccgcgcaacgccgccaaaagttgggtttttcttcttttaaaaggggggcccaaaggggatacacc

SEQ ID NO: 96013 - protein, 118 aa, Zea mays
  misc_feature: Ceres CLONE 1586470
  misc_feature (29)..(29): Xaa is any aa, unknown, or other
MAPTAESSSPSPQTSPPHGPIPPGLKNLXNTCYLNCVLQWLGFKPPLGKVLPLPLATPTFGKKGVPHKGKGKCPVLPGLKREDRPRLAFGQIAGGRSPFPRPKGKTRWQGPPIWVKHP

SEQ ID NO: 96014 - DNA, 869 bp, Zea mays
  misc_feature: Ceres CLONE 1586472
  misc_feature: Encodes the peptide sequence at SEQ ID NO. 96015
ctccccgcggtggcggccgctctagaactagtggatcccccgggctgcaggaattcgtctcacccctagaaaaaagaccacacaccacagcactaaaatctgttcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaaccagaacaagcacgtcgtgcaggacatggttaggttcggccagcaatggaactatgggctcgaggctggctccaagccaaaactgctcatcgccatgagctgcctccccgtcacccaagcccgagcccagcccgtacttgatctgcaacggctacaagggacccgactacatcggggctcccgctcttgggccggggccatgggccctgaaaccccatccattcgggctccaagaatgggaggaagaaccttggccattcgtccctccgaaccagtaaaagaaaacgcttcctcccaaaaaccttgcccaaaacaaacaaaattcccgtgtgccccaaaaaaatttccagggcccgggttaatttggggaatctccgccccccaaaaaattttttct

SEQ ID NO: 96015 - protein, 240 aa, Zea mays
  misc_feature: Ceres CLONE 1586472
  misc_feature: SWISSPROT Homolog: EC 4.1.1.19 Arginine decarboxylase
MDKNYGELYNILGWGEEYFAVNTEGHLSVKPFGRWTEPGQEIDVHSVIVEALATQPNDSTSKSQFPMILRFPDVLKNRIETLHNAFNSAMESTGYTSRYQGVFPIKVNQNKHVVQDMVRFGQQWNYGLEAGSKPKLLIAMSCLPVTQARAQPVLDLQRLQGTRLHRGSRSWAGAMGPETPSIRAPRMGGRTLAIRPSEPVKENASSQKPCPKQTKFPCAPKKFPGPGLIWGISAPQKIFS

SEQ ID NO: 96016 - DNA, 833 bp, Zea mays
  misc_feature: Ceres CLONE 1586474
  misc_feature: Encodes the peptide sequence at SEQ ID NO. 96017
  misc_feature (550)..(550): n is a, c, t, g, unknown, or other
agctccccgcggtggcggccgctctagaactagtggatcccccgggctgcaggaattcgtctcacccctagaaaaaacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaagggcttgggtaaatcattattgaaagcatctcccttttacatgtaaccttgcatacaatatctgttaagatgagttcactaaataaagttgtttcaaatagtggagatgcatgttcagtcttagctagtaaagtcacatcattaaatcccaatgcagcggagtttgtaccgtcatttgttaaccatcttttgggaatggtacangtctagataagtcagatttcaggggttcttctggaaaaaacattctagatagggctgagccatcaaagtctaataactcagatgatggagcacaccagttttggcataagcagcttccggatgacattattcaggacttcactcttttgagaaagtggacaggggcctgaactgtcctttgctgggatatccttgaatgcccccccttttaggaaaaacttcagtccgctttcagaagaattcccgaaatatcctcccccgttccaagggtcttggactggac

SEQ ID NO: 96017 - protein, 46 aa, Zea mays
  misc_feature: Ceres CLONE 1586474
  misc_feature (20)..(37): Pfam Name: PAM2 Pfam Description: Ataxin-2 C-terminal region
  misc_feature (45)..(45): Xaa is any aa, unknown, or other
MSSLNKVVSNSGDACSVLASKVTSLNPNAAEFVPSFVNHLLGMVXV

SEQ ID NO: 96018 - DNA, 1232 bp, Zea mays
  misc_feature: Ceres CLONE 1586479
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (1232)..(1232): n is a, c, t, g, unknown, or other
aatttttaaatnnnncaacaccaacggctctctctgntnnattnncccgcggggaccaaaaaacacaaagaagaacgcgagctcaccacagtggcggccgctctagaactagtggatcccccgggctgcaggaattcggctcacccctagaagaaatcgcgctttctccgcttccttctttcccctcacagggtcagaccccaacgccgggagaataggggattaggagccagacctggcggcgccgggcgtccaagaaacgctgcctaataaaatccctccggcgtctgtcgtcttgaccgcggcggcgcaggcttcttcttttcgctctccacggaagtctgctacctttccccccactgttccagcgcttgcccccctgcgggaagcgtgtcttggatcccttggtttgggaattggggattcgaaagccgtcgtacgggattgatctgttcccgattcttgaattccaatcagggcaggggggaccgcgattggaggctgcgaattttttttagacttacttacgatttattcctgttcccgcagggttcctagggtggttaggaagtttggggaaaggaggctccgatttttccgaagcccaacaacttggtgcagttgttgctaggcacgggtgacacgttaattactcccgattgaatagcgcctggccacgaagcaaccgcaaccaaccggcgttttttccgccttggaaataatcctagacattttagtacccccccatgtatcacattttattgcgcatcggcgggaaaaactgggaattttggcatttcttccgcggccccacgtttaaagtttcttctcttgtcttctaccaagtgagcggcctggataagtgaagcaccgttcacgataccatgcaactggtgtgacgagcaatagccctctttgaacgactttttagtacccccaggtcattgggtaaccagatcttcaacgcggattggtgccatgaagaaaatggtgatgctaagagtcgggcctggggcgtttgagacggtagttccctttcccggcaatatctttgggcgggcggctcgtgagatatacggcactaacgctgtgcatgcttccgagctggtatccgggctgtacatgactgtgttataagttagcccccggaggagatcttctctaaaaaaatcggtactctacactgatcatactatctgggtatctgaataggggccagtggtaaaaagacn

SEQ ID NO: 96019 - DNA, 1278 bp, Zea mays
  misc_feature: Ceres CLONE 1586484
  misc_feature (12)..(12): n is a, c, t, g, unknown, or other
  misc_feature (17)..(17): n is a, c, t, g, unknown, or other
  misc_feature (47)..(47): n is a, c, t, g, unknown, or other
  misc_feature (1091)..(1091): n is a, c, t, g, unknown, or other
tttttggggttnttttnaactctgcggtccccccggcctcccccctntttttgtttaccaactacacgaaaactggagctcaccacggtggcggccgctctagaactagtggatcccccgggctgcaggaattcgtctcacccctagaaaaaaaccaccgcgcattaaaatctgccccctcctgccactgccagcgaccaatccaatccctacctgctcgggaaccacccgtcgggctcctcccgcccccctcgccgcatctgcatgcggcggggatctccgggctcgctccgtcaccggagccccaatcaccgccacctcatccaagcccccgaatcccccgggcgcgcagcacaaccattgccgcgatcgcgcgcgggaaccgccgataattgggtcgtgaaaagctccattttgggcgattttgaattcgaagaaccgaccgcattcgattttgggtgggtttgcgaagccccccctggggatgcatctatgcaataaggaactggttgtacccgccagggttaactaagggtaacgttctatcaggaatttgcgaatgctttcccggagggcaaagacccccttggattttcaaagagtaaatttggacaaaggaaaactgtaaaaaacgcccccccggaaatactaatcactaagtaaatgacctcccctgggaaaatcagggtgataacaacataaaggtcccaaagaggtattgcttcagaaataatcatactttggggaaggcccaacacaagcataagaagaatatcaacatacacaaataaactcctgagaaatatacaaacagcaatacggtggtgagggcggacaaactagtggaataatttcctgtcacaccaagagtcgaatacttacgcacatacggaaaaaagagtgaatattgtttcctgtaccacagatacctaggatctccaaaatataacgcgatgagagccatgcgcccgcgaaccaacgtgagaccccacacaataacacatggttattctataaacaacctcatcagaaaaggatagtggaacatggtaggtaaatatatttttgcctctcgtatatacaaattgtcncgtccacgggtcgtagataatctctggtggacactttctcctacaaacatcgaatagaggatcctaggctaaatcttataaccgaaaacacactagctctcacaaacaaccatctacatcactctggtacatcgaccttattcaaaagtatgatgatgacataattatgtgcgaacctacagatgcg

SEQ ID NO: 96020 - DNA, 981 bp, Zea mays
  misc_feature: Ceres CLONE 1586488
  misc_feature: Encodes the peptide sequence at SEQ ID NO. 96021
  misc_feature (9)..(9): n is a, c, t, g, unknown, or other
  misc_feature (13)..(13): n is a, c, t, g, unknown, or other
  misc_feature (73)..(73): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
ttttttttntttntttttttgctatttcctcccctccctcttctttatttttgttgagggagaagcgtatatnttnnnaaaatggaactccccgcggtggcggccgctctagaactagtggatcccccgggctgcaggaattcgtctcacccctagaaaaaacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcggtggcccaaccatggctgtcattgccctaaagtgcccagacattgaggttgtcgttgttgacatctccaagccccgcattgaggcatggaacagcgacaccctcccgatctacgagcccggcctcgatgatgttgtgaagcagtgcaggggcaggaacctcttcttcagcactgatgttgagaaacacgtcgctgaggctgacatcatcttcctctcgggtgaacaccccccaccaaaaaccccgtgggggctttggagcttggcaaagggctgccctaacctcacctaactggggaaaagccccttcctccttaagaatccccccgaattgttcttccaaagtcctggacaaaaaaccgtttgttcccagaaagtccaacccgtcccctggttaaaaaaccggcctgaaaggctttttggagaaaaaaacctttgaacccccaaaacaagcaaaggggcattcaacctatcccggaatccccttttcccaaaacccggaagtttccctttgccaaaaagggccacctgcctatttttgaaagaacactggtttccagagccctgaaacaaaaagggctctcatcggggga

SEQ ID NO: 96021 - protein, 108 aa, Zea mays
  misc_feature: Ceres CLONE 1586488
  misc_feature (2)..(109): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRGRNLFFSTDVEKHVAEADIIFLSGEHPPPKTPWGLWSLAKGCPNLT

SEQ ID NO: 96022 - DNA, 916 bp, Zea mays
  misc_feature: Ceres CLONE 1586489
  misc_feature: Encodes the peptide sequence at SEQ ID NO. 96023
  misc_feature (361)..(361): n is a, c, t, g, unknown, or other
ggagctccccgcggtggcggccgctctagaactagtggatcccccgggctgcaggaattcgtctcacccctagaaaaatttttcacaccctcttgcctccccgtgactacctcgctgtcccctctcagtgtccaagcgacgacaccacgccgccgagatgtggatctcagattccgcctttatggagccctcatcttcctccccatccgcctctgcctccccgccgccgagcccgccaccagcacgccttctccgccaacgcaaccgccgccgacgccgcagcagccggaaacaggtcagtgccagcgccgtcgacggcgtcgccgaccccgaggcggaggacgtgtggcgtggggcgcantgggaggcggcgtggccggcgcggcaggactcaaaaccgtcgtgctcgcgggcggagacgacgcgggggggcggtccaggaacctcacgggacgacgacctcgaggagcttcagggatgcgccgaacctgggcttcggctttcactacgaacgagatcccccgagctccgggaccaccctgccggggccttcggactggggctactccatgtgagcccagcgccctcccaactgggacgaacaaaaaaacccccaccaacaaccgaggcccccccccaccaaaaggcccgcccccccccgtccccccgccctgttacccaaacggggaaagaatttctcacccccggggggaaaagccccttaaacaagggtgaaaggcccccgctctccaagtacttggggcccaagggcgggggggccgttgccccccgtcgcgcctttttgtgaaactggaaaggggggcccaaaacacatgccgggcccattttcttcccccccgtcgggggaaagcccaccccccagtttccggggtttacacggggccgcaccacaaaa

SEQ ID NO: 96023 - protein, 216 aa, Zea mays
  misc_feature: Ceres CLONE 1586489
  misc_feature (68)..(68): Xaa is any aa, unknown, or other
MWISDSAFMEPSSSSPSASASPPPSPPPARLLRQRNRRRRRSSRKQVSASAVDGVADPEAEDVWRGAXWEAAWPARQDSKPSCSRAETTRGGGPGTSRDDDLEELQGCAEPGLRLSLRTRSPELRDHPAGAFGLGLLHVSPAPSQLGRTKKPPPTTEAPPHQKARPPPSPRPVTQTGKEFLTPGGKSPLNKGERPPLSKYLGPKGGGAVAPRRAFL

SEQ ID NO: 96024 - DNA, 1262 bp, Zea mays
  misc_feature: Ceres CLONE 1586490
  misc_feature: Encodes the peptide sequence at SEQ ID NO. 96025
  misc_feature (38)..(38): n is a, c, t, g, unknown, or other
  misc_feature (39)..(39): n is a, c, t, g, unknown, or other
  misc_feature (67)..(67): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (881)..(881): n is a, c, t, g, unknown, or other
  misc_feature (899)..(899): n is a, c, t, g, unknown, or other
  misc_feature (1023)..(1023): n is a, c, t, g, unknown, or other
  misc_feature (1215)..(1215): n is a, c, t, g, unknown, or other
gggggggggggggggtgggaattcacaaacctaagggnnttatgtttttgtctttgcgcacaccccngannntaggagggggaaaaactggagctccccgcggtggcggcctctctcagaacagtggatcccccgggctgttccgaatggtctcacccctagaaaaactccgccctcacgcacgcggcccaactagcctaacaaaccctagctagatttagaaaaaaaatttgtccccaatccgaaccgacgaggagctcgccgccgtgagatgtccgagtacgacgagcgctaccagggcaacggcgacatgcccgcagccgaaggcggctatccgcaggccgagtacgccgccgccgccgcgtcctgcccgccggggggttcgcccccccgcaggacagcaaggcccctcccgggggtgcttgtggggggggggggaggaagccgagacgcgggggcgagcaggacagggatggacacagtggggggagaaaaaattgccccgcttggagaggggcggaggtccgaaaagacaaaggggagggagggggcgcggcaggtgaaagacgcccagagtaggcggggcggcgacgcgcgagcgaggccaggggggcccaaggagcgggtgggcggggtggcccgggccagtggaggtcgtggtgggtgttgggggtgggggtgctacggtagtaccagagtgctccccagcgtgacacccagatacacgcaataggcaccggagtggacaccacgcagagggcgccacctctggtggctcctatgtggtgtgcctccactcgttgctcgcgcgcggtgggtggcgtcccaccggtggatgtcacgctctcttctcgatattcccgcgacgatacagaacgganatgtcaccccaaatctcntctactgctgcgcgctcctgcaaccactatttgtatggacacgcattctttacgcggagtatctcatgatgtacagttacgaggcggaataacgagagcggcggagtgtctgtgcgtgatggtnaggggaaaagcgcaagcagatacataacatacgatccacagctaccacgtacgtaaaaatataaaagaaaggtgaaacgaacacacgtaaatgtacagactgcggtgtaaagcatgctgtaagcatatgaaaaatccgagcgcggtgcacaaaatatcacgatgtgcgagatagtagaacggcagaggcggnagctgagaagggaggcggacaacagatctggaacaacacatcatcac

SEQ ID NO: 96025 - protein, 153 aa, Zea mays
  misc_feature: Ceres CLONE 1586490
MSEYDERYQGNGDMPAAEGGYPQAEYAAAAASCPPGGSPPRRTARPLPGVLVGGGGGSRDAGASRTGMDTVGGEKIAPLGEGRRSEKTKGREGARQVKDAQSRRGGDARARPGGPKERVGGVARASGGRGGCWGWGCYGSTRVLPSVTPRYTQ

SEQ ID NO: 96026 - DNA, 1263 bp, Zea mays
  misc_feature: Ceres CLONE 1586491
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (22)..(22): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (723)..(723): n is a, c, t, g, unknown, or other
  misc_feature (724)..(724): n is a, c, t, g, unknown, or other
  misc_feature (778)..(778): n is a, c, t, g, unknown, or other
  misc_feature (916)..(916): n is a, c, t, g, unknown, or other
  misc_feature (923)..(923): n is a, c, t, g, unknown, or other
  misc_feature (963)..(963): n is a, c, t, g, unknown, or other
  misc_feature (1004)..(1004): n is a, c, t, g, unknown, or other
  misc_feature (1018)..(1018): n is a, c, t, g, unknown, or other
  misc_feature (1022)..(1022): n is a, c, t, g, unknown, or other
  misc_feature (1050)..(1050): n is a, c, t, g, unknown, or other
  misc_feature (1076)..(1076): n is a, c, t, g, unknown, or other
  misc_feature (1098)..(1098): n is a, c, t, g, unknown, or other
  misc_feature (1103)..(1103): n is a, c, t, g, unknown, or other
  misc_feature (1116)..(1116): n is a, c, t, g, unknown, or other
  misc_feature (1170)..(1170): n is a, c, t, g, unknown, or other
  misc_feature (1172)..(1172): n is a, c, t, g, unknown, or other
  misc_feature (1238)..(1238): n is a, c, t, g, unknown, or other
  misc_feature (1240)..(1240): n is a, c, t, g, unknown, or other
nnnnnnnnnnnttttttggggnggggccagcttttggtggggttgagtttggtttggggggcggannnnnnnaaaaactggaactccccgcggtggcggccgctctagaactagtggatcccccgggctgcaggaattcgtctcacccctagaaaaactccctttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagccctccagccggcggaggagagtctgcatgtgcaggattacaaggacgcgccctccggcccaaggggcgtggctcgccccccccccttagggaaccttgcaaccccggggggcggaaaaaccttgccgggggcaaggaccccccagggaccgggaaacatggtatttaaggggtggcgttacccccgggctttattcccctattggggagccccaaacgggcggtgggtgggggggggggagaatctccccgatttaacccttggaagcccccgttggagtcggggaaagccacccagcaaccacccgcgccaaanncgggagcggtggggcgaaaccctctaaattggcgcgttgggaacacaatttggnggtatcttctcgcaacggggcgggcgcttgtacaacgcgcgcccgcccgcgccaccctacttttgatggggggggaggttcgcggtcacaaacaacgcgcatattgtgtggcggggcgccacaatggcgaatatggangaattanaaaaagagatttttgtgagtgtggcggggggagatattanagggagaaacgttgtcttccccggtcgttatcgcgcgcggngtatgagaaacacntttnttgccacctcgacagcgcgcaggctggnaaaaacccatcgtcggcctctgtgtnctagaagacgcggtcgacgccntgccncatatcgcggccnttctgagacggggagagaagaaatgttgggcgctcctcccgcgcgcgccgcctnanaaaccgcgggacggggctctggctacccacatatgggggccgccacctccaaaacccagcaaaaangntttttaaaaaaaaatttctccgc

SEQ ID NO: 96027 - DNA, 822 bp, Zea mays
  misc_feature: Ceres CLONE 1586494
  misc_feature: Encodes the peptide sequence at SEQ ID NO. 96028
  misc_feature (558)..(558): n is a, c, t, g, unknown, or other
tccccgcggtggcggccgctctagaactagtggatcccccgggctgcaggaattcgtctcacccctagaaaaagcggtcttttcccgtccgccccgcctccagctcccgtctcccaccccaacccggatctcgcgcgcgacgccgcgcaggcgaaccccacctcctctcagaagcatctagaagttcctcacctcgctcccgcgcggatgagtggcagctcgggccccctcccctactcgatgcgcgatgtgggtgctggcggcgcctacaacaacgccaagttccgccaccggtctcgcctcaagatggttctacagttcttggctactaacagaagcaaataccattgtggaaagttcactgttggtaaattcttgagcctgttgatggtttctggcttattgtacttatttatgcacaaaggctcagagggtattgtatccagtgagcttcatggcaaagaagtacagataaaaatgttaggagatctcccagtatacgcacattctggagaaaccaccaaggctgcccccacgcctccctccaaatgaatctancaaaataattctctgcttcagcagtctccatctgagtggacatcgaggcagaggaaagttaaagaagcatttgaacatgcatggtctgggtatcaaaagtatgcaatggggtacgatgagcttatggctctgagccacagagcacaaatgggttagggggtctaggagctactattggtggattctttggatctgcgaaaataatgggggccagaggaagttgtttctgaagcttcaaattgattggaagacacctaatgaaaa

SEQ ID NO: 96028 - protein, 114 aa, Zea mays
  misc_feature: Ceres CLONE 1586494
MSGSSGPLPYSMRDVGAGGAYNNAKFRHRSRLKMVLQFLATNRSKYHCGKFTVGKFLSLLMVSGLLYLFMHKGSEGIVSSELHGKEVQIKMLGDLPVYAHSGETTKAAPTPPSK

SEQ ID NO: 96029 - DNA, 804 bp, Zea mays
  misc_feature: Ceres CLONE 1586496
  misc_feature: Encodes the peptide sequence at SEQ ID NO. 96030
ggagctccccgcggtggcggccgctctagaactagtggatcccccgggctgcaggaattcgtctcacccctagaaaaagccacccattcctccgctcttccttaattcctcatttcctccacgtacgcgtgcatactctgcgagtccaggagatttttttccccttcttcacgatactctcgacgagagtgtctccatggccggaaaaggagacgggccggcgatcggcatcgacctcggtacgacctactcgtgcgtcggggtgtggcagcatgaccgagtcgaagatcatcgcccacgaccagggcaaccgtacacggcgtcttatgtcgcgttcacgaatcggaaaagctcttcggcgaccccgccaaaacccaggtcccatgaaacccctcaacaccgtttttcaagggaagagggtttttgggccggggctttcttttaaactttggggggcaaaggggcccccaaactttgggccctttcaaaaagggtccccgggggtctcggggaaaaaaacccctatatattggggggtggcacttttagggggggcggaaagaaaaaaaaattttttctgggccggagggaaaaaaacccccccccgtgtctctttaaaaaaaaaaaaaaaaaaaaaagggcccaaaattttttttctttgggccccccctttttaaaaaaaagggttttttttcccccgccccggggcggctttttttttaaaaagtgcccccccggccggggggcccaaaaaggggaggcgggggggggtttcttttcgcgcggcccaaaaaaaagggaggg

SEQ ID NO: 96030 - protein, 82 aa, Zea mays
  misc_feature: Ceres CLONE 1586496
MAGKGDGPAIGIDLGTTYSCVGVWQHDRVEDHRPRPGQPYTASYVAFTNRKSSSATPPKPRSHETPQHRFSREEGFWAGAFF

SEQ ID NO: 96031 - DNA, 1169 bp, Zea mays
  misc_feature: Ceres CLONE 1586497
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (67)..(67): n is a, c, t, g, unknown, or other
gggtgggggttntnnnnaggagtggtcgccgcggcccccccccgtctaaacctcatatctttttttnaaaaactgggactcaccgcggtggcggccgctctagaactagtggatcccccgggctgcaggaattcgtctcacccctagaaacattcctctttcttcttcggttcttcgacagccgtgcgcgcttctccactgccctggagaccaaggagcaccccgcgatctcccggcgggacccggcctcacctccccgaccgcgtgcctctgaaacggagaagctgccggttcccagacggccaggctactccgactcttcctttccctccaggcggtgaggcgtcctaaccgattagcggacagcgtcaggaccgcgacatgtgggtgttccccccgatattcctggcctctgaacctggacatgggtcgtcggcaacctcccctactttccccgggcccttgccgggcccccccaacgttttttttcccaccctaaagaatcccccttgggggcgggggccctttctcccaaaaaatttttccttggaaaacccgggccccacccatatttggggggggacactttataaaatggccccatttccccgggaaggggggggggccatttataaaactccctttttttttttggagggggggggcgccccctttttttggggggccgccccagtattttataaccctccccctttctcttgtggggggccctgtgaagaagataattttctcattacttcttttctccccaggaagggtctctccttttaagaaaaaaatacatcctcacagggggagaataaatccttccgcccctgcggggttttataaacataaaaaatggcgtggggggaaaacaagggcgcgggatattacaattaattaacgtttggtggagaaccaccgccgccccgtctcttttctttctctggctccacaccatattttgtgtgcgggagaagagaacacctccatgcggggggagccacaattagtgtggggcggcgcctcgacgaaaagataaccatcgccgccgggttaaatattctatctctcctccggcgaaaacagcctccttttgttgggttgtagttgcgggggggtccttgctttttcgtgttgagggacggagctatccttctccgcgg

SEQ ID NO: 96032 - DNA, 812 bp, Zea mays
  misc_feature: Ceres CLONE 1586498
  misc_feature: Encodes the peptide sequence at SEQ ID NO. 96033
  misc_feature (720)..(720): n is a, c, t, g, unknown, or other
gagctccccgcggtggcggccgctctagaactagtggatcccccgggctgcaggaattcgtctcacccctagaaaaagtatcatcagtcaccacacatctcataccacatatcatcacacaccataccacatcgacgacttgagcgcgtgcgtgcgtgccctgatcgagcaccgattgccatggactcgacgacaacgacgacagcgccgctgctgcagccggccgccgccgcctcgagcaaggaggagccggcaccggcgtccccgcacggcgcgggcagctgggagctggaggcggtcctggccgacgcgtcgtcgccggtcttgcggcgggcctgggaaggcgcccgcctggagctgccgctgctgctgcgtgtggcgctgccggcggtgggcgtctacgtgatcaacttcgtcatgtccatgtccacgcagatcttctgcgggcatctcggcaacctggagctcgccgccgcgtcgctcgggcacaccggcatccagtccctcgcctacggcctcatgctggggatggggcagcgcggtggagacgctgtgcgggcatgcgtacggcgcgcacaagcacagcatggctggggggtgtacctgcagcggtcgacggtgctgctgatggccaccggcgtgcctctgaccgtggtgtacgccttctcggcgcgcatcctggtgctcctgggcgagtcggacgcatctccaggcccgccncgtgttcgtgtacggctcatcccgcagatcttcgcgtacgcggccaactccccatcaagaagttctgcagcgcagagcatcggggcgccagg

SEQ ID NO: 96033 - protein, 210 aa, Zea mays
  misc_feature: Ceres CLONE 1586498
MDSTTTTTAPLLQPAAAASSKEEPAPASPHGAGSWELEAVLADASSPVLRRAWEGARLELPLLLRVALPAVGVYVINFVMSMSTQIFCGHLGNLELAAASLGHTGIQSLAYGLMLGMGQRGGDAVRACVRRAQAQHGWGVYLQRSTVLLMATGVPLTVVYAFSARILVLLGESDASPGPPRVRVRLIPQIFAYAANSPSRSSAAQSIGAP

SEQ ID NO: 96034 - DNA, 795 bp, Zea mays
  misc_feature: Ceres CLONE 1586500
  misc_feature: Encodes the peptide sequence at SEQ ID NO. 96035
  misc_feature (348)..(348): n is a, c, t, g, unknown, or other
  misc_feature (360)..(360): n is a, c, t, g, unknown, or other
ctccccgcggtggcggccgctctagaactagtggatcccccgggctgcaggaattcgtctcacccctagaaaaagctgctgctccgcccttccgaccgatcgaggtggcgcaaagcagaggaaaaccccaggccgcaaccctcgcaaacactcaagtcctcgtcccttccgcactctcctcttcaactccagccgctttcaccgccaatcagaggtccaccaccaccaccaccacatctcttcgcatccaaccgccccgtaggatcacaggaaacggggatggcgagcggcggggcggtgagggaggtgggctcggccgccgagctgcaggcggcggtggccggggcncgggcggcggcngtgcacttctgggcgtcctggtgcggagcgtccaagcagatggacgaggtcttcgcgcacctcggcgtcgacttcccccacgcgggccttcctccgggttgaagctgaagaaacaccctgaaattatcagaaggcgtttggaagtaccacggggggcccataatttttgtttttccggccagggaagggcaaaaatgtgcggaaacctttgggagggggagcaaaacccccggccgccttttacccaaaataagggttggcaaaaaataccctggggcccccgccaaagggttgggcagaaaacctggcgtggacccggcctaacccttgtgaaattttccccccttgggaaccccgctgtttcttttggaaaaaacccccccaaaaaaaggggcccaaccccaaaaaaggggacccttctccccgcgggggaaa

SEQ ID NO: 96035 - protein, 60 aa, Zea mays
  misc_feature: Ceres CLONE 1586500
MASGGAVREVGSAAELQAAVAGARAAAVHFWASWCGASKQMDEVFAHLGVDFPHAGLPPG

SEQ ID NO: 96036 - DNA, 869 bp, Zea mays
  misc_feature: Ceres CLONE 1586502
  misc_feature: Translation starting site: 118
  misc_feature: SWISSPROT Homolog: EC 4.1.1.31 Phosphoenolpyruvate carboxylase
ccccgcggtggcggccgctctagaactagtggatcccccgggctgcaggaattcgtctcacccctagaaaaaaattgagggccctacccaccccccaatacaacatcgcgctctgggatgagctgcttccatgagactgtaagcaatggcgtgcctaatgtcttgcgccgatgtgtatacagccctgaagactatcggcatcactgagcgccttccctactatgtttctctcactcccggactcttcttggatgggtggagaccgctatggaaatcccagagttacccctgaggtgacaagagatgtatgcttgctggccagaatgatggctgcaaacttgtacatctatcagatcgaagagctgatgtttgagctctctgtgtggcgctgcaacaatgatcttcatgttcgtgacttatgagctgcacagttcgtctggtgtccaagttactaggtcttacatgagactctgggagccaattccctcaaacgatgccctacggggtgatactaggcccatgtatggacaagctgtacaatacaccccaagcgtggctcggcattttgctggccttcttgagtttctgaaattttcggcggaaaccttcttttaccaatttccaacaatttccttgagccactttgagctggggcaccaaattcatggggggacttgcggggaacaaggccctcgcgggaccggaaccctccgggaactccctgcggcagggattttacagatccgggctcccccatggggaaaactggaccatccggccaggaatcagaaacggcccccccgggggggggtgtgaggccatatacccaaacccttggggtttttgggggcaaaccccccggggggccc

SEQ ID NO: 96037 - DNA, 940 bp, Zea mays
  misc_feature: Ceres CLONE 1586503
ctccccgcggtggcggccgctctagaactagtggatcccccgggctgcaggaattcgtctcacccctagaaaaatcttgccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaaggggaagccccaggaatctccgtcccgctcccgggcgccgtccttctcataacctcatcggatctgtattgggttttcagtaaagaggcagaaaacgccttagggaatgcaaaaagatgtgcttgcccgtcccaagaagctacttttggtgagggaacttggccaggaaagcacgccatactctttcttcctctgccaccttccttgatgacctttcaaagctcaaaaatacaccgtattctccaccccccggcttttcgcaaccaatggggtttccaacagtggggggtccaaaccggcctttcttaaaatcacccatcttccggggggaaaaacggggttgaaattcttttcaaaacccttctttgaaacctccttttgggcgggggctccaatttttttttttaaactggccaaagggataaagcccagggggacccctctggggtggggcattacccccccaccaaccctttacgtgtggcctttaccccggggccccaaatggggcaaaaccctttaaaggggaaacgtttctcttttgcccaaatttttgaaataggggggaaaattggttttgggccaaaaggacctttttgcccaaaggttttaccatgcctccgagaaacaggggaactttcggaaaagtgtcccccatccaaaggtttttttaaaggaaaaaaggttttaa

SEQ ID NO: 96038 - DNA, 820 bp, Zea mays
  misc_feature: Ceres CLONE 1586504
  misc_feature: Encodes the peptide sequence at SEQ ID NO. 96039
ctggagctccccgcggtggcggccgctctagaactagtggatcccccgggctgcaggaattcgtctcacccctagaaaaaaaaagaagagaggacccgcatcgcagatctcccccttccctccacgcctctcgcgtcgccgcgatggccgacgaggccctggaccagccgccggacgcgtccccttctccgactccggcgacgccgccggtacccgccaccccgtcccccgcggcgctgctccgcccgcggcgggaggcattcgagcacgggctcttgcccatccccaagctcatcttcccggagggtacgctggcgcagaccctcgcccagctcaaggagaagctcgctgcctcagccccggacggacgcgtgcgcgccgcggccctggcggaggcgttgcagatcccgcaggagcaggcggcgctcgccctcgccacgctcgcggctgtgctcccggcagaggaccccgcgctcggcgacggcgccgtggatggttctgccgcggacatccgcgacatgctgctcttcctctacatccagtcttacaaacgtctcgtcccgcggagcgcgcacaaggactcgcccgtcgttggcggacgtctggccgtccacctccgcgtttcgatgggtacctctccggactctccccgatccagcttgttcgcagtaacagccgtcgttttttgcctttctcagcctggatgaagaaattcatcagttggccctatctgcaaaagcatttggggggaatattctttactctcttggcagattctgttgaaggggggaaggggggaatcattccacggggggttgat

SEQ ID NO: 96039 - protein, 187 aa, Zea mays
  misc_feature: Ceres CLONE 1586504
MADEALDQPPDASPSPTPATPPVPATPSPAALLRPRREAFEHGLLPIPKLIFPEGTLAQTLAQLKEKLAASAPDGRVRAAALAEALQIPQEQAALALATLAAVLPAEDPALGDGAVDGSAADIRDMLLFLYIQSYKRLVPRSAHKDSPVVGGRLAVHLRVSMGTSPDSPRSSLFAVTAVVFCLSQPG

SEQ ID NO: 96040 - DNA, 1323 bp, Zea mays
  misc_feature: Ceres CLONE 1586505
  misc_feature: Encodes the peptide sequence at SEQ ID NO. 96041
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (65)..(65): n is a, c, t, g, unknown, or other
  misc_feature (75)..(75): n is a, c, t, g, unknown, or other
  misc_feature (76)..(76): n is a, c, t, g, unknown, or other
  misc_feature (900)..(900): n is a, c, t, g, unknown, or other
  misc_feature (941)..(941): n is a, c, t, g, unknown, or other
  misc_feature (1266)..(1266): n is a, c, t, g, unknown, or other
nnnnnnnnnnnnnttttnnnnnnaattcagttatcccccccaccccccccgtgcgcggatattanagtgtgaaannccaaaactggagctccccgcggtggcggccgctctagaactagtggatcccccgggctgcaggaattcgtctcacccctagaaaaactctgtgcagaagcgccgccgcgacacggtcgaattccactggatccagctgctgaacggggtaccagaaggtggatttggtagtagcactgaacagcgagtggaatttctctaatactgtccaggatcatggttcctctctgtggtttctgtgggaaacaaaggtcaatgatctactgcagatcggatgcggcatcattgtgcttatcatgcgaccgtagcgttcattcagctaatgcactgtctcggcgtcatagaaggacccttctttgtgatcgttgtggtttacagcctgcatcagtccgatgtcttgaggacaacacatcactttgccaaaaccgtgattggaatggggcatgatgcaaccatcagggggcttctggggcataaaaaggcagggccataaaactgtgattcagggggggcgcagtaatcgagaagaagcttttccgaggaagccggggtcccttgttattgggcgcgaatgtcccccgaactgggtagccgggcttggatgacccaaaatctggtgggaaggggagggggggcctaagggccgaggtggagttgacacaattttggtgaatgcaagacctgtcagaattgtctggatactcctgaaactgcccgagctagaatcgggggtgggttgcgctgatcctgtgacaagacggcgaaaacacatacacagcggaaaaaacaccgcgtccattcggggtgcgtcataaaatcttgcgngctggatagtaatctcccccgggtctccccctgcgcgctcnaattagagggcgcgatggtatgtaatcacaaacgcaccgtgcgcacagcggggtcggtgttaacacgaaaacgcagcccacgaaaacaacactcgccccctgtggcgacagaggggggtgggaaggaggtgcgcggagccttggggagaggggtgaattgggcgtggcgttcgacagccgctatgattcacgagcccccccctcgataggtgtcgctgcacgacgtgagcgccacggatctgcgatgggctcgtaggtgtgacatatgtctctcgtcgagtttaatatatccactgcagaggcggggcttagcccggagaggggntcctgctggctggggagggtacaaggcgatgcggtctgtgtgagtcgagtctcgggg

SEQ ID NO: 96041 - protein, 76 aa, Zea mays
  misc_feature: Ceres CLONE 1586505
  misc_feature (1)..(47): Pfam Name: zf-B_box Pfam Description: B-box zinc finger
  misc_feature: The sequence is a functional homolog of SEQ ID NO 224 in the 10/412,699 US patent application
  misc_feature: The sequence is a functional homolog of SEQ ID NO 56 in the 10/374,780 US patent application
  misc_feature: The sequence is a functional homolog of SEQ ID NO 96 in the 10/225,068 US patent application
  misc_feature: The sequence is a functional homolog of SEQ ID NO 1704 in the 11/479,226 US patent application
  misc_feature: The sequence is a functional homolog of SEQ ID NO 2586 in the 10/374,780 US patent application
  misc_feature: The sequence is a functional homolog of SEQ ID NO 652 in the 11/435,388 US patent application
  misc_feature: The sequence is a functional homolog of SEQ ID NO 72 in the 11/375,241 US patent application
  misc_feature: The sequence is a functional homolog of SEQ ID NO 766 in the 10/225,066 US patent application
  misc_feature: The sequence is a functional homolog of SEQ ID NO 862 in the 10/412,699 US patent application
  misc_feature: The sequence is a functional homolog of SEQ ID NO 226 in the 10/412,699 US patent application
  misc_feature: The sequence is a functional homolog of SEQ ID NO 458 in the 11/479,226 US patent application
  misc_feature: The sequence is a functional homolog of SEQ ID NO 486 in the 11/435,388 US patent application
  misc_feature: The sequence is a functional homolog of SEQ ID NO 1896 in the 10/412,699 US patent application
  misc_feature: The sequence is a functional homolog of SEQ ID NO 2160 in the 10/374,780 US patent application
  misc_feature: The sequence is a functional homolog of SEQ ID NO 336 in the 10/666,642 US patent application
  misc_feature: The sequence is a functional homolog of SEQ ID NO 182 in the 10/374,780 US patent application
  misc_feature: The sequence is a functional homolog of SEQ ID NO 564 in the 10/225,066 US patent application
MVPLCGFCGKQRSMIYCRSDAASLCLSCDRSVHSANALSRRHRRTLLCDRCGLQPASVRCLEDNTSLCQNRDWNGA

SEQ ID NO: 96042 - DNA, 1169 bp, Zea mays
  misc_feature: Ceres CLONE 1586506
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (78)..(78): n is a, c, t, g, unknown, or other
tttttttttttnnnccnttgtgttgggttctcttatctccaatcaacaagcagtggtggggccggcggnnnnnnnaantggtggagctccccgcggtggcggccgctctagaactagtggatcccccgggctgcaggaattcgtctcacccctagaaaaagaagctgctatatatataataggcgagaggagcagattcggtgagcacacacatcctctaagtgctatctaatctacaatctaccaccagactgtcgtcagtcgtccctcatcaaccgcgcgcgcgcgacttcaagcatcagactaccataatcatggctccgccgccggcaatgcagagcccaggagagctaaacgacggcgcctacgacgcgccgcacatcctattcatcccgagcgcccggcataagacaactgacccccgtcttccgcgtcatcgccagctttctcagcccggggatcgacgtctccatcgtgaccggggctgcccaccgtgttctgccggccaaaactgactactttcaacgggcctcttcggggaacaacccccgcgttccgccccgttcgaactggccacctatttggccgcttggaccccctccccaaattttcccgaagaagagaggaaccccgtttctcctccttcccggttgggggaagggccctttcggacccgccttccaggttccaaaactttcccttcacggcgccccatttaatttcatcattaaatgacccgggttgggctctgggatcaatatctcggaggggcctgtatcgttattcttagcgcggtggaaatttgtttccccccccggtggaggaccactccggcagggcgggttgtaatatctcctccccttgcctggcccaatgaatgaaaagtcctcgtgggagtccgtgtccctcccgcgttggcgcatagaagtgacgccctcgttttagcacgtccagatagtatggatcgcagtgcgactgttgtagtgtttctctagaggttttagaatggaggcagtaactcaaatacctgcctgggggttagtcctcgtattaacaataaacacctctcaaagagagttgggggggaacgcggagtgcgcccggagggtggatggtatttatggtctgaactcgagcaggttgtgagtagaatatcactcggcccctat

SEQ ID NO: 96043 - DNA, 1085 bp, Zea mays
  misc_feature: Ceres CLONE 1586508
  misc_feature: Encodes the peptide sequence at SEQ ID NO. 96044
  misc_feature (10)..(10): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
gggccttttntttnnnccttccatttgatgcgcctgccgacccgttttataattacagctctccaaaaaataaaaaaaaactggactcaccgcggtggcggccgctctagaactgtggatcccccgggctgcaggaattcgtctcacccctagaaaaaaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcgggaccgaaagggaagggaatgtcggttttggagaagcaagtacgggcctctccccaaggatttgttaaacgaatgggccgttaccagtttgccaaagaagaaggtttggaagcctgggaaaggaacccctggtggggaaaaaaacaatttgcgaaagccctaaaaaaattggggtcccaagggggacaaagggctttggccaaggcctttataaagaaccccacaaaccgcgaaattttccttttggccccctggggaaaagaaaaatgggggggggaacacaaacaccgaaccccccttttctttgggtgtgggggtcccccccttggggcgctcccacaagggggggggccctggaaaaatatatggccactttggaaaggggaggggtgtgtgtttaataaaagaggggtgcccctattaaacaccaaaacccggtgggtgggccccaaaataatcccctgtggttttcaaaagagaattaaactccccccgcggggggggattatttgtaagaaaaaagaaaacaagtcttataaagcggcgccctctttgttttttgtgaaaaaaaaaatactccccggggagagagggtc

SEQ ID NO: 96044 - protein, 87 aa, Zea mays
  misc_feature: Ceres CLONE 1586508
MASTFGATSTVGLMAAPTGKNVRLQRRANFRVKAAKELYFNKDGSAIKKLQTGVNKLADLVGVTLGTEREGNVGFGEASTGLSPRIC

SEQ ID NO: 96045 - DNA, 1123 bp, Zea mays
  misc_feature: Ceres CLONE 1586509
  misc_feature (1)..(1): n is a, c, t, g, unknown, or other
  misc_feature (13)..(13): n is a, c, t, g, unknown, or other
  misc_feature (1058)..(1058): n is a, c, t, g, unknown, or other
nggcttgtggggngttttctttctgtttttttacctcccttattatttaaatatacctaaaaaaaaaatggactcacgcggggcggcgctctgaatagtggatcccccgggctgcagattcgtctcacccctagaaaaagcgctgcttcgctggctttcggcaacgccctttaccacatctgaatctcacccacccacccccgcgtcccccacctcatggcgccggcgatggggctgaagcggcctgcggcggggagccgggggccgggcagcagccgcaagacccgtcacacctgtcccgcgcccggcccgtgcggggacccggttgcgcaccggccgtaaggggaggcccaagccccccggcgaaagctaccgccccccggccgccaagggccccggcaacggcggtcagtgcccggcgggaaatccccttagggatggggggccttggcccttgaaaaaaggtctaaacggggaaggcctgttggaaccttatttggccccaaacccccccttggggccccccccggttaaaaaagccaaagagaggaaaggggggcttttcgttctgggcagagggcccccttttttaggggggggggtggcccccgcgttcaccagagttccccccccaaaattcgccccctcccccctgtctgtgagaggagaaaaaacaacacggggcgccccctctcttttaagaaagaagaaacacccctctatagttgttctcgtgtgagaccccccaccaaaaaggaggggatgtttttttctccaagaaaaaaaagaatcgcgctccaccaccacccctccctttatataaaatgaggtgggggcccccaccaactaaagagaggaacaaacattattgggtgacacaccgggcatcttttgcacaaaacaacactctcttcttctttcttgtgtgggggggagggaagcaacacaactagggggggggggtgtgtgttctttcttcacaccagcaaaggggggggcgcccccgttttgtttctaaccaccaatacttcattagggataaaaggaaaagcaggcgncacccaaaaaaaataggaggggggggcaccaacacccaacgcggggcgcgagtagggaagccccc

SEQ ID NO: 96046 - DNA, 984 bp, Zea mays
  misc_feature: Ceres CLONE 1586510
  misc_feature: Encodes the peptide sequence at SEQ ID NO. 96047
  misc_feature (69)..(69): n is a, c, t, g, unknown, or other
  misc_feature (77)..(77): n is a, c, t, g, unknown, or other
  misc_feature (836)..(836): n is a, c, t, g, unknown, or other
gtggggtggtgtgtgtgtgattgaggagggttgctgacctctctccaccttcatctaatgaagagatangccttttncacaatagatggagctccccgcggtggcggccgctctagaactagtggatcccccgggctgcaggaattcgtctcacccctagaaaaaaaaaaaaaaaagcacacacgcgcgacagggtgcgcgccgctcgggcgatggcctccgcccgcctcgtcgcgctcgctgcattcctccttctcctcctcttcgccctgggcccgggcgaggcgcgcgcggcggacgacggcgaggtgcgcgcgctgctggcgctgggggccgcgctggacccgacgggccgcctgctcccgtcgtgggcgcccggccgcgacccctgcgcgccggcgccgtccgggggattcgagggcgtcgcgtgcgacgcccgcggcgccgtcgccaacgtctcgctgcaggggaaggggctcgccggcacgctcccgcccgccgtcgcggggctccgctccctgaccggcctctacctccactacaacgcgctccgcggcggcctcccgcgggagctggcggcgctcgccggctctcaccgaccttctacctcgacggtcaacaacttcctcggggacccaatcccggtcgggagaatcggcgcccatgggaaatcaactgcaaagtggggtgcaaaccttctggctacaaacccaggcttcacccggggaagccattccccccaccccaagcttgggggcaaacccccaacccaagggcttcacccgggggcttgggccccttggacaattccaaaacccgcctttcaaaaggggcgncccattcccccgcgccaagcccttcgtggcgaaaccttgccccacctggctggggcgccgcccctgtggaacccttcaagccttttcaaacccgttctcccttttcgggacttcttaatccccccggttaaaggggcttcgacccccc

SEQ ID NO: 96047 - protein, 257 aa, Zea mays
  misc_feature: Ceres CLONE 1586510
  misc_feature (29)..(74): Pfam Name: LRRNT_2 Pfam Description: Leucine rich repeat N-terminal domain
MASARLVALAAFLLLLLFALGPGEARAADDGEVRALLALGAALDPTGRLLPSWAPGRDPCAPAPSGGFEGVACDARGAVANVSLQGKGLAGTLPPAVAGLRSLTGLYLHYNALRGGLPRELAALAGSHRPSTSTVNNFLGDPIPVGRIGAHGKSTAKWGANLLATNPGFTRGSHSPHPKLGGKPPTQGLHPGAWAPWTIPKPAFQKGRPIPPRQALRGETLPHLAGAPPLWNPSSLFKPVLPFRDFLIPPVKGASTP

SEQ ID NO: 96048 - DNA, 808 bp, Zea mays
  misc_feature: Ceres CLONE 1586511
  misc_feature: Encodes the peptide sequence at SEQ ID NO. 96049
ctccccgcggtggcggccgctctagaactagtggatcccccgggctgcaggaattcgtctcacccctagaaaaagttcgtcccctgcgcctttttttcttcttctctgccaccccgcaccccgcaccccggtaataaaagtttaatttctcctcgcgttacagctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgccgtggcgttccccgagtgccccgccgattaccaggactacaccccctgcaccgaccccaagcgctggcggaggtacggcaactaccgcctgagcttcatggagcggcactgcccgccgccgcccgaccggcagcagtgcctggtgcccccacccaaggggtacaagccgcccatccggtggcccaagagcaagggacaggtgctggtaccggaacgtcccctacgactggatcaacagccagaagtccaaacagcacttggccccgtcaaggaggggcgaccgcttccgggttcccccggcggcgggaaccattgttcccccaagggcgttggggcgccgac

SEQ ID NO: 96049 - protein, 199 aa, Zea mays
  misc_feature: Ceres CLONE 1586511
MKYSKEDKPERAGGAGAGSRAVPVALVVVVLCAFSFYLGGIYSTGRSLLDSIQPAPTALLALGAATTTRRPSDDGQARPALASTAAVAFPECPADYQDYTPCTDPKRWRRYGNYRLSFMERHCPPPPDRQQCLVPPPKGYKPPIRWPKSKGQVLVPERPLRLDQQPEVQTALGPVKEGRPLPGSPGGGNHCSPKGVGAP

SEQ ID NO: 96050 - DNA, 905 bp, Zea mays
  misc_feature: Ceres CLONE 1586516
  misc_feature: Encodes the peptide sequence at SEQ ID NO. 96051
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
nnnnnnnnnnnnnnnnnnggggnnnnnnnnnggggnggggnnnnnnnnnnnnnnnnnnnnnnnnnnnnnnnttttnnnggggatggtggagctccccgcggtggcggccgctctagaactagtggatcccccgggctgcaggaattcgtctcacccctagaaaactctcccttccaactagagagttgtcgtctgctgcagggatggccggcgtcctgccgaggtttggccccttcggccctctgccgccatcggatgagttcgggatcagggagacgagaccccgtctcgccggcaggcgggccggcgggtacgacctcgtggagcggatggagtacctgtacgtgcgcatcctcaaggcgcgggacctcaagtggactggcagcttcgacccgctcgcggaggtgaagctcgggagctactcctgcgccacgcggcacatcgagaagacgacgagcccggagtggaacgacgtgttcgcgttctcgcgggagaggatccaggcctcgttcctggacgtcgtggtcaagggcaagggcttcgccaaagacgacttcgtcggccgcctgcgcttcgacctggccgacgccccgctccgcgtgccgcccgacagcgcgctcgcgccgcaatggtaccacgtcttcaacaaaaaagcggaacgccgggggccaagtgattaatggcccgggtggtttcggccccccaggcccacgagtgcctcccccctggcggggggcacccccaaccccctcctttctgcccgtgggaaacccaaagttggggccgcgcacaatcccgctgggaaagcaaagtacacccgttggccgccgcccctctggggtacgggggcgcccttctattggtcattccgaagggccccgccgaaaatttcgccaattttcggg

SEQ ID NO: 96051 - protein, 158 aa, Zea mays
  misc_feature: Ceres CLONE 1586516
  misc_feature (46)..(123): Pfam Name: C2 Pfam Description: C2 domain
MAGVLPRFGPFGPLPPSDEFGIRETRPRLAGRRAGGYDLVERMEYLYVRILKARDLKWTGSFDPLAEVKLGSYSCATRHIEKTTSPEWNDVFAFSRERIQASFLDVVVKGKGFAKDDFVGRLRFDLADAPLRVPPDSALAPQWYHVFNKKAERRGPSD

SEQ ID NO: 96052 - DNA, 1053 bp, Zea mays
  misc_feature: Ceres CLONE 1586517
  misc_feature (7)..(7): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (37)..(37): n is a, c, t, g, unknown, or other
  misc_feature (40)..(40): n is a, c, t, g, unknown, or other
ggggggnaggnnnggaaacgccgcgggttttttgaanctnacctcctcagcgccaagggggtgacttcccaaagcggagctccccgcggtggcggccgctctagactagtggatcccccgggctgcaggaattcgtctcacccctagaaaaaacgacaaatcgacgatcgccgcttctcttggccattgtagagggagagagagagcgcgagcgacctaggtcagtcggtttcggttttgggcgtcagcttcagctatccgcgaccgcgacgatgggtctgctcgtggccgccaccgcgcccagcttccgcccggccgtgcagcgttgctcgggcagggggcgcccccgccccttggacacccaccaacccttggggccggtttgttgggccggaagggaaaacccccttttcctcccgtggcggaaatgtttcccgttggccgaccccccccgaaggggcttggccccccccccctttttttccccggtggggggggggccccccccagaaaggaaaacccccggggttctctttgggggggggggcttttggggaaaaacttcccccccaaaaaaacaggggtgtgggggggggcgcgaaaggtatccattttccccctttttctcaaaaaagggggggtgggggcggcccccccccgggggggagaaaaaccagaaaagagggctctctcttttgttgtccccccgccgctgtgtttttgttcccgccaagaagaaaaaaccccccgcgggggggggggggcacaaaagaaagagccaccccccgccggggggggggggcgccccccgacttttttttgcggggggggggctcgcgccccctattttacacaaggaggggtgttttcctttttttctccctctgaacggggcgggcggcccataataatatgaaaagaacctccggtcacccttcgttctaacaaaaaaaaacaacaggcgcggggggggggggtttgtttgcaaaaaaaagagggaggggggggaggagaaaacaaactattcccctcccccagcaggcgggactgttt

SEQ ID NO: 96053 - DNA, 781 bp, Zea mays
  misc_feature: Ceres CLONE 1586525
  misc_feature: Encodes the peptide sequence at SEQ ID NO. 96054
gcggtggcggccgctctagaactagtggatcccccgggctgcaggaattcgtctcacccctagaaaaagctcgagccaccaaagaggccaagagcttaccttttacctaaagcagctgaggtacctcaccatcaccaccaccaccgacaccaactgcgccgaggccggaggcggagtagagccagaccagaatggtattggggggaggccctctaggcgccatcattggccgctacccctcctcctccgccgccgccggtgacgatgaacaaggggacccgggacccggaggaggcgtcattcgccatgaccgcaagtgccgggactggcccttcctcgtcctcttcgccgccttctgggttgccatgattgtcaactccagcttcggattcaaccagggcaacccactcaggctgacatacggactggactacaaagggaacatatgtggcagcaggcatgccgatcctgatttgtatcagttagatgttcgctattgggtgaaccccaaccaggtctaccaaagtggcctcaaaaccagtcacatcgagctacctgatgctaaaaccatctgcctgatggaatgcccacttcctgccgaagatggcttgaattttgtttgcgattatccagaaggtgacatacgcctctctgtcgacgactggattgacagggactacgattacttcgagtacctcacaccagacatgagggatagttctcttcagctgcagggtcccatgtaccctgtcatatttccaagtgtaaatgtctactggat

SEQ ID NO: 96054 - protein, 196 aa, Zea mays
  misc_feature: Ceres CLONE 1586525
MVLGGGPLGAIIGRYPSSSAAAGDDEQGDPGPGGGVIRHDRKCRDWPFLVLFAAFWVAMIVNSSFGFNQGNPLRLTYGLDYKGNICGSRHADPDLYQLDVRYWVNPNQVYQSGLKTSHIELPDAKTICLMECPLPAEDGLNFVCDYPEGDIRLSVDDWIDRDYDYFEYLTPDMRDSSLQLQGPMYPVIFPSVNVYW

SEQ ID NO: 96055 - DNA, 806 bp, Zea mays
  misc_feature: Ceres CLONE 1586527
  misc_feature: Encodes the peptide sequence at SEQ ID NO. 96056
  misc_feature (469)..(469): n is a, c, t, g, unknown, or other
  misc_feature (806)..(806): n is a, c, t, g, unknown, or other
tccccgcggtggcggccgctctagaactagtggatcccccgggctgcaggaattcgtctcacccctagaaaaagtatacaacacatctttcgcccgaccatacttgggtacttgccatcttcttccgcgactccaaacacagtgttacgcggcccacctgcacctgcaatgcaacgatcggtccctctcgagcagtagacgcccggttccttgtactttggcacccccatcacgtcgtctggtcaatctaaagcttggacttgcagcctcctcatcggtcgatcgatcggagtgacgtgctggggattgtaggtgcaagcgcgcgcgacattgcagctaccgagaagaaagcacaggggcgatcgagcagttgacgggcgtgcagcaatggcgggacttcacttcttgctcgtgccgctggtggcgcaaggccacatcatcccgatggtggacctggcccgcctcctcnccggaaggagagcgcgagtcaccgtggttaccacacccgtcaacgccacgcgcaaccgggccgttgtaaaaaacgccagcaggcggggctcgacctcaaggtcacggacatcgcgtttcccggcccgaggcacgggctgccggagggtctggaaaacatggaccttgctcacgaggagggagcacttcttgccccttattcccgccggcttggaaaaatggacccccccacttgaaggagtacttggcggtcgcttgccccgggtgcccggaactggcctcaaaaccaagaatctttggtaacccccttggaaaagggaaaaaaggtctttctcccn

SEQ ID NO: 96056 - protein, 127 aa, Zea mays
  misc_feature: Ceres CLONE 1586527
  misc_feature: SWISSPROT Homolog: EC 2.4.1.238 Anthocyanin 3'-O-beta-glucosyltransferase
  misc_feature (28)..(28): Xaa is any aa, unknown, or other
MAGLHFLLVPLVAQGHIIPMVDLARLLXGRRARVTVVTTPVNATRNRAVVKNASRRGSTSRSRTSRFPARGTGCRRVWKTWTLLTRREHFLPLIPAGLEKWTPPLEGVLGGRLPRVPGTGLKTKNLW

SEQ ID NO: 96057 - DNA, 1281 bp, Zea mays
  misc_feature: Ceres CLONE 1586532
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (73)..(73): n is a, c, t, g, unknown, or other
  misc_feature (74)..(74): n is a, c, t, g, unknown, or other
  misc_feature (93)..(93): n is a, c, t, g, unknown, or other
  misc_feature (386)..(386): n is a, c, t, g, unknown, or other
gtgtttttggtggggcgtggtttctctttcttcttcttggcggcgacnnnttttttttttnnnggggaaaatnncccactaaggagagtcccncggtggcggccgctctagaactagtggatcccccgggctgcaggaattcgtctcacccctagaaaaaaatccgtgttccgtgtccgcgtccagtgtgtccgctactccgctccccctcagtcctcagttcctcacctagcggtagcgtgcgcgcgggagacgtagatggcggcttcggaggcggcagccggcggcggcaacaccgggtgacgccgaacggagggggacggggatcccgattccacagcctggaaggagtggaacattctgaatccaaagaagcccaacaaccncccagaatgctgggtggtgaattgagcccccgggccgccggggggggggcttctggtttttccccccccccccccggagggggggggggggggggggtgtggttctttcccctaatatcccccccccctccccgcgacaattttcgttgcggggtggtaaccggcgtgaggctgtgtgggggaaaccccattccggactgggggcgggggcgcgtggcttggaggcgttgccggtgcgtgcggtcgtgggggggtggcttttttttgccctgtgatcatttcgttgtctgtgtcgcagcgcctccggatggggattggttaatgaaaaccacgtcgctgtatttcctcggctgcgtacgcgacgatcgcttcccttctgtgcattgtgattctgtctaggctatcctctcgcgatgcattaggcggatctacgtcgggagggcaggactaacatttagtaattgattgctctactttctatcccatctctcgatgtgctgcccaggggagccggtatcggaggattggtgcgggcatgacgcgtgcgcggtatctggggtgcggcgcgcggacgctcagggcgctaccgggctgcgggggctgggcatgtgtagggggttgggtgtgatgggcttggcggagtcgcgtatagcgactagtagggtggttgagcggaacactcccacccttctatcctccgctacattatatcttctggtagctggggtgcgtgtagggacacgctcggttctacgctgttgctctgcgcgcctgatcgagtcgacgccttgcctactgctccggctcgagcgcctcctggctgcgccctcggctggtctgtttgcgcgccgagcggtctcacggcagtgatgttctgtgacactgggatcccgcg

SEQ ID NO: 96058 - DNA, 894 bp, Zea mays
  misc_feature: Ceres CLONE 1586534
  misc_feature: Encodes the peptide sequence at SEQ ID NO. 96059
  misc_feature (551)..(551): n is a, c, t, g, unknown, or other
  misc_feature (877)..(877): n is a, c, t, g, unknown, or other
  misc_feature (894)..(894): n is a, c, t, g, unknown, or other
cggccgctctagaactagtggatcccccgggctgcaggaattcgtctcacccctagaaaaatatgtactttccttgacataccagaaagttccaaggcctattcttgtagaggcaatcaacatcgaaggtctcgcgttggacaagtttcttgagtaccatgccgcgaactcaggttgggtgattgagaagggtgggcagtctcaagtgattgttcttcccccgtatgagttcaatcacccagagctcaagaagaacacagccgatatccttccgtttgaacacgtaacacgcatattccctgtccttgggctgattcaggcgtgctgagaaatctatacaaaactcagcgagtgaagcttctcctaatcattgcatccttcggtttggagtgtaccccttttgaaatttatctcggtatacccagtccttttttatgcccgggagttggttttttgccacccttggggtatttggtttttaccttttaccaaaaggcctcgaattttgaaattgggtcttgttcccttcggaaggaggcttgtacaaaaanaaaaaaaaaaagaaaaaaaggcctttttgatccggggttccttccttgtttgcacccctccaaaagaaggggtgaccacaaaaggcccaaaaacccttcccccccccgtgtcctaaacccccaaaccaaaaaagggaaccggcaattgggggggtaaaccccccgggcttctggccgcggggcggggggggggcgtccgcactttgtggcgccccttgggcagggggccccacgcgcccggggggggggggatacctccacccgcggggggattttccttgggcctttagaaggggggggggagggggcccccgtaaagtaatagncccgggttctggttttn

SEQ ID NO: 96059 - protein, 108 aa, Zea mays
  misc_feature: Ceres CLONE 1586534
GRSRTSGSPGLQEFVSPLEKYVLSLTYQKVPRPILVEAINIEGLALDKFLEYHAANSGWVIEKGGQSQVIVLPPYEFNHPELKKNTADILPFEHVTRIFPVLGLIQAC

SEQ ID NO: 96060 - DNA, 969 bp, Zea mays
  misc_feature: Ceres CLONE 1586537
  misc_feature: Translation starting site: 126
  misc_feature (884)..(884): n is a, c, t, g, unknown, or other
gctccccgcggtggcggccgctctagaactagtggatcccccgggctgcaggaattcgtctcacccctagaaaaaacacaacacaacacagttctccctttccactccagtccaaccaaccgtccatgggtttcttcatcccgccgcccaaggtgtacaagccggcggcagaggtcgacctcgggccggacagcgacgagcactacatcagccccaacgtgaaagcgccccgcgtggccgggttcctggtgaagatgctggcctgggtgctggagacgccggtgcttggctggatcgtgctcggcgtcctcaagaaggacaacctcgtctacaagctcgtctcggacgctgagatcccggagccgccgctgttcacggccacccacacatgggcaagcgatccggggagcagagcggtgcgcgtggacggaacccgaggctgtccccgggcggaacccgttgcagggaggccgtccccctggcgtcccaagctggctgcccagggcccaacctgggaagccgggggggcgggggtttaagggcccctgggacgggggccgggaaattcccccccggggccgtaccagaaatccagggaaaggggttaccccccctaaccatggggggggggggccggccgaatttcccttgggcaaaccccgggggaaaggaaaagatttcccaggggcccggagacccttaaacacatggggggtttcttttaatacaagcgtggcgaaccccttggcggaaacaggtcttgtcgggcaaggcccaaaaaaaaccccccccccgccaaaaaccccgccaagaggggggcgcccccttttccccccatgggtatcggaatgggctgggctcccccttaaaggaaaacaaattgngactggcgtgccggatccccaaaacagggggggggaaacctgggtggtttgggtttcgcccccgccggtccccccgcgaaacacg

SEQ ID NO: 96061 - DNA, 837 bp, Zea mays
  misc_feature: Ceres CLONE 1586539
  misc_feature: Encodes the peptide sequence at SEQ ID NO. 96062
  misc_feature (327)..(327): n is a, c, t, g, unknown, or other
ctccccgcggtggcggccgctctagaactagtggatcccccgggctgcaggaattcgtctcacccctagaaaaagctgctccactccgctccgctcagctcgtcgggacgcgcccccgcctcccatcccatgcccgcccccgcgctcgtcggaggccgctcgcggcggcctcccatcccgccgcgctgacgagagggcctctcggtgggggcgcttcgggtgttcattttgtccgttcggggaaggggagtgcggcgatggggaagcagcaggaggggaagcggcggcgcggggagaagacggggtaagcggaaggggagggggaanactgctgctgcggcggtgccggaggacgcggcgccagtggccgggtgctggatccgcttcccgcgcctccgcggctgcatgccgtcgcgcgccaaggtcgactcctccaccagcgcgcgtggcggcggccgggaaaccaaaccatctactgatgatgcttgccaggaccaatcagtaccaccaggcctctggttccgcaacaaccagtaacactgggaagtatcctcacctttcttccttaggtgggagaggagcttaaaactagcctttccaactggcgtagatttactttttagtggaactgaaaaggtgccccgagaaaactcccaaccttgagatccttcttggcaaagggaaggttttggctgtgtcttttaaggatggattgagggagaagggaccggctcctggttaagccaggcaccggaattacctggtggctgtccagaacccccaaccctaatggggttgcagggggataaaaaggggggggggcaaaatttgatttct

SEQ ID NO: 96062 - protein, 43 aa, Zea mays
  misc_feature: Ceres CLONE 1586539
MPSRAKVDSSTSARGGGRETKPSTDDACQDQSVPPGLWFRNNQ

SEQ ID NO: 96063 - DNA, 901 bp, Zea mays
  misc_feature: Ceres CLONE 1586544
  misc_feature: Translation starting site: 236
ctggagctccccgcggtggcggccgctctagaactagtggatcccccgggctgcaggaattcgtctcacccctagaaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctggaggaggtggacgggaggcggtggagctacgtggtggacggtggggccgcgaaggggaggagcagggggcgggggccgtccccgctggggccgccgtcagggccgtgccgctgcagtcgccgcttccgcctggcgaggaaataatggcattcataagatcatatgtggtgccctgaaagggtttcccagaccagggttactccttccatatgtacccttacatgacctgggagggctcttgaagcattttttttggtggaccgaaaggggagtgttttacgacaaagaaccttggctgagtttctgttgggagtcctctcaaagcaaggggaaacacccgggggcgcattggttataaaattgggaacctttcaagggaatggtggcttggggccttttcccgggaaaaaaggcttttttttgccccggccacagggaaaagaaagatttgtgactattggaccctaaaggccgggttgtcgggtt

SEQ ID NO: 96064 - DNA, 849 bp, Zea mays
  misc_feature: Ceres CLONE 1586545
  misc_feature: Encodes the peptide sequence at SEQ ID NO. 96065
agctccccgcggtggcggccgctctagaactagtggatcccccgggctgcaggaattcgtctcacccctagaaaaaacaaaaatcgtcgtcagaaatttaacgacgcatattcgtctgactgacccgcccgtgcgccttcctcccgcctccccttccaccaccaagagtgacgacagagagacagacagagagaatggcggcgccagatgcccggccctcgtcagctggtccaccgccggcccgctccctcctcctgcctctcctgctcgtgctcctcctcgcggcctactcgctcccagccgactcagcagcgcgcccgtcctccaactccaacccacggcctgccttcacgccgccgctgctgaagcgccaccagctgcggcgcccgagcagcagcagcgccgagctcgtcgccgggcccgccaacgcgtcgaccaagcccttcacggcgcactacttcccgcagctgctcgaccacttcgccttcacgcccaacgcgtccacggtcttccgccacaagtacctccctcacgacaccttctggcgccggcccggcgccggcgccggcgacgacgggcccggcccgctgttcgtgtacacgggcaacgagggcgacatcgagtgggtcgccaccaacaccgggttcatgttcgacatcgcggccacgttcggcggccctcctcgtcttcatcgagcaccggttctacggggaagtcaaagccgttcggaaacaactcttaaaaggtcggccgaaaacccttgggcttacttcccgtccaccccaggggcctggccgaacttccccgttcttattaaggggcctggaaagcgggaaccccgggcgccca

SEQ ID NO: 96065 - protein, 218 aa, Zea mays
  misc_feature: Ceres CLONE 1586545
MAAPDARPSSAGPPPARSLLLPLLLVLLLAAYSLPADSAARPSSNSNPRPAFTPPLLKRHQLRRPSSSSAELVAGPANASTKPFTAHYFPQLLDHFAFTPNASTVFRHKYLPHDTFWRRPGAGAGDDGPGPLFVYTGNEGDIEWVATNTGFMFDIAATFGGPPRLHRAPVLRGSQSRSETTLKRSAENPWAYFPSTPGAWPNFPVLIKGPGKREPRAP

SEQ ID NO: 96066 - DNA, 823 bp, Zea mays
  misc_feature: Ceres CLONE 1586547
  misc_feature: Encodes the peptide sequence at SEQ ID NO. 96067
  misc_feature (660)..(660): n is a, c, t, g, unknown, or other
ctccccgcggtggcggccgctctagaactagtggatcccccgggctgcaggaattcgtctcacccctagaaaaagctcctgctacttgccccctcttatcagagagagtggtgtggtggcgcctccccaccatcaccaccagccagcaccacccctcctgcccctctgcgctggcgggccgagcgccgcgagcgagctgggccgcgggcggaggaggagtcgaggctgaccgaccccgcggccggcggcgacgagcggacgcagattcggcagccgtgcgcggaatgcccgtggaaggaggggagagagggagggcgcaggcgcagctgagctgagctgagcccgcgaggttcgcggtctgcggtgcggcggcagaggtctcgccagcgcgatggccagcggcggctcctccaggtacagctcgtacaaggcgccggggctgcgcggcgcgctgctggaggcggcgcacgtgtcgtgcctcgaggaccggtacgcgctgggcccgcagctggggtggggccagttcggcgtgatccggtcctgctccgacctggtcaccggcgaggcgctggcctgcaagtccatcgccaagggccggctcgtgtcccccgacgacgtgcgcggggtcaggctggagatcgacgtcatggcgcgcctggncggccaccccaacgtcgtggggctcaaggccgtgtacgaggaccgcgactcggtgcacctcgtcatggagctctgcgccggcggcgagcttctcccacggcctccagagcgcgactgcttccccaagcgcgaggcgccgcgctctttcgccccctccggaagg

SEQ ID NO: 96067 - protein, 144 aa, Zea mays
  misc_feature: Ceres CLONE 1586547
  misc_feature: SWISSPROT Homolog: EC 2.7.11.1 Non-specific serine/threonine protein kinase
  misc_feature (90)..(90): Xaa is any aa, unknown, or other
MASGGSSRYSSYKAPGLRGALLEAAHVSCLEDRYALGPQLGWGQFGVIRSCSDLVTGEALACKSIAKGRLVSPDDVRGVRLEIDVMARLXGHPNVVGLKAVYEDRDSVHLVMELCAGGELLPRPPERDCFPKREAPRSFAPSGR

SEQ ID NO: 96068 - DNA, 900 bp, Zea mays
  misc_feature: Ceres CLONE 1586548
  misc_feature: Translation starting site: 169
ctcaccgcggtggcggccgctctagaactagtggatcccccgggctgcaggaattcgtctcacccctagaaaactactgctcccgctccgctcctgcttggtcgagatcacttcgccgccgccgctttcgagatctccgggtggagcaagcgaggaaaggcagcagccatgtcgctccgcgtgctgaaccctaacgccgaggtgctcaacaagtcggcagcgctgcacatgaacatcaacgccgccaagggcctccaggacgtgctcaagacaacctcggcccaagggcaccatcaagatgcttgtgggtggagctggtgacctgaagctgacgaaggatgggaaccaccctcttgaaagaaatgcaaattccgaaccaaactgcaatcatggattgccaaggacggctgtggccacaggatgacacaaagtgggtgatggcaccaacctcccactgtgctattttatcgggggaacctaatgaaaacagttcccaacgggtgcattcaatgaaagggaacccatcccaaggttcttggggttaaaagggtttttgaaagttgcctaaaaagaaacgcggggctttgaatttttccccgaaaaaggtgtaaaaaacacccccccccctttaccgggggggaagaaaacccggaaagaaaaaaacccctttaaaaaagtgttgtgcggaaaaccaactcttttttgaaaaaaaaaaatttttttaaaaaggggggggggcggaaaaaacagtggacacgaaaatttttttggggggaaaaaaggagttttttgtgcttttttccaaaaacacaaaggaaaacccattttttttttttttttttttgtgggggaaaaaaatatacaccatccccgccccccaaatatttttgggggggtcac

SEQ ID NO: 96069 - DNA, 801 bp, Zea mays
  misc_feature: Ceres CLONE 1586549
  misc_feature: Encodes the peptide sequence at SEQ ID NO. 96070
ggagctcaccgcggtggcggccgctctagaactagtggatcccccgggctgcaggaattcgtctcacccctagaaaaaccctctcgatccggaaacctctgaaaccctagccgcctcctgcaagttgcagagctcaggaatctgcgccatggcgagtgagacggagaccttcgcatttcaggctgagatcaaccagctgctctcactcgtcatcaacaccttctacgccaacaaggagatcttcctccgcgagcttatctccaactcttccgatgcgctggacaagatcaggttcgagagtctcactgacaagagcaagctcgatgcacagcctgagcttttcatccaccttgtcccagacaaggccacgaacacgctctccatcatcgacagcggcatcggcatgaccaagtccgaccttgtcaacaacctcggtaccatcgacaggtccgggaccaaagagttcatggaagcccttgctgccggcgctgatgtgtccatgataggacagttcggcggctgcttctactctggcctactcgtcgccgatagagttgtcgtgactaccaagcacaacgatgacaagcagtacgtgtgggagtcccaagcgggcagggtcgctcactgttactcgtgacacgtcacgcgagcagcatgggcaggagcactaagatcacgcatgttctccaaggacgatcatgctggaggactttgaagagcgtcgcctccaggatctggtcaaagaacccctttgaagtcaaaaactaccccatgctcctgggggactgaaaagacaacgac

SEQ ID NO: 96070 - protein, 162 aa, Zea mays
  misc_feature: Ceres CLONE 1586549
MASETETFAFQAEINQLLSLVINTFYANKEIFLRELISNSSDALDKIRFESLTDKSKLDAQPELFIHLVPDKATNTLSIIDSGIGMTKSDLVNNLGTIDRSGTKEFMEALAAGADVSMIGQFGGCFYSGLLVADRVVVTTKHNDDKQYVWESQAGRVAHCYS

SEQ ID NO: 96071 - DNA, 932 bp, Zea mays
  misc_feature: Ceres CLONE 1586550
  misc_feature: Encodes the peptide sequence at SEQ ID NO. 96072
ctggagctccccgcggtggcggccgctctagaactagtggatcccccgggctgcaggaattcgtctcacccctagaaaaaaccgaaccaaaccaacacacgtcaaagcagaaaacctcagaaaaccccaatatatcctcgtccaccactgcccccgctctgctgcaactccactcggcccggccgccctttccacccaccttgatcctccgatccgttggtgcttgaccgatccatggacacccacatcggatccgtgaacggggcggcgtcgaaccagacggttggctgcccggcgtcggcgccggggtgcccgatggcgtccacgccggcgcagcccgcggcgaccctgtcggcgggggaggcgtcgctggggcgccacctcgcgcgtcgcctcgtgcaggtcggcgtcaacgacgtcttcgcggttccgggggacttcaaactcacgctgctcgaccacctgatcgccgagcccggcctgcgcctcgtcggctgctgcaacgagctcaacgccgggtacgccgcccacggggacctcccgcgcccgccggggtgggggccctgcgccgttcacgttcacaagtcgggggggctcaacgtggcttcaaaggccatcgggggggcgccctacagcgaagaaacctgccccgtcattttgaatccgccggcgggggcccaaattcccaacgaataagggggaacaaaacggaattcttttcaacaaaaaaccatttgggcctttccccgaaattctttttcaaggagagcttcccccttggctttccaagaaacggtaacccttggcccattagagggggggggggggaaaaaaaactttgggaaaagaaaggcgccacccaaaacagaaatttgaaacaccgggccaatttgggccccggggcaccttgtgaggggagaaaagacaaaacc

SEQ ID NO: 96072 - protein, 153 aa, Zea mays
  misc_feature: Ceres CLONE 1586550
  misc_feature (44)..(154): Pfam Name: TPP_enzyme_N Pfam Description: Thiamine pyrophosphate enzyme, N-terminal TPP binding domain
  misc_feature: SWISSPROT Homolog: EC 4.1.1.1 Pyruvate decarboxylase
MDTHIGSVNGAASNQTVGCPASAPGCPMASTPAQPAATLSAGEASLGRHLARRLVQVGVNDVFAVPGDFKLTLLDHLIAEPGLRLVGCCNELNAGYAAHGDLPRPPGWGPCAVHVHKSGGLNVASKAIGGAPYSEETCPVILNPPAGAQIPNE

SEQ ID NO: 96073 - DNA, 1029 bp, Zea mays
  misc_feature: Ceres CLONE 1586551
  misc_feature (40)..(40): n is a, c, t, g, unknown, or other
  misc_feature (723)..(723): n is a, c, t, g, unknown, or other
  misc_feature (764)..(764): n is a, c, t, g, unknown, or other
ttttttctttttttttcttgctctcttttttcctttttantttttattttcttcttctttttttttttattatctggcgcccaaaaaaaaaacaaactggaactccccacggtggcggccgctctagaatagtggatcccccgggctgcaggaattcgtctcacccctagaaaactcgtcgagagagtcgtccccccgcgtgctctccgcctgcggcctctgtatcccgcaaccaaaaactaccccccaaaaaaagaagaaaacccccaaaatcctcgagatctttttagtatccaagcggacttacccaatcccaattggttagggttttacttttccaaaaaaatcctaaaaaaaaaatttctggtcaaaggggggaggagggcaaattcccccccccaggggggcgggggggtccctaaaaggggggtccccgggaattttttccccccccccgggggttccccccggggaatttcctcggttgtggtttaaaccaccctcttcaaaaaagggtggtcttttcatttggggggggaacccaccggaggggggggcgcccccttcaaaaaaaacaccaatcttttttttgagaaaaaaattttttgcacaacacaaccccggggcacgagagggtgtgttttattataaggccccttatttttctctcagggaggagggagattgtttttttgtttccccggcccccgtcgttgtgttgtntgggaaaagaaccccgtttttatgtttggataaggaggccnccccccccccccccccctcggtttgtataggctctcaagaggaagaaaaatggaagtagagggggtgagaggagaaatatttttttcgtcccctatctcctacaaaaaacaaaaaaaagtatttcgtgggggggggggggtttttttatattaaaaccaccatgagggcgcgttaacctccgaccccctccccgcggggagagaggggcgcgccccgaagacccccctctttttctctttttacagaaagacaagtggttcctct

SEQ ID NO: 96074 - DNA, 1267 bp, Zea mays
  misc_feature: Ceres CLONE 1586553
  misc_feature: Encodes the peptide sequence at SEQ ID NO. 96075
  misc_feature (1)..(1): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (953)..(953): n is a, c, t, g, unknown, or other
ngggggggggtttggtgggggtgttctcgctttttctttnacgnnnatggggcccacaaacaggaaagggaaaaataaactggagctccccgcggtggcggccgctctagaactagtggatcccccgggctgcaggaattcgtctcacccctagaaaaaagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtcagaggacgactggatcggcgtcttctccccccccggaattcaactcagtcggctacatgatccaaacccatgggccagcaagaagaactctaatctctggcacaagcacccaatcaaggtatcaggttcgcccaaactacttcttgcgaaactaacattccactggggggctaaggggccgggtatccccggcctggcagtcctccattaagaacaatcggccttcccgaacaattcctaccattgcggccccttgtcttctaccccgggggtcgggcccctccaatgccaaaactcccggaagggccctgagaatccgccgggagcgggttcccggagagagcgcccgatattgatttgtgggttactctataagggaaacaccctctccacacaagcggccacgtgctccacgctgagggcatacactcccggacatgccccccgttggcgcacctcaaacgggggtttacccggttctcacacctgcggagaaaccncaaagagaatttgacaacggccagcgaaaaccaggtcgggactaacatatagtgtggggggattatcacacgcgcatgtctctagaatggtaagggtccgagcctacccgcacgttctactgtatgggtggaagtcaggggaggcgtgctaccccctctgagtgcccacccccctctctcccgaacatgggtgctggcgccgcttctccgtctgtaatcactaccggtgtctccaccctctgtattgggagagactccttagaaccactctgtcccggggagagcccgacctacaggctcgtatcgcggtacgt

SEQ ID NO: 96075 - protein, 147 aa, Zea mays
  misc_feature: Ceres CLONE 1586553
MAVALLAALVASAAMFMLAGTASASPAEGIQPLSKIAVHRATVEMQPSAYVRATPSLLGEQGEDTEWVTVKFGWKEPSEDDWIGVFSPPGIQLSRLHDPNPWASKKNSNLWHKHPIKVSGSPKLLLAKLTFHWGAKGPGIPGLAVLH

SEQ ID NO: 96076 - DNA, 989 bp, Zea mays
  misc_feature: Ceres CLONE 1586556
  misc_feature (259)..(259): n is a, c, t, g, unknown, or other
tcaccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccngtatcttcctgcctgagcctcgtccccaccgtgcaccaccgggccggcgggttccccagcaatgtggcactgacgaacacgcttcagcgccgtcgtcgttctcgccgctatcttggtcgtcggccttcggccgaagagaagcctgaacagggaggcccgcccccttgtgaccaatcgaggaacgtggaaacctcaggcttcttaaataaggcccgcgggcccgaaacaaagggggaagcttccccccccccccggtgggcggggagggtcccacgggcaaacaacaaactgggggaaaggggttctgcttgggaaccccaattcaaaaggggggggggccccctccacggggaaggcttataatccccttatagagggggagaagttttctcgcccaccgaggctcccaccctaagaaaaaagagggttatttaaaataatataaaaaagcggggttttttctccccctcataatggggggggagagggtgtgcaaaatacccccgggaggagagaaacatttttctttccaaaaaaaaaattggcgcttttgggggggaatattcggcaacaaaaaaagaaaaatcccccactttactctttaacacccactgtgtggagaagaggcccacaaaaagttcccccacacatgtgtgaaaaaaaaaaaaaccggccgctccacccccacaaaatatggtgggagggcatcgtggggcggaactttttttgg

SEQ ID NO: 96077 - DNA, 874 bp, Zea mays
  misc_feature: Ceres CLONE 1586560
tccccgcggtggcggccgctctagaactagtggatcccccgggctgcaggaattcgtctcacccctagaaaaaccttcccttccttcgcctccgcttcctcctcctcctcctcctgcccctcccccacccccacccgtcgggacgcctccccactttcccctcccccggatccgcatggcgcctctgcagcccgcgccgctcggcctcccgtagccgacgcccggccccgtcccaccgcccgctgcgccgagcgctgcccgtcccaggctcatatttgcacagagtcattggaggaagtttgatgtttcagcagtactgtgacctttattagatgtctttccgcagcattgtgcgtgatgtaagagatggctttggggagcttgtctcgaaccccgtttgagggtgaagtttctgggccaccgcccgagcagatctcacggtgctgtccatgagctggcgtgatccagccccagggatccagagcagttgctggggcttatttggccccctgaattgccttccaaatgtgatcggaaaggttgggagggccattgaagcccccattggcctaacaggaaagagtgtaagtcctcctggggccagctgttttgttcggacctgtggagaagaaaatctgccaaagaaaatcggttaagaaattccagagtttctctgggaaaaaatccctttttccctgtgggcccttaaaagcaagcccggggcccccgaagaagtaaaccattcccggtggctttccttccaaaggggggaaaaaatcttccccaaaaacccaactaacttggttttttgggggcctttaaacaacaaggcgtgggccttggttgagaaaagggggcaaagtttccttcccca

SEQ ID NO: 96078 - DNA, 801 bp, Zea mays
  misc_feature: Ceres CLONE 1586561
  misc_feature: Encodes the peptide sequence at SEQ ID NO. 96079
  misc_feature (801)..(801): n is a, c, t, g, unknown, or other
ctggagctccccgcggtggcggccgctctagaactagtggatcccccgggctgcaggaattcgtctcacccctagaaaaaagctgaaagagctaaactaccacacacacacacatcctacgcatcttctcgcagccatctttgtggaagcaaggcgggcaacatcgtgtggctagccagcaagagggagagaaacaagcacaagtatggcctcaaaacctggccctctgagtcgctggccatggcaagatcttggaaactacaagtacgcgctggtggctccatgggcggtgcgcagcacgtacaggttcgtgaggagcgggagcggggagcgggacctgctcgccttcgccgtgctgccggtgctcctcctccgcctcctctacagccagctctggatcaccgtgtcccgccaccagacggcccggagcaggcacaggatcgtcaacaagagcctcgacttcgagcaggtcgacagggagaggaactgggacgaccagatcctgctgacggcgctgctcttctacgcggtgaacgcggcggtgccggtggcgcagtcggtgccgtggtgggactcgagggggctgctggtggcggcgctcctccacgtgggtcccgtggagttcctctactactggctccaccgcgcgctgcaccaccactacctctacgcccgcggtgatccatccgttcgcggaagagctggtgtacttcaccctggtcgcccatccgctgctcaccatggtgggcaccggcaccgccctcgtggcgtgggcaacggctacctcgcctacatcgactn

SEQ ID NO: 96079 - protein, 198 aa, Zea mays
  misc_feature: Ceres CLONE 1586561
MASKPGPLSRWPWQDLGNYKYALVAPWAVRSTYRFVRSGSGERDLLAFAVLPVLLLRLLYSQLWITVSRHQTARSRHRIVNKSLDFEQVDRERNWDDQILLTALLFYAVNAAVPVAQSVPWWDSRGLLVAALLHVGPVEFLYYWLHRALHHHYLYARGDPSVRGRAGVLHPGRPSAAHHGGHRHRPRGVGNGYLAYID

SEQ ID NO: 96080 - DNA, 830 bp, Zea mays
  misc_feature: Ceres CLONE 1586562
  misc_feature: Encodes the peptide sequence at SEQ ID NO. 96081
ctccccgcggtggcggccgctctagaactagtggatcccccgggctgcaggaattcgtctcacccctagaaaaaatccaatccaatccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcggcgccgtcggtcccggcctccattgtcagccccctgctcaggacggggtaccatttccagccgccaatgaactggatcaacgaccctaacgctccgctgtactacaaaggatggtatcacctgttctaccagtacaaccccaagggcgcggtatggggcaacatcgtgtgggcgcactcggtgtcgcgcgacctgatcaactgggtggcgctggaggccgccatctaccccagcatcccgtccgacaagtacggctgctggtcgggctcggcgacgatcctggaggacggcacgccggcgatcctgtacacggggatcgaccggccggacatcaactaccaggtgcaggtgctggcgctccccaggacgcgttcgacccgctgctccgcgagtgggagaaaccggaggagtacaacccgttgcgacgccgggcggcgggggcatcaacgcgacgcagtccgcgacccaacaaacgcttggcggcccccggggcgggcacttgccggatcttgttggcacctgccccgccccccgggaatgcccttgtttacccgacccggacttcggggctggaaaaaagccat

SEQ ID NO: 96081 - protein, 234 aa, Zea mays
  misc_feature: Ceres CLONE 1586562
  misc_feature (58)..(226): Pfam Name: Glyco_hydro_32N Pfam Description: Glycosyl hydrolases family 32 N terminal
  misc_feature: SWISSPROT Homolog: EC 3.2.1.26 Beta-fructofuranosidase
MGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEAAIYPSIPSDKYGCWSGSATILEDGTPAILYTGIDRPDINYQVQVLALPRTRSTRCSASGRNRRSTTRCDAGRRGHQRDAVRDPTNAWRPPGRALAGSCWHLPRPPGMPLFTRPGLRGWKKA

SEQ ID NO: 96082 - DNA, 917 bp, Zea mays
  misc_feature: Ceres CLONE 1586563
  misc_feature: Encodes the peptide sequence at SEQ ID NO. 96083
ccgctctagaactagtggatcccccgggctgcaggaattcgtctcacccctagaaaaaactgatcgcccctcgaccctcgcgttgattggtcaattctcgcaggattagaaatttgtttagcagcacaaaaaaataactgaaacaaccttggagaacacgcgaatttccgtttgatctcggatctggccaattcggatttccatctccccctatcttcgctcgcgagctcctcaccgctcccccgagattaggggggagcgcaagtgcctgaagtaagcctaaacctaaccgccgcagccatgacggcgcccaagctcaagctcctagctcttcctactctgctggtcctcctactcctcctcctctccgccgcccggccgcgcgtcctcctgggagacgctcctcctccgcgccccggtcctccccggggcgaccctcctcccgctcctgcccctggcccagtggcgcaaccgcttgctccgccgacttcgcggctgggggggcccccgcccaacctgctccccggcctttcctcgggggcgccgcgcgccgccgggggtcccaacgacgccctaacccgggtcccccaaatgggaaggggcgcccttgctttctacaaagaacaaggggcttggggggtggagttcccccaaacgggacccgggggggggggtctccgaaggccgcgccttatcccatgttgggagaacctcccaaaggcgccccacggtggggactttggcaaaagaacttgggaatgttattttgccaaccaccccttaccaggaggttacactgggggagattaccacaacttttttgggggggcggaagagcccacctctcttggaatttctaaaaaatatggggaaaaacgccatatcctctaaatattggaaactttgtgtgaaaacag

SEQ ID NO: 96083 - protein, 99 aa, Zea mays
  misc_feature: Ceres CLONE 1586563
MGRGALAFYKEQGAWGVEFPQTGPGGGGLRRPRLIPCWENLPKAPHGGDFGKRTWECYFANHPLPGGYTGGDYHNFFGGAEEPTSLGISKKYGEKRHIL

SEQ ID NO: 96084 - DNA, 868 bp, Zea mays
  misc_feature: Ceres CLONE 1586565
  misc_feature: Encodes the peptide sequence at SEQ ID NO. 96085
ccccgcggtggcggccgctctagaactagtggatcccccgggctgcaggaattcgtctcacccctagaaaaatatccccatcagtcaatgcatatttgtcggaggcttcaaggcatgaaataaggcctcagggaacaccagaaaatgggtacatgtggaacagggttagccctcaattaagttcccctaatcaaccctattcattgagggaagcacttgctcaagcacaatcttcaagaattgggtcaaccgccagggcattgagagagtctctgcatccagtactgagacaaaaattggaactttgggaagaaaatctcagtactgctgtgagcctcgaagtgttgagaataaccgagaagttttcagctgctgcaggcactagaagcatcactactgattatgcgaagctagattgtgtaacatctatcgtaatgggtcttttatctaggagccaacccttggcattttggaaggctttccttcctgtggtctacaacatatttaatcttcatggtgcaacactaatggcaagggagaaatgaccgcttcttgaagcaaaatttgcttttcatcttttgcgggctgctgtttttcgaaatgattctattaggaaaagagctgtttgttgggttgcaaattctccttagggaagcattcaactattttcagaaaccttccaagggtgaaaagtcatggttgaaaattacttttgtcagaattgttggtctgaatgtgcaagggactccaaatggaaatcccaagggtgtttccttgaaaaaaaagggggtaaaccctcggccccctttaaaaaaaatcaactgtggagagaaaatggcgttaaatttaaaaaaagcaatagggtttt

SEQ ID NO: 96085 - protein, 130 aa, Zea mays
  misc_feature: Ceres CLONE 1586565
MWNRVSPQLSSPNQPYSLREALAQAQSSRIGSTARALRESLHPVLRQKLELWEENLSTAVSLEVLRITEKFSAAAGTRSITTDYAKLDCVTSIVMGLLSRSQPLAFWKAFLPVVYNIFNLHGATLMAREK

SEQ ID NO: 96086 - DNA, 1244 bp, Zea mays
  misc_feature: Ceres CLONE 1586567
  misc_feature: Encodes the peptide sequence at SEQ ID NO. 96087
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (9)..(9): n is a, c, t, g, unknown, or other
  misc_feature (10)..(10): n is a, c, t, g, unknown, or other
  misc_feature (17)..(17): n is a, c, t, g, unknown, or other
  misc_feature (993)..(993): n is a, c, t, g, unknown, or other
  misc_feature (1066)..(1066): n is a, c, t, g, unknown, or other
  misc_feature (1079)..(1079): n is a, c, t, g, unknown, or other
ntcggnntnnggtgttnttggggccggggccgtcaacgaatatacaactttataaaaggacaaaaaacaaaacaaacgaaagaagaagactacccccgctggcagccgctctagaactagtggatcccccgggctgcaggaattcgtctcacccctagaaaaaaccgccaccaccgcctacctccaccaccagtccatctcctccgcagcgtctaaagccctatccggatatccccactcgccgacgcccggacatatggccagcttcggcgtcgacacccgcccggccgccgcggcctccggcggcggcgtgggcgtggcggggacgagggagggcgcgctctcgttccctctcccgcgggctgcgggaggacctccgtctcatctgcgcgcgggccggggagctcgagaccttcctcagcgcgccggtgccggaacccgagctgttcgagcgcctccgtcgcgcctactcctgctcggcgtcctcttcgcggacgcggctcggaactgtccgccatccgggaaggccttcgaaggccgacacgatgaaagggcgcccaggaacttgcccaccgtgcgaaggggggggaagggccggtacaccggaaggccggaaggaagctgggaaagcccagtcccaggaacgggtcccaaaggggccccccacccctctcaaggggaagccttccccaaccccggaagaggagaaaggccctttggtccccccaaggttcgcacacccgccaggcacgaaaaccatgtggcccctgggccacccaaaaagggcgcttttcctaaagcgcgctcccccacaatcttttgtgtggaaaaaaaactcgccactctgtggagacaccccttctttgtggaccagccccccctgtggaaaatcacccgctctccctttcggagaaggagaaagtcgttttctcattgcgccccccaaccactgtgtggaaaacttttgtgaggggggggggaaaaaccactatnccctctggggccctgttaaaacattctgtgcgacaaataaacacacaaattctctctggttaacacccaccgnacgttatctgganaacacgcagaatgttggtggcgtatatagacaaatcaggaagtatttgctcagtgcgtctacacacaagagcgtgtggttgatcaaacgtttctcctttgttgcgacgtgaacaaggccccacaagaggtacctcacccacactgtaataataagcgttattcgc

SEQ ID NO: 96087 - protein, 237 aa, Zea mays
  misc_feature: Ceres CLONE 1586567
MASFGVDTRPAAAASGGGVGVAGTREGALSFPLPRAAGGPPSHLRAGRGARDLPQRAGAGTRAVRAPPSRLLLLGVLFADAARNCPPSGKAFEGRHDERAPRNLPTVRRGGKGRYTGRPEGSWESPVPGTGPKGAPHPSQGEAFPNPGRGERPFGPPKVRTPARHENHVAPGPPKKGAFPKARSPTIFCVEKKLATLWRHPFFVDQPPLWKITRSPFRRRRKSFSHCAPQPLCGKLL

SEQ ID NO: 96088 - DNA, 936 bp, Zea mays
  misc_feature: Ceres CLONE 1586569
gagctccccgcggtggcggccgctctagaactagtggatcccccgggctgcaggaattcgtctcacccctagaaaaagttcttctccctccgtccgaccgtccctcgacagtgccgaggcgcaacctagcagccgcccacacggcgcgacatccactggcgcaagcgaaatccgcaagggccaacggatcgccggccggcgcgccgccagcctcctggctcggccgtcccgcggctaacgcaggggcggaaaggccggccagccgcccacaccccacggctcatccggccagccaggcggaaacgaccgtaagagggaagccgcagccggccgctgactccgatcccacctctagtcaaccacagtcagaccgatcctcctcgtctgaccacgacggccatctcgcacgcctacttccactcaaccacataagtcttttctgccaggcctaacctttcccctgccccgcctctactggttttgcacagtgccgtgacgtgggaagaactggagatcccaacgaaaataaaatttattttcttccttcttcgggggagaaactcaaaaacaacccttctagggttcctcagccttgcgccaagatccccgtcgggggttggcccgccctccccatgggaactaccccaaggggggcgggcgccatccacccaggggtggaaagaatatctggccgttaaggtcaaaaacacttaggaattaaggaggggggaccggcctaatttaggttttttccaatagggaaggggaaaatccctgtggggggaaagcctaaacccctacttttgcttcggacaccgggggaattaaaaatgtggccctccaatttggcgcaacaaggcacaatttttcttggggtgggccctaattggatttttagagccattctcgcgagagctctcttggagaacatattgg

SEQ ID NO: 96089 - DNA, 1012 bp, Zea mays
  misc_feature: Ceres CLONE 1586572
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (93)..(93): n is a, c, t, g, unknown, or other
ggggggggggtgggggggggggcaagatggcacgcactgaggcggtgtatatattaagcttnnnttgtttttattaaaaactggaactccccncggtggcggccgctctagaatagtggatcccccgggctgcaggaattcgtctcacccctagaaaaacgctacccttccgtcgctcctccggtcctccccacccacgacccctgccggaagggcaaaaggggctcgaaatcggtcccctgatccaggagccaatcttctagttctcccaaatccttttccggatccgaactgcaagtcctccttcgcgaccatggatccacgcgccaggtatccttcgggcatgggcaacggccgcggtgggacccctaactactacggccgcggcccaccgccgcaacagccgcatcagcaccaccaccagcagcagcagcagacatcgggggcgcatcaccaccagcagtacgcgcagaggcagcagcaacagcaccgccacagccacaaccaccagcagcaacagcagcagcaccagagtcagcagcagcagccagcagtgggctgcggcgggaatcagattgccccccaagggccgccgggcgcaacccgtgaacccagcgagccgaaaagcccctgggcggccatcccaccggcccgcccgaacgggcggtcaaatttccaaagtttccgcaaaaaaatttgggaaaaaaccccaaatttggaaaagcctttcccgccccttcccggaataaccaccccctaccacggggaacagaaaggaatggttataccagccccccccaagggggaaaaaagagaagttttggaaagaaactaatttttttcctcaaaaggccgtggaaaaccccccctaaagtggggggaatttttacccaaaaaagggggaaattttgaaaaaaaaaccccttcttcccctaattttcacaaaagggaaaaggccttttccccatttggccctttttaaacctggggaaagtggacaaatttcctttga

SEQ ID NO: 96090 - DNA, 936 bp, Zea mays
  misc_feature: Ceres CLONE 1586574
  misc_feature: Encodes the peptide sequence at SEQ ID NO. 96091
agctccccgcggtggcggccgctctagaactagtggatcccccgggctgcaggaattcgtctcacccctagaaaaacacgacctgtacctgccccgccgcccaccggacgcaaccgcgtccgaccaccgccgccggaaccctacgcccccgcctcgccgcgccatggcggatccgccgcccgtggctgcctccgccttgccggcgcagcccgaccaggtcgccgcctccgtgtccaccccgcagaaccccaaccctaaccccctcctctccccccaaatccccccgtccccgaccgtctccgacctctccgcgcacatctcgtcccctcagcagctcgacccggtggctgcggcagctgccgcttcgggcggcgggggatccatggattaccccccgcgcccgccgcagctgcaggcgccttcgcccacgcaggcggggcccgggcgccgccgggttttggccagatcccccgctcgggggtcggcctcacgcctcttcacgggccagccagcttccagcagtacgcggcttgggatgtacgggcgggcaaatgagccttctccgggtggggggaaggcttcgggggcccaaagccagccacctgggcgggggcgcccccccccgttgctttgtggccggggccccacttgggggatttcttgcaaaggcccaggggtaaacccctgggaatctcccgggcccattttttggggcttccagtccgccaaaagaatggggccccgggcttaggggaaaaaggggctgtggctaccaggggcaccccatttggaaataatggggtaaaaccaggttcaagggcgtttcaaaggggattgtcccccccctggggggggtccaggggggacccattgggcggagtaaccccggtaggggacccccaagtgggagcgcttttcccactattgggggcgccg

SEQ ID NO: 96091 - protein, 195 aa, Zea mays
  misc_feature: Ceres CLONE 1586574
MADPPPVAASALPAQPDQVAASVSTPQNPNPNPLLSPQIPPSPTVSDLSAHISSPQQLDPVAAAAAASGGGGSMDYPPRPPQLQAPSPTQAGPGRRRVLARSPARGSASRLFTGQPASSSTRLGMYGRANEPSPGGGKASGAQSQPPGRGRPPPLLCGRGPTWGISCKGPGVNPWESPGPIFWGFQSAKRMGPRA

SEQ ID NO: 96092 - DNA, 825 bp, Zea mays
  misc_feature: Ceres CLONE 1586575
  misc_feature: Encodes the peptide sequence at SEQ ID NO. 96093
ctccccgcggtggcggccgctctagaactagtggatcccccgggctgcaggaattcgtctcacccctagaaaaaactcttaagaccaaaaaagaaacgagaaaaaaagaagagagctgctctgatggatcgctccacctccctgctccggctcatcttgcttgctcttggcgcagccctggtgctcctcgccgtccgctccgccttccgcctcccacgtggaatcgacacacccaccacctcactcttcgatgacgaagccaccgcgggcagcagctgcacccggttcgcgccgtgggggtgccggcaagccgaccggattaagcagaagccgccgtcgcacgagaacgacgtgccgcggcacccgctcgacccactgacgatcagcgaggtaaaccgtgcgcgcgagctcctccgcgcgcacccgccgttcgcatcgtcgccgtcgtccatgttcgtgcactcgctcgcgctcgacgagccggacaagcccgtcgtcctgagctggcggaagggcgtcgacccgctgcccccgcggcgcgcggtggcggtggtccggttccgcggtgaggccttcgtcctggccattgaccctcgcagcggcgccgtgactcctctgcctgtcccagcttccgggtacccgaccatgaccatggacgagcaggtgctcctctgctacacgcctttcagggaacccggcgttcacgcgaccatccagcggaacggcgtccggctgtccgatgtcgcctgcctgcccatcttggctcgggggtacggccccaacgaggaaaacggccgctgattaagattcagtgcttttcccgga

SEQ ID NO: 96093 - protein, 225 aa, Zea mays
  misc_feature: Ceres CLONE 1586575
  misc_feature (80)..(168): Pfam Name: Cu_amine_oxidN2 Pfam Description: Copper amine oxidase, N2 domain
  misc_feature: SWISSPROT Homolog: EC 1.4.3.6 Amine oxidase (copper-containing)
MDRSTSLLRLILLALGAALVLLAVRSAFRLPRGIDTPTTSLFDDEATAGSSCTRFAPWGCRQADRIKQKPPSHENDVPRHPLDPLTISEVNRARELLRAHPPFASSPSSMFVHSLALDEPDKPVVLSWRKGVDPLPPRRAVAVVRFRGEAFVLAIDPRSGAVTPLPVPASGYPTMTMDEQVLLCYTPFREPGVHATIQRNGVRLSDVACLPILARGYGPNEENGR

SEQ ID NO: 96094 - DNA, 1332 bp, Zea mays
  misc_feature: Ceres CLONE 1586576
  misc_feature (992)..(992): n is a, c, t, g, unknown, or other
  misc_feature (1097)..(1097): n is a, c, t, g, unknown, or other
gaatgtaaattttgtggaaacgcgaacagatataaatatatatttgttggtgtggtatgaacaccatagaagggtgggctctcctccgtggcggccgctctaaactagtggatcccccgggctgcaggaattcgtctcacccctagaaaagggaactgaaagcaaaccaaaaaagaaagagagggggagagacacagaggcctcactccacacactgtacttgtctctcagtcccagagctttcttggatcgcgaggaatccacttggaaattttgcaattgtagtagaagaactgtatcgtcatatgaaggtgcatggtggttggccatgggacacggcatggaaacaaagactagcagggcgggggactctccccccaagctcattaatccctgtcctccgctgttaaagtaattcctgccggaggaccccccgaatttccactcgaaccaaacaccaccatggaaagccggctcccgagggcaccccgcaccccaccctggggatgacgaagaaaccaaatccctaaaacaaatgaagtgttcaccctccacccttcccccgggatggtagagggggaacctctttaaccctctttacccctctcacacaagtgataatgaattgggccctggtcgcaccccgcgggccgtgggagaaaataaaaaaaagtccgggcgcccatttgaaaacatcccaaaacacacggggtttcggccgaccatattgaggaaaacgggtgaaatctttctcacaaaagagtggtgaagaataaacaaaaaaacttcagagaaaacccccgacgatgaaactcacaaaaagaggcatcacctggtcaattgtgcgtactatcgaagatcaggacacacctctgatgacccctttgtaagagatcatacatcgaatctcccacagatgtacatccccactctctactctggagagatatactacgaacataaatacaattaatctagtattgcgtccatancatagttgaaataagaatacccctcataccacatcaaatacgaggtatgccttctccaaatctcatcacagcacccggaagcctcgttcaccctatcagcgtcgntcccaataattcgtaaatagtttatcttttattttgagacactttagataaccacgtaattgtcacgcatctacattgctatcatcacgggaaacagaagagatatatcgccactcttttttgtgtttgtgcgatggaaaatcacgagaggagaccacctcctcagtgtcggcaaaaagcccactataaccataggacaaagacatagagagtagcgctctgctggtaacaactt

SEQ ID NO: 96095 - DNA, 805 bp, Zea mays
  misc_feature: Ceres CLONE 1586578
  misc_feature: Encodes the peptide sequence at SEQ ID NO. 96096
ggagctccccgcggtggcggccgctctagaactagtggatcccccgggctgcaggaattcgtctcacccctagaaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagatgtcaacgtcgacaatttcttcgctgttctgcttggcaacaaaactgctctcaggggtgggagcgggcaagttgtggacagtggcccccatgatcatatatttgttttctacagtgaccatggggggtcctggcgtcccttggaatgcctacgtatccatatcttctatggtggatgaactccgaaaatgtcctggaaggaagaagcatggctgcccgggacctaacaaaaaccctgggtctttttaccctttgaaac

SEQ ID NO: 96096 - protein, 185 aa, Zea mays
  misc_feature: Ceres CLONE 1586578
  misc_feature (49)..(185): Pfam Name: Peptidase_C13 Pfam Description: Peptidase C13 family
  misc_feature: SWISSPROT Homolog: EC 3.4.22.34 Legumain
MVADRLRLALLLSACLCSAWARPRLEPTIRLPSERAAADETDDDAVGTRWAVLIAGSNGYYNYRHQADICHAYQIMKKGGLKDENIVVFMYDDIAHSPENPRPGVIINHPQGGDVYAGVPKDYTGRDVNVDNFFAVLLGNKTALRGGSGQVVDSGPHDHIFVFYSDHGGSWRPLECLRIHIFYGG

SEQ ID NO: 96097 - DNA, 1092 bp, Zea mays
  misc_feature: Ceres CLONE 1586579
  misc_feature: Encodes the peptide sequence at SEQ ID NO. 96098
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (39)..(39): n is a, c, t, g, unknown, or other
  misc_feature (1010)..(1010): n is a, c, t, g, unknown, or other
ntattattacnnnaaaaaacctcccccgactcttcattntatatttcccccatcatttagtaaaatcatgtaggagtaagctggagctccccgcggtggcggccgctctagaatagtggatcccccgggctgcaggaattcgtctcacccctagaaaaaaatctccctcccgttccctttcctcccccgctccgcctttccctttcctcccccttctcttcctctctcctctccttgggggcgcggcgagatcgggcggaggagccctaccgccccccctcgccgcagcggaggcgggtgctcagctccgcggaaggttagaggtgcggggctgcgtttggaaccggcggtgggcgcgggagatccggccagcggggatgcagcaggaccagcggaacaagacttctgcagaggtcgacttcttcacagagtacggggatgcgaaccggtacaagatccaagaggtcatcagcaagggaagctacggggtcgtctgctctgccatcgatctccacactcggcagagggtggcgatcaagaagatacatggcattcttcgagcaacctctccgatgccgcgcaggatccctccggcgagatcaagccttcttaaggctccctggaggccacccctggacattttgtccgagaatcaaaaccacaattaatgccttgcccttcccctccgaagaaaagagagactttccaagggaaccaatttgttccatgtggtattttttggaagaccttcaatgggggaagtttccccggacaccttccccaacccgaaaggttttataaaaaaagaggccccaaaccggaatgtgaacctttgggaccccaagaggggaaggccaatttttcccccggggttccctttctgcctccgtaaatccaagtattaacctctccccggggccccccctcctaagaaataacccattgttcacttaacctgtggctaaaaaatggtttttaacccacccccgctgggatcccttcccacaagncccccgaaaaacaactaattttcttaagcccacaaacttctctaactcccgggcaagaattgtggaaaacatcgatagttgt

SEQ ID NO: 96098 - protein, 96 aa, Zea mays
  misc_feature: Ceres CLONE 1586579
  misc_feature: SWISSPROT Homolog: EC 2.7.11.24 Mitogen-activated protein kinase
MQQDQRNKTSAEVDFFTEYGDANRYKIQEVISKGSYGVVCSAIDLHTRQRVAIKKIHGILRATSPMPRRIPPARSSLLKAPWRPPLDILSENQNHN

SEQ ID NO: 96099 - DNA, 915 bp, Zea mays
  misc_feature: Ceres CLONE 1586580
  misc_feature: Encodes the peptide sequence at SEQ ID NO. 96100
ccccgcggtggcggccgctctagaactagtggatcccccgggctgcaggaattcgtctcacccctagaaaaaagcaggcccagctccaaccaccgctcgtctcgtctccttcctcctctgcttcctcccgtctcgtctccgacgacctcgtctttcccccccagccagcctcgcctcaccgactccccgatccggtccctcccttcgccagctatgcatccctcctccggcgcgggggactacgccccttactacccaccttatccctccccggccgcgccgcctcccgccgcctacccgtcggtgtccgccccggcttctgcgcccccgtactcgtcgtaccccgcggacttcgcccccgcgccttcgtaccccgcgtacccgcccgccgacctcccccactacgcgccgccgccggctgcgcccgcgcccccgcagccgtactacccctacgagccggcgccggcgccaccgctgccggcgtccccgcacaacccggttccctctccgtacccgtcgctggatcgggcggggagctacggctaccggatcggggcctggcttccgggtacggcccaggagctgtaacccgcccaaggccgggcggggggggtgggtcccaaccaacgggagcggtccgccttaaaacgggggggggaacccgcctggaacccggttccggggctccggggggcaccgccaccgaagggccggggtttcggggaccccccccttgtttgaatgacacacgggagggggccctttgggctcaactttgccgaaaagggggtgggccctggggggggtaatgggcggcccaagccccacagggtggggtgggggggctcttgcccccaagggcagaaaaccttctcgagggacgctttcgggggggggggggggtggaggaaaaag

SEQ ID NO: 96100 - protein, 124 aa, Zea mays
  misc_feature: Ceres CLONE 1586580
MHPSSGAGDYAPYYPPYPSPAAPPPAAYPSVSAPASAPPYSSYPADFAPAPSYPAYPPADLPHYAPPPAAPAPPQPYYPYEPAPAPPLPASPHNPVPSPYPSLDRAGSYGYRIGAWLPGTAQEL

SEQ ID NO: 96101 - DNA, 881 bp, Zea mays
  misc_feature: Ceres CLONE 1586582
  misc_feature: Encodes the peptide sequence at SEQ ID NO. 96102
gcggtggcggccgctctagaactagtggatcccccgggctgcaggaattcgtctcacccctagaaaaaaggcttcccagcccctagattctctctcgcgcttccgctttcccttctcctggtcctggccatggcccacgaacgggagccgctcctgcagcaacgacagaccggcgtcggcaatgcctgcggtgccaagggctcgtcctcggcgccggcgccgtcggctgccgcgctgccgtcgctggctaggaccgtgctcaagttcctgatgtgggcggtgttcctcacctgggccgcggggatcttcctctacccgaccaagcccgtgcaggccgtgttcaggaagtgggtcgggctcaccagggactccatgttcggcatcgtcgggggtattttcctgaccttcagcgcgccaattctgatcattgcgcttctcgcatatgtgtacatctccttcttcccgagtgaacatgtggtggagaaaaggaagctgcgctcactgagtttcaggctctggactttccctggttcttgaaaacggccccctttggagttgtctctgccagttgagtttcattcgaaattggccttggttaaaaggttttttggttgtcaaccccaatgacctatttatgcccgtggaaacctgttgaatccttggttttcgaaaatttgacctccccatccaatgaactgagaagggaatttggaaacctggaaagtcatttggccctccgttttaaggggccgggttggggttggttctggaaaggcctctttccctccttcctggcccaattcgccaccagaggttccgggttttcttttaccgggcttataccaaaatttcccattttggagacatggcttaccagaaaa

SEQ ID NO: 96102 - protein, 135 aa, Zea mays
  misc_feature: Ceres CLONE 1586582
MAHEREPLLQQRQTGVGNACGAKGSSSAPAPSAAALPSLARTVLKFLMWAVFLTWAAGIFLYPTKPVQAVFRKWVGLTRDSMFGIVGGIFLTFSAPILIIALLAYVYISFFPSEHVVEKRKLRSLSFRLWTFPGS

SEQ ID NO: 96103 - DNA, 1229 bp, Zea mays
  misc_feature: Ceres CLONE 1586583
  misc_feature (33)..(33): n is a, c, t, g, unknown, or other
ggttgtgggtggggtgtggtcgtttggcgtgtntttcttatatcttagataataaaaatataaaaaggaaaaaaaaatggagctcccctcggtggcggccgctggtggactagccgtgatgcaccgcctcgagtcgtatttgccgtcaaccccaaactgatgaccactgacaagctagcagccgccgcgcgcctcccatgggttgaagccgatcaagcaggcaccggcggcggcgcgagggaggggcttcagcctcgacgccgctcgacaccgttgccgccgaaccctagggtgccctccgccgcgccgcagaggaagattcatggcgagggcggccgctcgtgaccaaccctgaggccgatcaaagaagcccctcgtgcagcggcgcaggggcgtcagcatcggccctttggagaaccaccacggcgtcggcagcaagccccagggcgaccgtggcggcagcgcagggtcaaatccactctccaacaagctcagtgccctcccgaaaggaaaagggcaaccgttttgaaagaaaacaaccccgtcccccaaccaagacacggggggccgtccctgcaactgggcaaagaaccccgcttggaaatggccaaggcaaaaagccccccgttaaacaaagacatgggcgccaaaagggcggaaggaagcccgggggagcttattgaagataccaccaggccagggcgtttaaatgggagagggcgcagtgctcccacctctttgccaaagggagattaccccggaaagaacaaaaatagagggcgacaggggcctaaacatctgcccaaaagaggggctcttcgcacagaagagggctcaacagggggggtggggggggggaaaaacactccataacaccaccctgtcgggtgaaataaatataaaacaaaccgtgtgggggccgtggaaaaggaggggttttcacccgagctctcccaaaagatgcacaggggaggtgtggcgcgcgattattttataagacaggggggaatggggaatatcccataatcggggggtaacaaaaagtccaccgcgcggtgtaggagacactcccctgaagggttcactaaaatttggttctctctaaaagacgagctttataagggctattcacgtgcccccgggaatccggtcttccctaaataacactgctcctcctctatgaataacaacagagggagaaagaatattggcaagaaggatacccctcc

SEQ ID NO: 96104 - DNA, 1324 bp, Zea mays
  misc_feature: Ceres CLONE 1586585
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
tgtgttgttggaggtttggaactgcgtggactccgtgggtagtcttttgggttattnnnngggccccgcgggacaaactggactccccacggtggcggccgctctccaacagtggatcccccgggctgtttgtcttcgtctcacccctagaaaaaactccccattccgctccgccgccgtctttttcgcccgcgacccacccggactcccgcttcgatctcgcccctatggccccgctcacgcccccaacccgattcgtccctctcaccctcgcgggggtgggaagacagcgatcgcagggggcgggggcctctctccccgccgcgggtgacctctcctcgcgcggggagccctcccgcgtgcccaggcggaggatcccgtcgcggctggtgcactaccacctcctctccattcgcacactccctcgttgctctctcgcgcgtcccctcgaccttagatagggtttgctgccttcccccccgccccgcccgatttgatctcagtcccgatcccgggactccggcgtagggatgactccggtctctccctccctgcggccagggtgtcctctacacagggcgtccctaatttccctcccctacggacccgcctagagaaccagtttagcccggttctagcaaaagcaggaacgggcccagagggcccctacggcgagttcccccccgccccccggaccgttttcggggacaaagggggtccccgttaacaaatacctgcgtggtgcacatgcgaatgcggggattccctcttgctacctgtccttcgtccagagagggatgctgtgccgcccctgcttttaaaaagcccccccaccgtgcggaacggagttgtgctccccgctagaacgaccaagtaaaactgtgttgggggtggcctccggcggactcgagaccttccccatcccccgcacggacttccaggcttaaaagagagaggccctgttctgcgccctcctggaccctttgggcttatgtttgtattgcctcagggcgccgcgtcagcctttctcagcctagacggagaccaaggggtccccggccccccgatgacggcgatgattctcctatctgccaaaacgctcagagcaatgggtatttcgcacgaggggcagtgtgtcaacctgctagcgtgatcacggattgtcgcgtgccctatgtctcacgtgaggttaggtcgctttaaatcacttttcgctgatttatctctgtcgggtcgaatgtcaatcctgctacaattgatgtttggtgacgaatccatctgtacctttttgtaaaaacaagccgattactcgtactcatgtctc

SEQ ID NO: 96105 - DNA, 1010 bp, Zea mays
  misc_feature: Ceres CLONE 1586586
  misc_feature: Encodes the peptide sequence at SEQ ID NO. 96106
ctccccgcggtggcggccgctctagaactagtggatcccccgggctgcaggaattcgtctcacccctagaaaaaactcctcccgatctgggcgcggacgccaacgacgcgacggcccaagtcgcgacgccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgccgccgccaccggcgagggccttgtgcggcagctcggcgtcctcgacctcgtgctgctcgggatcggtgcgtccatcggcgccggcatattcgtcgtcactgggaccgtcgcccgcgacgccggcccaggtgtcacgatcaggttttgttcttgctgggagctgcgtgcggtgcttcaaggctctgtgcctatgcctgaactgggcggtctccggttcccctggctgtgggttgggggggaaacatactttgtaccacggaaccccagccggtccaatgggaaatcaccccgcctttcttggggcctttcacttcagagtggaatgggtggggaattacccataaatcggggggccaagcaaaggaattttgtcttcggcaggcttttaagccaaggcttacctttttaatcgggaggttccttgggggagcctaaatccccctgttctcttgaaaaaggggcccaaaatttccccaaggccttggggtaagggcccatggtggcggagggagaattttgttgtggggggggggggtttggattcacaatttaaaagatagattgggcgcgcccctgtgcttttcccggaaacgtgttgaaagggtcgagaattctctcgtgcaaatgagggggccaaagaaaatatcctgccgcgcgggtgggaacgcctgttttatgaacgccaccttgcgaagaaacagtccggtgggcatgtagcggatgtggggagtagtgggg

SEQ ID NO: 96106 - protein, 174 aa, Zea mays
  misc_feature: Ceres CLONE 1586586
MEEARDHRLSSTAGRPFLSGFCAAALRRKPLGARASAAAAATGEGLVRQLGVLDLVLLGIGASIGAGIFVVTGTVARDAGPGVTIRFCSCWELRAVLQGSVPMPELGGLRFPWLWVGGETYFVPRNPSRSNGKSPRLSWGLSLQSGMGGELPINRGAKQRNFVFGRLLSQGLPF

SEQ ID NO: 96107 - DNA, 755 bp, Zea mays
  misc_feature: Ceres CLONE 1586587
  misc_feature: Encodes the peptide sequence at SEQ ID NO. 96108
  misc_feature (141)..(141): n is a, c, t, g, unknown, or other
  misc_feature (422)..(422): n is a, c, t, g, unknown, or other
tccccgcggtggcggccgctctagaactagtggatcccccgggctgcaggaattcgtctcacccctagaaaaaacctcctctcccaccaccgcccccgccgtcgcctgctgttccatgaaggactaatccgtcggtccacnttctcagctatggcgcagctcgcggtgcggtcgctgctgctgtccctgctcctggtctcgccagttgtggcttcacctggtattgtgaagctcaactcgtcgtcgaccctcttcggcatcgagttcccgccgttcaacaccgccgtcgccgcgaccggctgcgacagcaagctggttgcagccgacgaggcgggggatgagcagaagcagccggcgagctcgtccccgtcgctgcagctgcgcatgaagcaccggtccgcggaaggggggcaggacacggnaaagagtcgttcttagataaagccgagaaggatgccgtccgcatcgagacgatgcaccggagggcggcgcgctccggcgtggcccggatgccggcgtcttcgtctcccgcgcgggcgctgtcggaagcggatggttgcgaacggtggaagtccgggcgtggcgggtcgggtcccggcaaagtacctggattcaacgtctacgttcggaacgcccaacggcgggcgtttttcccggaatgaatcaaggggaaacccggggaagggcgaaccttcaaaattgccttgtcaatgggcccggccccttggccctgggaaacttggttttcaaaaaac

SEQ ID NO: 96108 - protein, 95 aa, Zea mays
  misc_feature: Ceres CLONE 1586587
  misc_feature (91)..(91): Xaa is any aa, unknown, or other
MAQLAVRSLLLSLLLVSPVVASPGIVKLNSSSTLFGIEFPPFNTAVAATGCDSKLVAADEAGDEQKQPASSSPSLQLRMKHRSAEGGQDTXKSRS

SEQ ID NO: 96109 - DNA, 1258 bp, Zea mays
  misc_feature: Ceres CLONE 1586591
  misc_feature (33)..(33): n is a, c, t, g, unknown, or other
  misc_feature (910)..(910): n is a, c, t, g, unknown, or other
  misc_feature (1015)..(1015): n is a, c, t, g, unknown, or other
tgttgggtttttgtgtgtgggggggtgtccgtntaggcggccccggtctgcgtcgcaaacgaaaaaaccgggtctcgtaatatgtgggctcaccgcggtggcggccgctctagaactagtggatcccccgggctgcaggaattcgtctcacccctagaaaaatgggataagatcccgctgcccagtctgtcttcttcccccctgcggcagcttccgcggcgtccgtctccttgctcgcgccctacttctccccaaccacggcgccctctgttccttccagccggtcgactccctctgcagtcatgcgctcgcccagctcccttgcctcccccatggccagcgcccccttcagctcctctgctcgggtctccctcccatggcgcctccctctgccggccgccaatcttcctgcttgatctcgcccagctcgatctctgcgtctcctgctagccgcgagcccctgctccctgatttctccttgctcgctcctgaaccctgggatttcctgccgccctcccttctggctctcttctccagaccggccgggctcccagctccgtcaaaacttcctcccttggcttcgtcttccaccgggagcctccggcgttggtcccttacctacccctccccctgttttaattgggaaggtaatgaatccttcccattgggaaagagggggataacccctgggaccctcaaacttttctgcttgatcgcctcagatgggaaccacccagaaatgttccgccttagagacgcgcggcgtgcgcccaatgctgggtaaagaagagggtgattatctttcccccgcgggtgtgtactttaatacttctaccacgtctctcactgcactagcccacttatgcgcattgcgaactattgagagcgtcgaggtgaaaaaagaccaagnctctctggcggcgcccctctcaaattattaagaagaggggccctctcctgagacctgtggcgaaaaagaggagtgggtccgcagacataaaaaattttcttcgtngtaccccgcgccctcgctgtgtgcggcgccctcatacctcctgaccctctaagcatgggggttaaatactccacggaacacactctgaaagtctctcatcagaacgctgtttaggtccacaccgcacaattgtgttcaatcaccgatgttgtgtctgatgccattattgtgaactagtgtgattcgccacatatccgtatagcgccagtacactaatggagggcttaacatcgagggtatttg

SEQ ID NO: 96110 - DNA, 992 bp, Zea mays
  misc_feature: Ceres CLONE 1586592
  misc_feature: Encodes the peptide sequence at SEQ ID NO. 96111
aaagctggagctccccgcggtggcggccgctctagaactagtggatcccccgggctgcaggaattcgtctcacccctagaaaaagttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaacccgccggcgtcatccgctccgactccggcgcgggacggggccagcattgctcgccgctgaggggcggccgttgacgcccgcgccccatacagacgaacccaaaaggagggggttcccccttccggcaaggggcaaggagctaaggggcaaacaagacccattgaaggggaaccggcggggggggggaaaggggcgccggaaccctgggcgggaagaaagggggaaagagatcggggagtgggaggggggcggccgccggggggattacagagggggcttccatagggggaagggctgtgcccccgcacggccgaaggagaagcaccgggaggggagggcgcgcgcgggggggggggggggctggggggccgcagagagcgtgtgaaacgtgcgggtggtagggggggggggagggggattacaggtggggggcccgcgcgcggggggggaggggccgcaggcggcccgccgccccagggcgggcccggaggcgagaggggggggacgggagaggtgaaccggggggaggggagacagtaggggaggagagggcgaagggggcggggaggggggagaa

SEQ ID NO: 96111 - protein, 65 aa, Zea mays
  misc_feature: Ceres CLONE 1586592
  misc_feature: SWISSPROT Homolog: EC 2.7.9.1 Pyruvate, phosphate dikinase
MTASVSRAICVQKPGSKCTRDREATSFARRSVAAPRPPHAKPAGVIRSDSGAGRGQHCSPLRGGR

SEQ ID NO: 96112 - DNA, 1145 bp, Zea mays
  misc_feature: Ceres CLONE 1586594
  misc_feature: Encodes the peptide sequence at SEQ ID NO. 96113
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (44)..(44): n is a, c, t, g, unknown, or other
  misc_feature (155)..(155): n is a, c, t, g, unknown, or other
  misc_feature (157)..(157): n is a, c, t, g, unknown, or other
  misc_feature (158)..(158): n is a, c, t, g, unknown, or other
  misc_feature (162)..(162): n is a, c, t, g, unknown, or other
  misc_feature (164)..(164): n is a, c, t, g, unknown, or other
  misc_feature (165)..(165): n is a, c, t, g, unknown, or other
  misc_feature (167)..(167): n is a, c, t, g, unknown, or other
  misc_feature (173)..(173): n is a, c, t, g, unknown, or other
tccctttttttttnttnnatatttactttaacattcattataanattgaattataaataaaggtcttgtggaaaggtgaactccacgcggtggcggccgctctagaactagtggatcccccgggctgcaggaattcgtctcacccctagaaaaangnngggngnngnaaaagnaaaaaaaaaaaaaaaaaaaagactcacactcacacagcaaataccccacaaggccactccaaagagctagtagtggaaccgaagatgttcgggaacatcggaaagatccccatcatcggcgacctgacgggcagcaacaagaatgcgcacctcaagggcaacgtggtgctcgtgcgcaaaaccgtgctcgggttggacgtcacaggaatcgcgggtccctcctcgaagggggtggggaattcctcgggcgggggggcacctggcaggttaatagctcaaccgtcgggggaaccctaaaaaagggaaacggggggaaaatttggggcccccaaggcaaaccctggaaaaagggggtggttgaaaaccccccgcccgctttttggttccagggagaaaaaacaatttccgggggttaaccttttaaaatgggggaagggggggaaaaaaaaaagggggaatttcccgggggggggccaatttttgtgtgtaaaaaaaaaaaaaaaaatgggcctttcagaaaaatttttttttctccttaaaaaaagaaatattataaccccttaaaaaagaaaaaagttatcccccgggggggacacgagggggaaacacacaattgggggtggttattgaaaggggcgaaaaaaaattatgggtggaggttattaacaccccccgagaggggtccaaaagaagaagcagggtaaaataaaccaggcgggtgtatttattttttttttcaaaaagaaaatgcgggagctcctctctcctcacggcaaaaaaaactccggcggcgggggtccttataaaaaacccttaaaccgggaaaaaaaaagaaaaatgccgggagaaaaatgggagaggggggaaaacaaaacaagagggggcgccctttaaaaaaaaaaaaaaaaaggcggttttcccccggaaaaaggtttttaaaaaaaaaaactcgcgctaaacggaccgccgcgg

SEQ ID NO: 96113 - protein, 70 aa, Zea mays
  misc_feature: Ceres CLONE 1586594
MFGNIGKIPIIGDLTGSNKNAHLKGNVVLVRKTVLGLDVTGIAGPSSKGVGNSSGGGAPGRLIAQPSGEP

SEQ ID NO: 96114 - DNA, 1143 bp, Zea mays
  misc_feature: Ceres CLONE 1586595
  misc_feature: Encodes the peptide sequence at SEQ ID NO. 96115
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (43)..(43): n is a, c, t, g, unknown, or other
  misc_feature (1143)..(1143): n is a, c, t, g, unknown, or other
nnnccgtttnnnnnnttnnnnnnnntttgcactttcccccccnttctccacgaaatattggtgggtaagcgggccagttattggagggaggctccccgcggtggcggccgctctagactagtggatcccccgggctgcaggaattcgtctcacccctagaaaaacctcgtggactccttccccacaaaactaaaccctcgcttcggaggcgcgtgaacccaagaccgacaggcgaacgaagcgagggtcctcacaaccaccatcccctgctgcaacgacgccgccggcgatggcgtccatctccggcgcggcggcgccgccatcttccgccgtgtgccggcttcggctgcgccggcaccttctgctccggccctcccacctccgcctccgcgcgccccactccatcgccgacctctcccgctcctccaattccgccccgagcccggcccgcccagcgctgggcctcggccccggagaacggcagcggcggcgtccgcgcggtgggagaaagaccccgattcagctgttgggagcgctaccgtcaagttggctcttaccaagcacaaagggagcttcgggcattctttcttttaaacgtttcagccccgggaatggggggtctctcccgcgaagggaggtttccctgtggcggcgcaaaaaatggaggaaccccccccggggaattggcccataccaagggggcccttctttccgtgtccgcaaaaaacattgtgggcgggggggagaagaccctctcccctaagagaaaaaaagaggggggggggcgcgccaccattattctgggctcccacaaacacccaccccccataataaaagaaaagagggggtgttccgcccaacattgtgggtgggggggggagcaccacaataaaaagtggtggggggtgtttttctccggggagaaaaccacggggggagcccctccttttgtggtttctcccccacaaaaaaaaccgccgtttgtccactcccccgcgggggaaataacaaaagggatctctcgggggacaccgcccgcgcccgtcccgtaaataaaaaaaaaaaccatcctctggcgccgctgtttttctctccccaagaagaagaagtgcgcctctccccctcgcggggaaaaaaataatn

SEQ ID NO: 96115 - protein, 157 aa, Zea mays
  misc_feature: Ceres CLONE 1586595
MASISGAAAPPSSAVCRLRLRRHLLLRPSHLRLRAPHSIADLSRSSNSAPSPARPALGLGPGERQRRRPRGGRKTPIQLLGALPSSWLLPSTKGASGILSFKRFSPGNGGSLPRREVSLWRRKKWRNPPRGIGPYQGGPSFRVRKKHCGRGGEDPLP

SEQ ID NO: 96116 - DNA, 825 bp, Zea mays
  misc_feature: Ceres CLONE 1586596
  misc_feature: Encodes the peptide sequence at SEQ ID NO. 96117
ggagctccccgcggtggcggccgctctagaactagtggatcccccgggctgcaggaattcgtctcacccctagaaaaaaaggccaaccaacccacccaccgcgaaaccttcctccctctccctctccctctccctctctgtccccttctctcctccgccgctcgacagcctactctgcaagccaggagaacccaacccgacaagccccacacgcacacgcacacgcccacgcagccgcggcggaggccatcaggcgggtgccgatgggctgctgcggctcctcgctgcgggcggggacgcagccggagaagaagccgggcggcgggggcgctccccccgcgccgcccctcctactcgctgagccagaaccagagcaagaaccaggcgccgccggcagcccgcgcgggcgcccaccaggtgccgccgctcagggagttctcgctggcggagctgcgcgccgccacggccggcttcgcgccggacaacatcgtgtccgagagcggcgacaaggcgccgaatttcgtgtacaggggccgcctcgagcccagccgccgcgcgatcgccgtcaagaagttcgccaagatggcgtggcccgaccccaagcagttcgcggaggaggccaaggggggtcgggaagctgcgccaccgccgcctggccaacctgatcggctactgctgcgacggcgaggagcgcctgctcgtcgccgaagtcatgcccaacgacacgctcgccaagcacctctttcactggggaaaaccagacattgaatgggctatgcggcctgagaagtgcatactacatcgctgaagcactggaatattgta

SEQ ID NO: 96117 - protein, 255 aa, Zea mays
  misc_feature: Ceres CLONE 1586596
GAPRGGGRSRTSGSPGLQEFVSPLEKKANQPTHRETFLPLPLPLPLCPLLSSAARQPTLQARRTQPDKPHTHTHTPTQPRRRPSGGCRWAAAAPRCGRGRSRRRSRAAGALPPRRPSYSLSQNQSKNQAPPAARAGAHQVPPLREFSLAELRAATAGFAPDNIVSESGDKAPNFVYRGRLEPSRRAIAVKKFAKMAWPDPKQFAEEAKGGREAAPPPPGQPDRLLLRRRGAPARRRSHAQRHARQAPLSLGKTRH

SEQ ID NO: 96118 - DNA, 996 bp, Zea mays
  misc_feature: Ceres CLONE 1586597
  misc_feature: Encodes the peptide sequence at SEQ ID NO. 96119
  misc_feature (26)..(26): n is a, c, t, g, unknown, or other
tttgttgttttttttttttttttctnggtttcgctaatcatttttttttttataactcccctgggggttaagagaaaaaatggggctcacgcggtggcggccgctctagaatagtggatcccccgggctgcaggaattcgtctcacccctagaaaaatggcctactcaatccacccaccactaaaccttcattccttctccctctccctctccctctctgtcaccttctctcctccgccgctcgacagcatactctgcaagccaatagaacccaacgagaaaaacgccatactcacacacaagatcctaaacagccgcggggaacgccatcaggcggatgccgatgggctggtgttgttcctccctgtgcgcggggacctgcccgaataagaaacctgcgggaagggcactacctgcgcgctcggcgtacctattcgcttaagcaaacagcgagcaagaagccaccatcgccggcatcccgctcgtgtgccgaccacgagtcgccactcatggaattctcgatctctgacctaaggtgtgccacggacgcgatttacgacctacaacatcggggtcccagaacggcggactacgtcgcctaattcccatgtacgtggtacatcctgttaaggccccaacgccccgggtatcctcattcaaactaagttacgcccaaaaaggccggtgggaccgaagcttcaaaggtagttcaaagggagggaaggtcaaacggagcgtggggggaaacaatgcccccgccaaggtttccctggcacaaaccatgcatggggcttatccagcttatccaatccggccagggaacaaacctcgcgttcattcggcccgaaaagaaaatgatacacaatggcacccggccttccgttggattcaaaacccctatacgacctgggggaaaaaaccccccccaccttatttggaaatggggcccttattccccgaaggggaaataatatgtggcttaatttttttctttcc

SEQ ID NO: 96119 - protein, 30 aa, Zea mays
  misc_feature: Ceres CLONE 1586597
MEFSISDLRCATDAIYDLQHRGPRTADYVA

SEQ ID NO: 96120 - DNA, 918 bp, Zea mays
  misc_feature: Ceres CLONE 1586599
  misc_feature: Encodes the peptide sequence at SEQ ID NO. 96121
ccgcggtggcggccgctctagaactagtggatcccccgggctgcaggaattcgtctcacccctagaaaaaaccaccaccaagcaccgcaaccggagccggagccagaggagggcgagaggccgaggggagaggagcgaaggaggccgccgaccgaccgtgcgtccggccccgcggcggcgtcggcaggtcgtagacgacagacgagcagtagcagcagcagcagcacgaggcggccgggcccgggccacgccatgccggagaaggaggcgcaggccgccgcgttctgcggcgaggcggtgatcgccgagttcgagtccctcacgcgggacgccgccgccgtgcagcgcgacacgctgcgccggatcctggcagacaacgcctgcgccgagtacctccgctgccggggcctcgcgggccgcaccgacgccgccagcttccgcgcctgcgtggcgctcgccacgcacgccgacatcgagccctacatttgcgcgcttcgccgaaggtggacacgtcccccggtgcttcaccgccaaacccattaaccttccatcttccctcagcttccggaccaacgcagggggaagccgcaagttacctggccctttcaaccaggaagttcggtcaagtccccccaatggcaaattttccggggaatttccttaccccctttaggaaaaagggggcgtttccccccttgggaaggaaccggcaaagggcgcttggaaatttctttttttgggggcagacccgggcatgtttttcctcccctaaggggcgggggtcttgacgggtataaataagggccccctctcaccaagcttgtttaacctcacaggcggggggagtgttcatttccccaccaaataggcgcggccctttctcacattctccgggggggtggcccagccccccgggag

SEQ ID NO: 96121 - protein, 96 aa, Zea mays
  misc_feature: Ceres CLONE 1586599
MPEKEAQAAAFCGEAVIAEFESLTRDAAAVQRDTLRRILADNACAEYLRCRGLAGRTDAASFRACVALATHADIEPYICALRRRWTRPPVLHRQTH

SEQ ID NO: 96122 - DNA, 840 bp, Zea mays
  misc_feature: Ceres CLONE 1586601
  misc_feature: Encodes the peptide sequence at SEQ ID NO. 96123
ccgcggtggcggccgctctagaactagtggatcccccgggctgcaggaattcgtctcacccctagaaaaacatccaatccaatccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcgccgccgtcggtgccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggaggcggccatctaccccagcatcccgtccgacaagtacggctgctggtcgggctccgcgacgatccttgaaggacgcacgccggcgatcctgtaaccggggatcgaccgggcggacatcaacttacaaggggcaggtgctggcgctccccaagggaccgttccgaaccgtttttccccgaagtggaaaaaaccggaaggaaacaaaccgggtgggaaaacccgcgggggccggggggatttaaaagcgaaacaaatttttcccgaaccccaaaaaaaagaggggggggggggcaccccgggggacctttgcgaaaaaatcttttgtgggggaaacaattgtccccgcgccccccccgcggaaaaaagcccccttggtgttcca

SEQ ID NO: 96123 - protein, 142 aa, Zea mays
  misc_feature: Ceres CLONE 1586601
  misc_feature (58)..(143): Pfam Name: Glyco_hydro_32N Pfam Description: Glycosyl hydrolases family 32 N terminal
  misc_feature: SWISSPROT Homolog: EC 3.2.1.26 Beta-fructofuranosidase
MGTRPRGVVLAPWAVVLVLVLALRLAGASHVIHRSLEAEAPPSVPASIVSPLLRTGYHFQPPMNWINDPNAPLYYKGWYHLFYQYNPKGAVWGNIVWAHSVSRDLINWVALEAAIYPSIPSDKYGCWSGSATILEGRTPAIL

SEQ ID NO: 96124 - DNA, 2393 bp, Zea mays
  misc_feature: Ceres CLONE 1586604
  misc_feature: Encodes the peptide sequence at SEQ ID NO. 96125
acccttgccctccgtccagctcgccgtctctcgcagagggaagcagggcgcagcagtgaccagttaccagtcatggttcgctgcgttgccggcagctgccctcccgtcaccttcgcgtgttgcccccgccggactgggagtcttccagacgaagtgctgttgttcagtgtggcactgcatcgagcacaccagcaatatctggaactggaccttcatcatctggatcctcggggcttgttcaagattgtactgcccctctggtctgtgcactgcaattaactgccagacaagatgtttcctgctttcacttcccaggacacaacagaggaaaagctgctccatcttccttgtcgaaactcattggctcaggggcatttctgcatgacttgcccgagctacccgagctggatgatctcttctccccaaaaggtgtgattctagatgcccagaggcgagcagctcaactgtttgggtcatctaaaacttggttccttgtcaacggaacgacctgtggaatccaggcctcagtgatggctacctgttctcccggcgactacctcattgtgccacggaactgccacatttcagtgatctctgcgctggtcttgtctggtgtggtgcctaaatacataataccagaatataattctgggtgggacattgctggtggtatcaccccactgcagctggatgaagcagtaaaagagctggaggaggatggaaagagggtaggcgctgttcttgttacttcgcccacctaccatggtgtatgcagcaatgtgcaaggtattgccagtgtttgtcatccacgaggcattccggttatagttgatgaagcacatggtgcacatttcaggttccatgacagtttgccaagcactgcaattgagcaaggtgctgacctagctgtgcaatccacacacaaggtcctgtgctcccttacacagtcttcaatgcttcacatgtctggagatcttgtcgatgtagataaagtaagccagtgccttcagctcctccagagctcgagcccgagttaccttctactgtcatctttagatgccgcgagagatcagctgagccagaacagaaatatatttgatgagccattagctatagcatcggaaacaaaagacaaactggcgagaatcccagggatatctgttctagacttaccatgctttgcttctgatttccctgctatagatccgttgcgcatcacactcagtgcctcaaatctgcaattatcgggatacgaagccgatgacattttatatgaaggccatcaaatcgtatctgagcttgttggcacaagggccgtgacatttgcagtcaacttaggaaccagagtgcaggacgctgagaagcttgtgcagtctgcaaagcatctatcagaaaaacatttctttgcaaatagcctgaaacccgtgaaggagaatcgtgtgcatggcccattagagaatatctctgtgcatctgagtccaagagaggccttctttacagagaagaggagagtgaaaatcgaggacagccttggtgagatctgtggtgagctaatatgcccgtatccacctggtatcccagttctgattccaggcgaggtagtaacccatgattcactgtcctacttgatgagcgttagacaccaaggcatcacgatcagtggagcggctgatgctgagctaaattccattctggtgtgcgacttatgatgattgccctattgtttctcacaagactgtgttgtcgcagagataccgtgggagagatcaagtatggtttatgccaagtcaagagcacaatgtattgtccgcttgatggatgtaaaccaatggctggcggtttaatttgtagccgccggccacttggccaaataatttagtccgtgttctgtctcgtctcgtgagccgaaagagttgccaagctgcgacatatgatgccaaagcatgaataaggagggtctatagcatgtgatctcctgtgttgttgtttgaagtatgagttgctagggagggctggctacctttctatctgaagtggcgtgcaatgtttcctctttgcttctcttctgaactgggagctccggtctgaactggcagtaaagctgaagcatcatatgcaggtctgcacacctccacggttgtgctacctccggctgcatgttttgcagggcttctgaaacaagtactatctaccttctcttctaagtttatccatcaactcatgaattcacgaacattccacaactcgtacacacacacacaaaaaaggaaacataggaatggaccgcatcattgtaatcacaattttttttcttcatttcgtagaatggcactcttgctctatagtataagaaatgaagggcgcttatatatatacaaaaaaaaaaaaaaaaa

SEQ ID NO: 96125 - protein, 392 aa, Zea mays
  misc_feature: Ceres CLONE 1586604
  misc_feature (1)..(288): Pfam Name: OKR_DC_1 Pfam Description: Orn/Lys/Arg decarboxylase, major domain
  misc_feature (278)..(382): Pfam Name: OKR_DC_1_C Pfam Description: Orn/Lys/Arg decarboxylase, C-terminal domain
  misc_feature: SWISSPROT Homolog: EC 4.1.1.19 Arginine decarboxylase
MATCSPGDYLIVPRNCHISVISALVLSGVVPKYIIPEYNSGWDIAGGITPLQLDEAVKELEEDGKRVGAVLVTSPTYHGVCSNVQGIASVCHPRGIPVIVDEAHGAHFRFHDSLPSTAIEQGADLAVQSTHKVLCSLTQSSMLHMSGDLVDVDKVSQCLQLLQSSSPSYLLLSSLDAARDQLSQNRNIFDEPLAIASETKDKLARIPGISVLDLPCFASDFPAIDPLRITLSASNLQLSGYEADDILYEGHQIVSELVGTRAVTFAVNLGTRVQDAEKLVQSAKHLSEKHFFANSLKPVKENRVHGPLENISVHLSPREAFFTEKRRVKIEDSLGEICGELICPYPPGIPVLIPGEVVTHDSLSYLMSVRHQGITISGAADAELNSILVCDL

SEQ ID NO: 96126 - DNA, 1281 bp, Zea mays
  misc_feature: Ceres CLONE 1586605
  misc_feature (20)..(20): n is a, c, t, g, unknown, or other
  misc_feature (30)..(30): n is a, c, t, g, unknown, or other
  misc_feature (39)..(39): n is a, c, t, g, unknown, or other
  misc_feature (53)..(53): n is a, c, t, g, unknown, or other
  misc_feature (954)..(954): n is a, c, t, g, unknown, or other
  misc_feature (1063)..(1063): n is a, c, t, g, unknown, or other
ttcatttgccgaaacaaaancccctctctngttccttanaaagaactcttttnaaccccaacaacacaaactatattaaaaatggagctccccgcggtggcggccgctctagaactagtggatcccccgggctgcaggaattcgtctcacccctagaaaaaaaatttcaacgtccaagggtggcgcgagcacacagacatagaggcacggaaagcagagcgcgaggaagagagagacagagagaaaaacccaaaccctaacaatcatttccaggcccccgccccccggcgtctccagaacgttccagaaccttcaaggaaccatccacaggagcaggcgcgagcgcgggtgtttggatcgtgggaggcaacgctggcggctcgcagcggcagcaggtgatggcggattcgcctagcggtggaggatctagggcttgtgtctgctgggtgagacaggtcgaggaggcagcgtcggggctggtgctcgggagaaacgaaacaggggaggagggaatgcaacatgcttacccttggcccaggttcaactattccttcagagaaaccacatccgtggtcgtacgaagatcctcccacctcaaaatgatacttgcggtgataacccacacggagggcaggaatttccgcccaaaacatgggtcacgcgagaaaactctcatacgcctatcataatcggcgcgcaatttccttggaaggtgtctacccgtgtaagagtattctcctcatgttcccagctagaataagattataaggggtgaacaattccgcatactttatctctccgggcatgagatctgattgtgcagttgtcccaataaatagttgggcaaacacacagagtgcgcacaatatcagaattcctctatcactcattgtgcgcttcctgatcggggacactttgatgcacaacctcaccacgactgttcgtcaaataganagtaaactggcgcgtgttggaattcgcgattcgagacagatgacgatatcgaccatactataaatatgttcgtccccgcgttctaataagaacggatttccctcgtcgnccctaattaacgtgttgtagatgtaatgatgagttattgggcgcgtacatacgaattatgtcgcctcccataggatacgcttgcatgtggtacgaaacgcgcgtctctctacaaaatacaagagaaactgggtgtggggggagtagatctatctgaaaatatcgaagtgtgtgatttgtcggtcttgccgcagtgcatatttgtatcttctattaggg

SEQ ID NO: 96127 - DNA, 834 bp, Zea mays
  misc_feature: Ceres CLONE 1586606
  misc_feature: Encodes the peptide sequence at SEQ ID NO. 96128
  misc_feature (211)..(211): n is a, c, t, g, unknown, or other
  misc_feature (629)..(629): n is a, c, t, g, unknown, or other
ctccccgcggtggcggccgctctagaactagtggatcccccgggctgcaggaattcgtctcacccctagaaaaaagggatacggataccccattgccggcccactggcgagagagattttggtgcgactacagagtcccaatcctataccccggccccaaaactcttctctgctaccagtgaccgttccttccgccggaatcgattttctngagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctccctcatcggggtgggcgtggcgcccgaagtgggcaggggtcgtcgtcggcgacacaatgctcagcaggcggggcagctccctcccgcgccccgcgctgccgcgggtgtccctcgcaacgagggcgccgccgtcgtaccgagaaactgtgtgggctctgcngcgcccgaggacgagcagctggcggtgaccacccgtgacttgatgcacctctggcggctcgtccagaagagggaccgtggcccgtcgtggatccacatgatggaccgcacctggccaaacatgaggaacaaggctgggcgaagaaaccaccgaatggtccaccacaggtaccgaaggagccttatctttgaggatgattaccaag

SEQ ID NO: 96128 - protein, 54 aa, Zea mays
  misc_feature: Ceres CLONE 1586606
MHLWRLVQKRDRGPSWIHMMDRTWPNMRNKAGRRNHRMVHHRYRRSLIFEDDYQ

SEQ ID NO: 96129 - DNA, 2111 bp, Zea mays
  misc_feature: Ceres CLONE 1586608
  misc_feature: Encodes the peptide sequence at SEQ ID NO. 96130
agcacctacgtccataaaccccagaagtcgactcctgcccctgcctcgccgccgccgttgcttaccaacctcccgccatggcgacatcgccgttgccgacggcgaccgcctctgcctcgaagaagcggcgttccagaggcgggacgctagccctagatgaggtgaagaagctgggaaccgagctcctttcctctcgctcccacctcaaccacgcccccgccctcctcgctctcctctctcccaccgcgccgctcgacctcgctctcgaggcgctcatttcgctccagtccttcttcgtaccactcatcccctccatcccctccgcctccgcggcagccaacgcgggggatgcgggcagtgaccccgagctcgtgtttggagcctggctgcggcagcggttcgacgagctcgtcgccgcgctggtggagctcagcgtgtctccacacagcgacgacgcaatcagggatgtagcactggatgctctcatggatttcgtgaagctggggaaggatgggaagttccattcggcaatttaccacaagtttctctacgctgtcgttcatgctgctgatcccgtcgatatgttgttagagttgcttgtatcaaagtacttcaaatacactgatattcgttacttcacttacactagcttagacaagattgccaacagtctgggcagtaaaaccactggctctggaaaagatgctttgcaaaatggaagtgacgagtcaaaaaacaggagtagtatttttatacacaacatatacaatcttttggcacatgttcctttgatggattttcaaaaggaatcaacatttgatatgtggagtactgttggtctatcttctaaaggagaaaatgactcttccaaggacacttctacgtacatcaataagaaactaaaattgaagttcaccaaagcatggctgtcttttctcaagttaccactaccacttgatgtgtacaaggaggtccttgcttcaattcatcaaaatgtcattccttcaatgtcaaacccttccatcttatgtgatttcttgactagatcatatgatattggtggtgttatcagtgtgatggccttaagtggccttttcattcttatgacacaacacggtctggagtatccaaaattttatgaaaagctttatgcactactgactccggctgttttcatggcaaaacaccgatcagtgtttttgcaacttcttgacacatgcctgaaatcttcttatcttcctgcctatcttgctgctgcgtttgcaaaaagattgagtagacttgctctttcagttcctccagctggagctcttattattattgctttaattcataatctgctgaggagacacccctcagttaattttttggtccattgggaggttgatgagagtgatagcaatgccacaagagaagctagtcaatctaagaagattggttctgatccttttaaccagaatgatgcagaccctgcgaagtctggtgcaatgcgcagttctttgtgggaaatagacacgcttcgtcatcattactcttctgcagtttctagatttgttgtgtcacttgaggaggatctcactgtccgggccaaaactactgagatgaaaataacggacttcagttcaggttcctatgcaacagttttcagggacgaggtacgtcggcggataaaacaggtcccccttgcattctacagaaccacaccaacctcgttatttctaggatcagattttcctggatggacctttggggaccaacacaatagcaccgtagaaactactgtagaaggcaacggaaaagtcgaggcagtaggggctagcgatagcacaccttccaaaaggttgcggatggagacctgagaaggaaacacggcgaatctccaagaattaggccggcttgttggggtagcattgggtggttgtgtgcttctcatttggagtttggtttcccagtgttatctccaggattgtctgggtgttgtagcttcaattttgagcagaatgggttacgtgaggaaactcttctttcggttgcgactaatataagttgtaagcttaattgccaattacagaggaaatgtgccgatttttgtctaaaaaaaaaaaaaaaaa

SEQ ID NO: 96130 - protein, 593 aa, Zea mays
  misc_feature: Ceres CLONE 1586608
  misc_feature (331)..(494): Pfam Name: CBF Pfam Description: CBF/Mak21 family
MATSPLPTATASASKKRRSRGGTLALDEVKKLGTELLSSRSHLNHAPALLALLSPTAPLDLALEALISLQSFFVPLIPSIPSASAAANAGDAGSDPELVFGAWLRQRFDELVAALVELSVSPHSDDAIRDVALDALMDFVKLGKDGKFHSAIYHKFLYAVVHAADPVDMLLELLVSKYFKYTDIRYFTYTSLDKIANSLGSKTTGSGKDALQNGSDESKNRSSIFIHNIYNLLAHVPLMDFQKESTFDMWSTVGLSSKGENDSSKDTSTYINKKLKLKFTKAWLSFLKLPLPLDVYKEVLASIHQNVIPSMSNPSILCDFLTRSYDIGGVISVMALSGLFILMTQHGLEYPKFYEKLYALLTPAVFMAKHRSVFLQLLDTCLKSSYLPAYLAAAFAKRLSRLALSVPPAGALIIIALIHNLLRRHPSVNFLVHWEVDESDSNATREASQSKKIGSDPFNQNDADPAKSGAMRSSLWEIDTLRHHYSSAVSRFVVSLEEDLTVRAKTTEMKITDFSSGSYATVFRDEVRRRIKQVPLAFYRTTPTSLFLGSDFPGWTFGDQHNSTVETTVEGNGKVEAVGASDSTPSKRLRMET

SEQ ID NO: 96131 - DNA, 807 bp, Zea mays
  misc_feature: Ceres CLONE 1586609
  misc_feature: Encodes the peptide sequence at SEQ ID NO. 96132
ctggagctcaccgcggtggcggccgctctagaactagtggatcccccgggctgcaggaattcgtctcacccctagaaaaagtcttatcccctcgcccctcctcccctccgccgctccccccacctcacctcgtcaaccccctccttggatagggttagagttcccccggcacgagcgcgagccatggcctccttcacctgctcccaggtcggcgctgcggcagcgggcggaacctcgcccttcctcggctaccggcggcggagcggccccgggggcgccatcccgtcgagctccctcttcgtgggccggcggttggcggcggtgcggatgcgcgcgccctctcgcggggtccgcgggggctccgcgctgcgggtcacgtgcgagaaggtggtggggatcgacctaggcaccaccaactccgcggtcgccgccatggagggcggcaagccgaccgtcgtcaccaacgccgagggcgcgcgcacaactccctccgtagtggcgtacaccaagacaggggagcgcctggtggggcagatcgctaagcgccaggcggtcgtgaaccccgagaacaccttcttctctgtcaagcgcttcatcggccgcaagatgtctgaggtcgacgacgaggccaagcaggtctcgtactgcgttgtcaaagacgagaacggcaacgtcaaactcgactgccccgctattggcaaacagtttgctgccggagagatctctgcgcaggttttgaggaagttggtggatgatgcatctaacgttctttatgagaaattacaaaagcagtggttacagtaccag

SEQ ID NO: 96132 - protein, 208 aa, Zea mays
  misc_feature: Ceres CLONE 1586609
MASFTCSQVGAAAAGGTSPFLGYRRRSGPGGAIPSSSLFVGRRLAAVRMRAPSRGVRGGSALRVTCEKVVGIDLGTTNSAVAAMEGGKPTVVTNAEGARTTPSVVAYTKTGERLVGQIAKRQAVVNPENTFFSVKRFIGRKMSEVDDEAKQVSYCVVKDENGNVKLDCPAIGKQFAAGEISAQVLRKLVDDASNVLYEKLQKQWLQYQ

SEQ ID NO: 96133 - DNA, 1803 bp, Zea mays
  misc_feature: Ceres CLONE 1586617
  misc_feature: Encodes the peptide sequence at SEQ ID NO. 96134
aacacacatcctctaagtgctatctaatctacaatctaccaccagacactgtcgtcagtcgtccctcatcaaccgcgcgcgcgcgacttcaagcatcagactaccataatcatggctccgccgccggcaatgcagagcccaggagagctaaacgacggcgcctacgacgcgccgcacatcctattcatcccgagcgccggcataggacacctgacccccgtcttccgcgtcatcgccggcttctcgagccggggcatcgacgtctccgtcgtgaccgtgctgcccaccgtgtctgccgccgagactgactacttcaacggcctcttcgcggactaccccgccgtccgccgcgtcgacatgcacctattgccgctggacgcctccgaattcacgagagaggacccgttcttcctccggtgggaggccctgcgccgctccgtccacctcctccgccccatcatcactaacgccgcgccgcgcatcacggccatcatcaccgacatcaccctgacctcctgcgtcatccccatcgccaaggagctggacgtcccgtgccacgtcctcttccccacagccgccaccatgctctcgctcaacgcctactaccccgtctatctcgagaagctcaagggtggaccggagccgggcgtgatcggcgacgccgtcgacatccccggcgtgttccgcgtcccgcgctccgccctcccgccggcgctcctcgacgtgaacaagctcttcacgaagcagttcatcgacaacggcagagcgatcgtcaaagccgacggcgtcctcgtcaacacgttcgacgccgtggagccggcaccgctggcagccctgagaggcggcaagatcgtccccgggtacccgccggtgtacaccatcggcccactcaagtcgcacgccacgaaagcgggcgacaagccaggtgacgcgttgcttgacgaatggctaggtaagcagcgagcgcgatctgtggtgtacgtggcgttcggcaaccgcagcgctgccaggctggaccagatccgggagatcgccgccgggctggaggacagtggctatcctttcctgtgggtgctcaagaccacgaaggtggaccgggaggacgacgccgagctggcggaggtgcttggagacggataccttgagcgcgtgaaagggcgcggcatcgtgaccaaggggtgggtggagcaggaggagctgctgaaacacccggctgtgggcatgttcgtgagccacggcgggtggaactcggcgctggaggcgtcgtccgccggcgtgccgctgctggtgtggccgcagctcggcgaccaccgcgtgaacgcgatggcggcagtgagggcaggcatcggggcgtgggcggagcactggagctgggacggggaggacacgctggtgaccaggcaggagatcgccgacaaggtgaaggaggttatggccgacgggaagttgagggcgagcgtggcggtggcccgcgaggaggccgcaaaggccgtcgcggagggcggcacgagttaccgtaacatgcatgacttcatcgccaagcttaagggaggagcttgaggcttgaggagatgatgttacgaacgcaacaatcatgcactgcacgtccattcccaccattccgacgagtgaagtgactgctgttacactcagccgtaccactttggttctgggttttcatttcatgttcatgtgtcttctactactatatacaagcatattcagtgtcttatgtgaactaaagatgatttgaaatggagtcaaataatatatatgtaattagaataaaaaaaaaaaaaaaaa

SEQ ID NO: 96134 - protein, 482 aa, Zea mays
  misc_feature: Ceres CLONE 1586617
  misc_feature (21)..(479): Pfam Name: UDPGT Pfam Description: UDP-glucoronosyl and UDP-glucosyl transferase
  misc_feature: SWISSPROT Homolog: EC 2.4.1.115 Anthocyanidin 3-O-glucosyltransferase
MAPPPAMQSPGELNDGAYDAPHILFIPSAGIGHLTPVFRVIAGFSSRGIDVSVVTVLPTVSAAETDYFNGLFADYPAVRRVDMHLLPLDASEFTREDPFFLRWEALRRSVHLLRPIITNAAPRITAIITDITLTSCVIPIAKELDVPCHVLFPTAATMLSLNAYYPVYLEKLKGGPEPGVIGDAVDIPGVFRVPRSALPPALLDVNKLFTKQFIDNGRAIVKADGVLVNTFDAVEPAPLAALRGGKIVPGYPPVYTIGPLKSHATKAGDKPGDALLDEWLGKQRARSVVYVAFGNRSAARLDQIREIAAGLEDSGYPFLWVLKTTKVDREDDAELAEVLGDGYLERVKGRGIVTKGWVEQEELLKHPAVGMFVSHGGWNSALEASSAGVPLLVWPQLGDHRVNAMAAVRAGIGAWAEHWSWDGEDTLVTRQEIADKVKEVMADGKLRASVAVAREEAAKAVAEGGTSYRNMHDFIAKLKGGA

SEQ ID NO: 96135 - DNA, 840 bp, Zea mays
  misc_feature: Ceres CLONE 1586618
  misc_feature: Translation starting site: 121
gagctccccgcggtggcggccgctctagaactagtggatcccccgggctgcaggaattcgtctcacccctagaaaaacctaccttcgcaagtttgcgcctaaaccctagctcgcttcccaatggcgccgaagaagcgcaaggccgatcccgccgagtccgccgacgctgcggaggcagccgccggcaaccaccgccaggagccagcgccctcggagcccaagccccgcgccaccatctacttccccatcaccgacgacccgccggagcccgccgccgaggaggacgaggaggatggcgctggcgacgacgaggacgacgtggaggacatcggcaagctgctcgagccactgtcgcgggagcagctcgtcgcgctgctccgcacggcggcggagacgagccccgctacgatggcggccgtgcgccgctccgtggaggcggaccccgccagcaggaagctctttgtccacgggcctcggctggggcgccagcgccgaggacctccgctccgccttctcaggcttcggcgagctcgaggactgccgcgtcatctctgacaagcagtccggcagatccaagggctacggggttcgtccttcttcttgctcccgccgctctgcactccgcggccctcaggcggcccccaggctccaaattcggggggccgtcttggcttttctggccaccttcgccggccttaagggccccggggccccccaggttttttcaagtcttcaaaaaccccttaggctcccaaacacaacaccaccaaatgggcaaacctcttaactttccaattaacccaccccccccaagtgcgctttcggggggttcacaatcaa

SEQ ID NO: 96136 - DNA, 867 bp, Zea mays
  misc_feature: Ceres CLONE 1586622
  misc_feature: Encodes the peptide sequence at SEQ ID NO. 96137
  misc_feature (136)..(136): n is a, c, t, g, unknown, or other
  misc_feature (689)..(689): n is a, c, t, g, unknown, or other
ctccccgcggtggcggccgctctagaactagtggatcccccgggctgcaggaattcgtctcacccctagaaaaagcttgctttgtcacgcacacgaaaagctcctgcctttaccttatctccgcacccgtagtggngatttggtgggagctgcgctgctcgcccctcgcgtttctttgctcaattgggggtcacggtcacggcccgcgggtgctgcgcgtgctcgtgggcgggcggaattcggggttcttgcgcggtcccggtcccctcggcgattgcggacgctctctgcagatcttcgcgtaactccgggagcgcgccggagatgaactgcgggccgcccgaccagctgccgccggggtcggcgccgtcgtgcttcctcaacctgaactgggaccagtctatggccgccgaccagctcgacccggcgctcagctcgatggtctcctccccggcgtccaactcgacggccgccgccgcggttactgacggccgcgctctccacgggatctctccgcagcagcagtacggaggcactccgctcagctcgccccccaagctcaacctgttccaccaaactcgcccccagttccaccacttcccgccgccgcaggtcggcggcctgccaatcctggagaacctgatgccgatgggccatctagaccagttcctcgccgaacccaggcttcnccgagcgcgcgggcgcggctgtccgggcttcgacggccgcccccggtggaagtggctaatgggagggggtcggcgttcccggggacattttgggcattccccggacgcccggccccaatccggggccaatttaaaggaacctggaagctctgggaaacggcccggggaacacaatcct

SEQ ID NO: 96137 - protein, 181 aa, Zea mays
  misc_feature: Ceres CLONE 1586622
  misc_feature (122)..(122): Xaa is any aa, unknown, or other
MNCGPPDQLPPGSAPSCFLNLNWDQSMAADQLDPALSSMVSSPASNSTAAAAVTDGRALHGISPQQQYGGTPLSSPPKLNLFHQTRPQFHHFPPPQVGGLPILENLMPMGHLDQFLAEPRLXRARGRGCPGFDGRPRWKWLMGGGRRSRGHFGHSPDARPQSGANLKEPGSSGKRPGEHNP

SEQ ID NO: 96138 - DNA, 814 bp, Zea mays
  misc_feature: Ceres CLONE 1586624
  misc_feature: Encodes the peptide sequence at SEQ ID NO. 96139
tccccgcggtggcggccgctctagaactagtggatcccccgggctgcaggaattcgtctcacccctagaaaaagttctccacagtcctccacactcgccgagcgacaccgcgcgggacgaccgagcaagcagagcatgcaaccgtcgtgcctgggcgcatgcagcggtggaggactagcactctccgcccgccgcctccacggcccctcctactgccgcgtcgcgccgcatagggcttccgcctcgtgctccgccggtggcggcggcaaggcatcgccgcgggggaaggacaacgtctggagcgtcgataacgagcgtgccgccaaggaggcggtccggggcccgaagcaccgccgcaggaaacgccccagtggtcgccgcctgccgccgccgaggaggaaggggaaggatgcggggtcgagggttctagtgtctggagccatgctcgtggaggtcgagactgtgctccaaactcaggaacctgttataaagccttcttgggatacatttgcaagtagtttaactggtaactgggaagggtgttggagctatcttctcaccaatcacagcagagatggagcccgttggggtttgggaacaaagaagagtacctttatgactgctacactctttctcacatcaagagatcttttgaatgtgggcatgggctctgaaatcccaaagaaaaccaaattgggtcccaaatcaatccctttttgggggaagctggaaaagcaagatcacattcatattggatgggttgggaagtcaaaagcactttccagttgggaaaagggaaattggctgaatttta

SEQ ID NO: 96139 - protein, 226 aa, Zea mays
  misc_feature: Ceres CLONE 1586624
MQPSCLGACSGGGLALSARRLHGPSYCRVAPHRASASCSAGGGGKASPRGKDNVWSVDNERAAKEAVRGPKHRRRKRPSGRRLPPPRRKGKDAGSRVLVSGAMLVEVETVLQTQEPVIKPSWDTFASSLTGNWEGCWSYLLTNHSRDGARWGLGTKKSTFMTATLFLTSRDLLNVGMGSEIPKKTKLGPKSIPFWGKLEKQDHIHIGWVGKSKALSSWEKGNWLNF

SEQ ID NO: 96140 - DNA, 747 bp, Zea mays
  misc_feature: Ceres CLONE 1586625
  misc_feature: Encodes the peptide sequence at SEQ ID NO. 96141
  misc_feature (267)..(267): n is a, c, t, g, unknown, or other
tgggctccccgcggtggcggccgctctagaactagtggatcccccgggctgcaggaattcgtctcacccctagaaaagtcgcattccgcaacacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatggctatgattgatgagcctctttatccnattgctgtactgattgacgagctcaagaaatgaagacatcccggttgcggtctaaacttccattaagaagacttttcaacaaattggcccggggcttcttggggagaagaaaagaaaccccgggaaggggggcccggattcccctttttttctttaggggggaaaaaaccaaccctttttgtttttaaaaaaccccaaaggggggcgcttttttttttgcccaaaaggggggcgtgaaaaaaggaaaaatattgggggggggggggggggggtccccactttcccccccaattattttttttgggggggggggggggttgaaaaaaaaaaaaaaaggggccccccccaaggggtttttttttggcccccccccccccccccttttttttggggggagaaaaaacattttgttgggggttgttaccacccggggggggggggggggaaaaaaaaaaaacttctttgtgggggccgccccca

SEQ ID NO: 96141 - protein, 99 aa, Zea mays
  misc_feature: Ceres CLONE 1586625
WAPRGGGRSRTSGSPGLQEFVSPLEKSHSATPAPRPLLSEATPRALLPCPVSGPPAPSARQPAVTEARSGPREKSLLYLMAMIDEPLYPIAVLIDELKK

SEQ ID NO: 96142 - DNA, 840 bp, Zea mays
  misc_feature: Ceres CLONE 1586628
  misc_feature: Encodes the peptide sequence at SEQ ID NO. 96143
ccccgcggtggcggccgctctagaactagtggatcccccgggctgcaggaattcgtctcacccctagaaaaattccgcgcgagatcagtagggtgcgcgtgctggtgctggctacggccatggcgacgcccaccagcaccgtcacccgcggcggcaacaggcattggcattgtacccaagtgcttccactgctgttgctagtaccactatgcttcgcgcttctggttgagagcggcggcatccccacgacgctggacgggccgtttccgccggccacgcgcgcgttcgaccgcgcgctgcggcagggcagcaacgacgtcccgctcacggatccgcgccttgcgccccgcgtgcagcccccggcgcccgagcagatcgcgctcgccgcctccgccgacgccgactcgctctgggtctcttgggtcacgggccgcgcgcgcgtgggctcctccaacctcgcgccgctcgaccccgccgccgccggcagcgaagtctggtacggcgagcgcagcgccgccgacgccgcatcctatccgcacgtggtcacggggtccgccgaggtgtacagccagctgtacccgtacccgggcctgctcaactacacctctggcgccatccatcacgtccgtctccgcggcctgcgccctgccacgcgctactactaccgctgcggcgacagcagccttcccggcggcctcagcgacgagcacttctttcaccaccctgcccgccaacggcgccgggatgctaccccgcgccgcgttcgcttttggaaggggacctttgccttcacggggaaactccaccggcacgttggaacaccttcgccggaaagaacca

SEQ ID NO: 96143 - protein, 240 aa, Zea mays
  misc_feature: Ceres CLONE 1586628
MATPTSTVTRGGNRHWHCTQVLPLLLLVPLCFALLVESGGIPTTLDGPFPPATRAFDRALRQGSNDVPLTDPRLAPRVQPPAPEQIALAASADADSLWVSWVTGRARVGSSNLAPLDPAAAGSEVWYGERSAADAASYPHVVTGSAEVYSQLYPYPGLLNYTSGAIHHVRLRGLRPATRYYYRCGDSSLPGGLSDEHFFHHPARQRRRDATPRRVRFWKGTFAFTGKLHRHVGTPSPERT

SEQ ID NO: 96144 - DNA, 840 bp, Zea mays
  misc_feature: Ceres CLONE 1586632
  misc_feature: Encodes the peptide sequence at SEQ ID NO. 96145
acccgcggtggcggccgctctagaactagtggatcccccgggctgcaggaattcgtctcaccccctagaaaaagacgaactcatcactgcactggtggtgcccgtggtgctccacagagtgaagcgatagccaggagaggcgacgatgcgcaagtgggcgctctcctccgcgctcctcctcctctttctcctcaccacactccccgacccagctaagaagctacaagtgaatgccgaggagagcagcgatgacttggctaacccaccgaaggtagaggagaagtttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgcgttggataagattaggttcctttctcttactgataaggaagttctaggtgaaggggacactgcaaagcttgagattcagatttagttggacaaagagaaagaaatcctctccattcgggataggggtattggtatgaccaaagaagatcttattaagaaacttggaacgattgctaaatctgccacttcagctttttgtggaaaagatgcagtctgggagtggacctcaatcttattgggacaggttggggggtgggcttcctacccctgtggtactttgggtggctgaaccaagtttgaagtgggtcccgcaaggccccaatggatgaataaacacgtatggtggggggc

SEQ ID NO: 96145 - protein, 142 aa, Zea mays
  misc_feature: Ceres CLONE 1586632
MRKWALSSALLLLFLLTTLPDPAKKLQVNAEESSDDLANPPKVEEKFGAVPHGLSTDSEVAQREAESISRKTLRSSAEKFEFQAEVSRLMDIIINSLYSNKDIFLRELISNASDALDKIRFLSLTDKEVLGEGDTAKLEIQI

SEQ ID NO: 96146 - DNA, 873 bp, Zea mays
  misc_feature: Ceres CLONE 1586633
  misc_feature: Encodes the peptide sequence at SEQ ID NO. 96147
  misc_feature (873)..(873): n is a, c, t, g, unknown, or other
ggcggccgctctagaactagtggatcccccgggctgcaggaattcgtctcacccctagaaaaaggttggttggggtggaggaccgtcgccttccccgtttcgtcttccggtcctcgttttatcccctcgcccttgcactcctccgccgcacccctttcctccttccgccctccgccgcgcctggctttctcccttcccgagaggccacgctccatccccgcccgcgctgcctcccctggcgatcggcggcgaccgcggcccaacgaaagcgtcgtggtcggccgacgctgggcggactgggaacaagcgccaatggggatcgcggtggtggctctacacaccatgccgggggcgttgaccacccactccccggcatccattctgccccttcgggcagactttacgaggataaacagccgcacctattcggtgccaaacgccaggacactgccaggcgtcctaaggatcccgagggctgaggtcggtcaaggcggctgtgcccagcggatccaatgaccggggttacagaggggaaacgggtccttgggttcaacgaaggccattgaaataacccttggccagggttcttgtggagaacctcggccgtgtttgtggtccaaggctgttatgggggaaatgcgggggtctaaaatggggaaggggctgcccaagaaaacccaacctcagaaggcgtgaaacgtccctccttctgtttgcagaaaagaagggcccgggggaaacgttttgcccgggaaatccaaggtggcttaccccttggggggctcagcccctggttgcggaacgatattcttgcccttgcaaatccaaaaatgaacgacgggttccaggtcgaacccacgtgtccggggggtn

SEQ ID NO: 96147 - protein, 67 aa, Zea mays
  misc_feature: Ceres CLONE 1586633
MGIAVVALHTMPGALTTHSPASILPLRADFTRINSRTYSVPNARTLPGVLRIPRAEVGQGGCAQRIQ

SEQ ID NO: 96148 - DNA, 864 bp, Zea mays
  misc_feature: Ceres CLONE 1586634
  misc_feature: Encodes the peptide sequence at SEQ ID NO. 96149
ctccccgcggtggcggccgctctagaactagtggatcccccgggctgcaggaattcgtctcacccctagaaaaagattgaggggattgctactaggcgggcgctagcactgcgaagcatctcgcctcatcgtctcctccgtgctccacttgcccattcttacgcgctaagcaacaggccagccggccgtagctccaaagcgggagccggagccggagccgggagctaaggggggccgtgatgtcgtcgtcgccgacggccgcgccggcgccgaccacgccatcggctccgccggccaacgcgacaaatccgccgcccgcgaccccgtccgcgccgccaccggcggcgcccacgcctcccacgcccaccccgcccacgccgtccccgccgtccccagccgcgccgccgccgtcacccccctccgtcccggcccccgcgccgtcctccaccccggcgactccctctgcgccctcgccctcctccccttcctccccgggcacgcccgccaccccgtcgcctccatcggacaccccgtcgccgccgtcgtccggtggagggggcaggtccccgccgtcgtctgggggtgggcgatccaagccggtctcccactcgcctcccagtgactcgccggggggggggggggggggcaactccggggcgtttacgttgtcttcgtgtgggggctgggccctcgggggcctccctgcttgtgcctgcttcccaggttaatttggcctgggtggttcccccaaaaaaaggcctacttggaggccgccgccttctttgagaaaaaagggaatctccccgcgcccccgctcccccttaaaggggggggaacttttccggggtggaaaagtaacaaaat

SEQ ID NO: 96149 - protein, 162 aa, Zea mays
  misc_feature: Ceres CLONE 1586634
MSSSPTAAPAPTTPSAPPANATNPPPATPSAPPPAAPTPPTPTPPTPSPPSPAAPPPSPPSVPAPAPSSTPATPSAPSPSSPSSPGTPATPSPPSDTPSPPSSGGGGRSPPSSGGGRSKPVSHSPPSDSPGGGGGGNSGAFTLSSCGGWALGGLPACACFPG

SEQ ID NO: 96150 - DNA, 831 bp, Zea mays
  misc_feature: Ceres CLONE 1586636
  misc_feature: Encodes the peptide sequence at SEQ ID NO. 96151
caccgcggtggcggccgctctagaactagtggatcccccgggctgcaggaattcgtctcacccctagaaaaaaatccatccggagaagctagagtccaggtctcactcgcgaccgagagccacagagaaatgggggcccctgctcgtccctggcgccggcacgtcttcctcgtcgtgtcgctgcagctgctccttgtggcgccatggcaggacgagacggccgctcgagctctcaatttcaccaggcaggatttccccagggccttcgtctttggtgccggcacgtcagcttatcagtacgaaggggcaaccgatgaagacggaaggagcccaagcatatgggacaactttactcatgcaggtaggatgccggacaaaagcactggcgacctaggggcggacggctaccacaaatacaagggagacgtgcagctgatgagtgacactggcctggaggcctaccgcttctccatttcttggtccaggcttattccaagaagaagaggagccatcaaccccaagggccctcgagtattacaacaacctgatcaatgagctagtaaaacgaggaattgagatacacgtggaccctgtcccacctgggattcccctcagatcctggaggacgagtaccacggctggctaaacccccaggagggtggacgactttcaaggcgtacccgggacgtttggcttcccgcgaagttccggcaacgggggggaagccacctggaccccccatggaaacaaaccccaaaacgtctaacttccattcccccgcttaacgaaaaaccggggcgccttttccccccccggggcgggtggtttcct

SEQ ID NO: 96151 - protein, 141 aa, Zea mays
  misc_feature: Ceres CLONE 1586636
  misc_feature: SWISSPROT Homolog: EC 3.2.1.21 Beta-glucosidase
MGAPARPWRRHVFLVVSLQLLLVAPWQDETAARALNFTRQDFPRAFVFGAGTSAYQYEGATDEDGRSPSIWDNFTHAGRMPDKSTGDLGADGYHKYKGDVQLMSDTGLEAYRFSISWSRLIPRRRGAINPKGPRVLQQPDQ

SEQ ID NO: 96152 - DNA, 873 bp, Zea mays
  misc_feature: Ceres CLONE 1586640
  misc_feature: Encodes the peptide sequence at SEQ ID NO. 96153
  misc_feature (442)..(442): n is a, c, t, g, unknown, or other
ctggagctccccgcggtggcggccgctctagaactagtggatcccccgggctgcaggaattcgtctcacccctagaaaaatagaaaagctacgccaatggctatagggcacaagaacaccaccaaagtggcgctcctagttctgctgctgtcattgatgctctctttgacagcgtcagtggcgcgcaatctccaatggcgactgtccgtcgctacggctgtggaggtgtgcgtgaaggctgctgtcggggctcctgacaagcttggcgactgtcccttctcacaaagggtgctgctcactctggaggagaagaaggtcccttaccggatgaggctcattgacctcagtaacaagcctggatggtccgtctcgtttacttttcctgtttattttccagagcagtatcctgtagggtctgacgactaagttgacaaagtactanctgggggtcgtgtcttattttctacactcaagttgttctgggcagagatttctctgggtgtagttttcatagtttcattgatggactggtagtagagaccaggaaggcaggagcaatacgagacagaatattttgctttctgcttgttttgctttggagggtttagatatatttagtggattcgttggatgtggcagatttcccttggtttaactgaaactgtatttcctggaacttggcattttgaaataaacactgccttaggggcctgttttggttggggctgtggcttgtaaaaaaaagttccttgtgggctctgtaacctttaaaaaaaaaatttcctgtaaggcctgtaaacctgttaaaaaaagctaaaaaattcttttggggggagaaaccccctaaaaagtccgttaaaaaattccttccac

SEQ ID NO: 96153 - protein, 109 aa, Zea mays
  misc_feature: Ceres CLONE 1586640
MAIGHKNTTKVALLVLLLSLMLSLTASVARNLQWRLSVATAVEVCVKAAVGAPDKLGDCPFSQRVLLTLEEKKVPYRMRLIDLSNKPGWSVSFTFPVYFPEQYPVGSDD

SEQ ID NO: 96154 - DNA, 850 bp, Zea mays
  misc_feature: Ceres CLONE 1586642
  misc_feature: Encodes the peptide sequence at SEQ ID NO. 96155
tggagctccccgcggtggcggccgctctagaactagtggatcccccgggctgcaggaattcgtctcacccctagaaaaaaccagacgccaatcccgatcaccgccgcccaacctcacctcccctccgtcccccgagccacctcacaaaccctgttcggtgcctctcactccggctgccagatggacagcgccgacgcggcgacggcgctgggcgcgtggatccggggctacttcacgccggccacgttcttcctcgtcgtcaacctcgtcatcggcaccatcgcgctcacctcccgtgccacccagcagcgccgccgcagggagaactactaccacgacgacggccacagccacggccacggccaccaggaaacgctgcacccgcagatggagcagccggggtacggccactactaccacccggaccacacgcacacgctgtacgcggcgccgcctccgcccgcgccgctcgcgcgcacgtcctctgtcctcgaccgcctcaggtcgctcggcctgtaccgcttccgctccggggacttcccgcccgagtacggcgccacgccgccgaaccacgcgcaggatgtgcccgctccggtggaggaggaagagacgatcgcgtcggcgcactacgacaggagccggtccgagccggcgcctgctgctcgggaagatgaagaggaggccggcaacgcccaggggtaaagaagtcaggctcgagaggtgaaggaagtcgcaaggtgtcgcgggcggcggcccaggatcgttcaggcggtcaccgaggacgacgactccctcccaaggaaaacccgggcggccgaacgtttttagagggggaaggccgtccgccccc

SEQ ID NO: 96155 - protein, 173 aa, Zea mays
  misc_feature: Ceres CLONE 1586642
MDSADAATALGAWIRGYFTPATFFLVVNLVIGTIALTSRATQQRRRRENYYHDDGHSHGHGHQETLHPQMEQPGYGHYYHPDHTHTLYAAPPPPAPLARTSSVLDRLRSLGLYRFRSGDFPPEYGATPPNHAQDVPAPVEEEETIASAHYDRSRSEPAPAAREDEEEAGNAQG

SEQ ID NO: 96156 - DNA, 842 bp, Zea mays
  misc_feature: Ceres CLONE 1586648
  misc_feature: Encodes the peptide sequence at SEQ ID NO. 96157
ggagctccccgcggtggcggccgctctagaactagtggatcccccgggctgcaggaattcgtctcacccctagaaaaatcttaatttcctcgcagcgccggcgctcatcttccgctttctctcttactcgcgctcaccacgcaggcgacggcgtcggcgctcaggctcgggctctgggcgacggcgtcagcggcttctcctcccgcctctctccagtcgcctcgcgccctcgcctccggtcctccgcacaccggccggtgaccctgcgtgcgtgcctctctctctctctctctctctcccctcccgcatccggtggatcgtcaacgccgcccggcccgggcggcagcgccgcgcgccacctgagggcagcgggagccagcagccgctgcttcaccaaggcggtcgcgccgcttttggagcgcttatgcccccggtccgctgagcgcttagtgcagttttttggaacatgagacctcctagcagtggcaaaaagactgaggtctcccataacgtggagaaatgtggggtttctgatcaagcttgtcatggcaaatgccaaagctgtggcatcgatgcaaaacctttttgtgctggagtgaacgaagtctccttgttgaccggcagtcacactggtgtggaggcctcaaaagagaattgtggagcatgcagttttaacaatgatcgtgctgatgctctagaagaagaggccaggtttccacagctaggataggtcatgttgagagtgctgaccctggtggctctgtgggtgtaggaaaaggaaatttcatggctgttaatgaggagtctgaagggggagcagctgggcaaccactggaggatct

SEQ ID NO: 96157 - protein, 87 aa, Zea mays
  misc_feature: Ceres CLONE 1586648
MRPPSSGKKTEVSHNVEKCGVSDQACHGKCQSCGIDAKPFCAGVNEVSLLTGSHTGVEASKENCGACSFNNDRADALEEEARFPQLG

SEQ ID NO: 96158 - DNA, 1219 bp, Zea mays
  misc_feature: Ceres CLONE 1586649
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (706)..(706): n is a, c, t, g, unknown, or other
  misc_feature (713)..(713): n is a, c, t, g, unknown, or other
tggtggttttgtttnntnatttcgcgtgggtttcttggcgggggctttttccgccacgaacaaaaataataaaaactggaactcacgcggtggcggccgctctagaatagtggatcccccgggctgcaggaattcgtctcacccctagaaaaaacaaaagctgctcatcaccgcacgatggtgccacggctaacacaagcaagcaagcaagtcactgagtagctagcggtatataccaccataaaaacaacacacacacaccacgtgcgctaataagctaagcttaaggcggtagccgtagctcctctcgatctccgggctcggacagacgacgttgccatggctgctcaacggcatcacgcactatactagctgctgcccgaagcagcaggagcgaaacgagctctgctggtcgcggatcccttctccctgctgctcctgccggtcctgctgagctacctcgcagcgtttgggtaggcccccccccccccccaacgaaagaagtagggccgggcgaccgaccacgaaaaagtcgttgagccttgttgacacttcaccccccctaaaaacttcccccaaaaagaagggaacctgtccccataaaagggggggaaaaatccccgactgtctactgtcgccagacgacgactagtgaaccttggctgcactgtgtctttccggtcagttccatggggnnnnnnnnncngaacagntctgaaatagcggaagtagatctatgatctggagcctcagcccttattctagacacagcgatcgcgtcggagaggcgtgtctatgacgtttcttgtagatagaacaaccggttggctatgcgcgcgatacatatgccagaaacctcaaaacagatgtaacgaagaccaagtacttgtcgacagaagctcccttagtaagagtcaatccccttactgctgatccacactccgtacggggggtacgaggagagaaccttatcgcatcaagtacttcataatagatgcaacactgtaagcagcgttctggagtataaacaagagagcacacaaacgtgaagagtcttgcttcagatctggatagctccttgtgacaataagtccgtgtggatattagtcaggcgtgtaactcagtatggctgtgggactcgtacggaacgctggtgggacttagccatcatcatgcggtagacgagtaacacacacactaacacctatcaagtacattg

SEQ ID NO: 96159 - DNA, 802 bp, Zea mays
  misc_feature: Ceres CLONE 1586651
  misc_feature: Encodes the peptide sequence at SEQ ID NO. 96160
ggagctccccgcggtggcggccgctctagaactagtggatcccccgggctgcaggaattcgtctcacccctagaaaaaagccttcacccctgctcgctgtgtcttctccacttcgccctgcgtacgctccccagtctcactctctctccccctctacctcgttcgtggcgacgacagggcgaccgccgctgccaccgccgcctctccactgtgtgcccagtgctttgcccggccgttcgccggcgacgggcactcaccaccaggtgacaaaggaaaaggaagaggggcagcaaatcggtgcgctgctgttcatcaaatgctggggaggaaatcaacagatcaggggcctggtgaaatgctgcgcagcgagggtgactgactggcaactccgcccgccgacgcccgtttcgtgcttactggcatgctcgcagcataaaggaatcttcccggaattagcccccctccctgtggccgtgacggccccaagtttcaagacatggaccatgtgccggctctagttcttgccgggtgctgcttcctggccctgctgcctggctgggcctgtggccttggctccatgtcgtccattgcggtgtcctatggggaggatggtccggtgttctgtggcctcaactccgacggctcccacctcgtcgcctgcttcggtgctgatgcatctgtcctgtacggcgcaccacccaacatccctttccttggcctcacggcaggagatgggttcgtgtgtggcctcctgctcgacacaggcagccatactgctggggtagcaactcctatgtcaagc

SEQ ID NO: 96160 - protein, 102 aa, Zea mays
  misc_feature: Ceres CLONE 1586651
MDHVPALVLAGCCFLALLPGWACGLGSMSSIAVSYGEDGPVFCGLNSDGSHLVACFGADASVLYGAPPNIPFLGLTAGDGFVCGLLLDTGSHTAGVATPMSS

SEQ ID NO: 96161 - DNA, 845 bp, Zea mays
  misc_feature: Ceres CLONE 1586654
  misc_feature: Encodes the peptide sequence at SEQ ID NO. 96162
  misc_feature (578)..(578): n is a, c, t, g, unknown, or other
  misc_feature (662)..(662): n is a, c, t, g, unknown, or other
  misc_feature (753)..(753): n is a, c, t, g, unknown, or other
ctccccgcggtggcggccgctctagaactagtggatcccccgggctgcaggaattcgtctcacccctagaaaaagccctcccctcctccccatcgcgtcctctccgctacacctcgccgatcggatcgcgacgagacgccgcgcgatccgacctaggctgacgccaacgaccactctcgccgccggcggtcatggcgtacggcgaccgcgttaccaccttcgaggactcagagaaggagagcgagtacggctatgtccgcaaggtctctggacctgtggttgttgctgatggaatgggtggtgctgccatgtatgaacttgtccgcgtcgggcatgataacctcatcggggaaattatccgtcttgagggcgattcagctacaatccaagtttatgaggaaacagctggactgatggttaatgaccctgttttgagaacgagaaagcctctatcagttgaattgggacctggaattcttggaaatatttttgatggtatccagcgccctctaaaaaccattgccattaagtcaggagatgtgtatattcctcgtggtgtttcagttcctgcccttgancaagatgcattatgggaatttcagccaaagaaactaggtggttggagatgtcatcacagggtggagatctatacgctactgtcntttgagaacacattgatgcagcaccatgttgctcttcccacgggttctatggggaaaaatagttacattgcaccagctggtcagtacaccnttcaggacacagtgctagaattggattttcagggcataaaaaagaatttaccatgcttcagacatggcctggtgcgtccaccaaggctttta

SEQ ID NO: 96162 - protein, 218 aa, Zea mays
  misc_feature: Ceres CLONE 1586654
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (129)..(129): Xaa is any aa, unknown, or other
  misc_feature (188)..(188): Xaa is any aa, unknown, or other
MAYGDRVTTFEDSEKESEYGYVRKVSGPVVVADGMGGAAMYELVRVGHDNLIGEIIRLEGDSATIQVYEETAGLMVNDPVLRTRKPLSVELGPGILGNIFDGIQRPLKTIAIKSGDVYIPRGVSVPALXQDALWEFQPKKLGGWRCHHRVEIYTLLSFENTLMQHHVALPTGSMGKNSYIAPAGQYTXQDTVLELDFQGIKKNLPCFRHGLVRPPRLL

SEQ ID NO: 96163 - DNA, 837 bp, Zea mays
  misc_feature: Ceres CLONE 1586655
  misc_feature (653)..(653): n is a, c, t, g, unknown, or other
ctccccgcggtggcggccgctctagaactagtggatcccccgggctgcaggaattcgtctcacccctagaaaaaattttgacctccggagtgctgactctatcctagtcgactgtgttgtgtctggattggtcgggtgggactcgcctgtcatctacatgaagggcctcttgggatacgtggtctccggccttcccagtatactcttactgctcttctatcggggcgtcaatccgtgcgctacatgttccgctcaccttccacgtgctctccatcgacgtcttccaggactacggggactaccgagtggcctgcgattccatgtcggcgcagagctgcggtaccggagccagccgatgtctctctatcacccgcggacttcaggtgagtcgcggccttcctcgtcaaagcagatctgggcgaatgtaacgcgccaagcgataatggtactgtcttgcaagatctagcatttagtgtgcacttcgagacaattatttggagtatttgaaagtatgacttggctctctgtcgctgtcacttatgtgccctgtgcttcattcaagaagagcgacatctttcatctagtatgggctctgagagactgcttagatgtaccagacatctcgtagtctcttgagaaaatctctgcggtcntggctaaattggagatgatattgtcctgctcttgaggcataatcggaactggatctttgctgatcttcacggagatgttatcaggattgaaagggtcagattcatggcgtgcctatgcttctgacctttcaatggctgccacggttacattcatgcagtaaggccccggcatgtcttttcatta

SEQ ID NO: 96164 - DNA, 849 bp, Zea mays
  misc_feature: Ceres CLONE 1586657
  misc_feature: Encodes the peptide sequence at SEQ ID NO. 96165
ggagctcaccgcggtggcggccgctctagaactagtggatcccccgggctgcaggaattcgtctcacccctagaaaaatacacgcggcggcggcgggcagatccatcttggtatacacgtaatatatacacacacacacgatgggcagcgccggcggcggcggcgagagcaagctggagagcccgctgctgggcgcgtcgtcgacgggccacggcgaggcggtggtgagcgggcagctggagagcatcctgggcgacgcgtccgtgccgtgggggacgcggatggcgtcggcgtccgcggtggagatgcggctgctggtgcgcctggccgcgcccgccgtgctcgtgtacatgatcaactacctcatgtccatgtccacgcagatcttctcgggacacctcggcacgctcgagcttgccgccgcctcgctcggcaacaccggcatccaggtcttcgcctacggcctcatgctgggcatggggagcgcggtggagacgctgtgcgggcaggcgtacggagcgcacaagtacgacatgctgggcatctacctgcagcgctccaccgtcctgctgatggccacggggggtgccgctggcggcgctgtacgccttactcccgccccgttcatgctcctgctggggggaagtcccccgagatcgcggtcgggccgccccccgtctttcgtgtaccggcctgggtccccgcaagattcttcgccctaccgccggccaactttcccccatcccagaaagtttcatggcagggcgccaagaacattccctggggggccccaagcggccctaaaattttacccgcccggccggggatttccgaaggccccaaccctta

SEQ ID NO: 96165 - protein, 236 aa, Zea mays
  misc_feature: Ceres CLONE 1586657
  misc_feature (65)..(221): Pfam Name: MatE Pfam Description: MatE
MGSAGGGGESKLESPLLGASSTGHGEAVVSGQLESILGDASVPWGTRMASASAVEMRLLVRLAAPAVLVYMINYLMSMSTQIFSGHLGTLELAAASLGNTGIQVFAYGLMLGMGSAVETLCGQAYGAHKYDMLGIYLQRSTVLLMATGGAAGGAVRLTPAPFMLLLGGSPPRSRSGRPPSFVYRPGSPQDSSPYRRPTFPHPRKFHGRAPRTFPGGPQAALKFYPPGRGFPKAPTL

SEQ ID NO: 96166 - DNA, 829 bp, Zea mays
  misc_feature: Ceres CLONE 1586662
  misc_feature: Encodes the peptide sequence at SEQ ID NO. 96167
ctggagctccccgcggtggcggccgctctagaactagtggatcccccgggctgcaggaattcgtctcacccctagaaaaatcccgccgtcccgccgccaccgcagcaccgctactgccggagtctctcgccaccgtcgttgctctcccgccttcaccgtgccaactcccctccttgcctcccccgcgcttcagtcgctccactccccatcgctttcgcctggtcagaattccagatccaggtgtcctttgacccagaccgcgcctgcctttccctccgctcggattcttcgccgtcttcgttcctactgggcaccgccggggtggagcggagatcggatccgccaggagctgattccttctctcgtagtctagtttgatgcggattcattcgctgaccggcatagcatgatcctgcggtgattgcggtcgcggatagcttgtgcaagctgttggcttgggagttatctttctaatctggcctaaagaaatcctgaggcggtagcgtcacatggatgcaagtacggaggttactgatgttattactgcagtgggcattgacaatgggccaacggggaagttgccgccccgtgatagtgtagaggggcacgcagaaagacacgacgtgctggctgaatgaacgcatttcgggtgagagcgaggtgatcaacccggtctgagaaagtggaaatggggagccacctcgcaatcccagggaaataaaagccccagagttctgaaggggggttcaaggccctttccccggaaggtggttaactaaatcttcccgaaaagaagccctcgggggcgggggaaaaaaaggtgaagccc

SEQ ID NO: 96167 - protein, 42 aa, Zea mays
  misc_feature: Ceres CLONE 1586662
MDASTEVTDVITAVGIDNGPTGKLPPRDSVEGHAERHDVLAE

SEQ ID NO: 96168 - DNA, 870 bp, Zea mays
  misc_feature: Ceres CLONE 1586665
  misc_feature: Encodes the peptide sequence at SEQ ID NO. 96169
  misc_feature (870)..(870): n is a, c, t, g, unknown, or other
ggagctccccgcggtggcggccgctctagaactagtggatcccccgggctgcaggaattcgtctcacccctagaaaaaaacaaaacaccactccatctctcctcttcccagcgatttcctcttcccctcctcgcccgccgagaggccgcccgtcctccgtccgccgtcccagcgagagctttaagattgtgcagacacataatttggatgctcctgcctatgcaagatgtcaaccaccagagatattgtttagtgctgggaaagttatgcagttttggatcataaattctacatagacaagataattatggaccgtgcagacacatcagggtttgtcagtggtggttgctttggtactacactcctgctgatattctttcatttcgtctattctacagtccgtgtctgaaagatcgtcagtaacgctgcagctgcctgggcagaaatatcatcaggccccctgttctttgagatctctggtgttttatctcattttcttttccaccatcggtatattgtcttaactgtgatggataacggcttcatggacatcccccatccgcctctgatgaatgacccttttgtgttagtgggatgctcagcgcccagctccacggtggagaacatgggccaaagcacactctgtatggatggcctggaacccagcaattgttaattgcagccatgttaatggaaaatacacaggattatggattgacattaacaccgagagaagaatggccagcaggtttaagtccctttgggttgggggtccaacccccgaaattttttatttctggcagtggtccccctggggctccaaaaacaggcctcagaagatatgtgccggggcccagaaggtttcaactn

SEQ ID NO: 96169 - protein, 48 aa, Zea mays
  misc_feature: Ceres CLONE 1586665
MDNGFMDIPHPPLMNDPFVLVGCSAPSSTVENMGQSTLCMDGLEPSNC

SEQ ID NO: 96170 - DNA, 851 bp, Zea mays
  misc_feature: Ceres CLONE 1586666
  misc_feature: Encodes the peptide sequence at SEQ ID NO. 96171
  misc_feature (582)..(582): n is a, c, t, g, unknown, or other
ggagctccccgcggtggcggccgctctagaactagtggatcccccgggctgcaggaattcgtctcacccctagaaaaaaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacnggcacacgctgccgtcggaggtcacccgcgcggcgatgctggtgcgcatcaacaccctccttcagggctactccggcatccgcttcgagatcctcgagggcatcacgaagctgctcaacaccgggtgtcagccccctgccttgccgcttccgggggaaccatcacccgcggtcgggccgacctgggtcccggcttttccaacatcggccgggccttcattaacgggggccgcccccaaacgcgcaaggccggtctacccgttcaaaagg

SEQ ID NO: 96171 - protein, 224 aa, Zea mays
  misc_feature: Ceres CLONE 1586666
  misc_feature (41)..(224): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature (135)..(135): Xaa is any aa, unknown, or other
MAGNGAIVESDPLNWGAAAAELAGSHLDEVKRMVAQARQPVVKIEGSTLRVGQVAAVASAKDASGVAVELDEEARPRVKASSEWILDCIAHGGDIYGVTTGFGGTSHRRTKDGPALQVELLRHLNAGIFGTGSDXHTLPSEVTRAAMLVRINTLLQGYSGIRFEILEGITKLLNTGCQPPALPLPGEPSPAVGPTWVPAFPTSAGPSLTGAAPKRARPVYPFKR

SEQ ID NO: 96172 - DNA, 840 bp, Zea mays
  misc_feature: Ceres CLONE 1586667
  misc_feature: Encodes the peptide sequence at SEQ ID NO. 96173
ggagctccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcgggcttcgtcgccttcgtcggcaacctcctcttcccttttatcgcgttcgctgggctcttcttcctctttccgccgcgcgcaggggggggcccggcgcccggccctggtgggctccggggggcccatgggactttcgggccgcctccaagagcaagttcccgggaaggggt

SEQ ID NO: 96173 - protein, 230 aa, Zea mays
  misc_feature: Ceres CLONE 1586667
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGLRRLRRQPPLPFYRVRWALLPLSAARRGGPGARPWWAPGGPWDFRAASKSKFPGRG

SEQ ID NO: 96174 - DNA, 856 bp, Zea mays
  misc_feature: Ceres CLONE 1586672
  misc_feature: Encodes the peptide sequence at SEQ ID NO. 96175
gagctccccgcggtggcggccgctctagaactagtggatcccccgggctgcaggaattcgtctcacccctagaaaaaacacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgaatcagttgtagctggtgaatttggcaagactcaatttctctcatctgagttcagaaacgtttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcactgcagcctgctgaagtctttacttgctgcattctgtgctcacttttgaaagctgctctcttctgctctgcggttgttgatttctgcactcaagcttctcttggctgtgaactcaagcttctctcttcctggggaaacaagtgatctccctggaagcattttcggctttttacctaaaagattctttctgtttgttaaaaggaaagaaaaggcttttagggtggatgggcccaaactaaggcttggcttccccgggtttttcgttttccccccccaaacccaaaggtttgaagactccctta

SEQ ID NO: 96175 - protein, 29 aa, Zea mays
  misc_feature: Ceres CLONE 1586672
MSAEVAGGHPYFLSCYFWFIYCIKFRDFT

SEQ ID NO: 96176 - DNA, 825 bp, Zea mays
  misc_feature: Ceres CLONE 1586673
  misc_feature: Encodes the peptide sequence at SEQ ID NO. 96177
  misc_feature (631)..(631): n is a, c, t, g, unknown, or other
ccccgcggtggcggccgctctagaactagtggatcccccgggctgcaggaattcgtctcacccctagaaaaaaaaccctggaatctcgcccaccgccccactcgccgcccccgctggtcatccctccacccaaccccgctcctcggggaccgctcgtcgccggagccgccgccggcctcgagcgatagggatcgacagcgagctcgcgagcccgtcccgcaacctgatctgcgaggaccaccgggtgggaggctgcgagatcgacgacgggctcggttcgattcggctggcgcgagcaccagcctatctatctgagacgggcatcggcggcggagagacctggcgcgcggcggaacgctgaggttatcttgtattctcgtcaagacaactctcttccctcagagcactgaacaatcattgtgatttatgactaactctgagtggtgaaagaattaagaaaatacagaacaccgcgatggctgttagatgctcctgtactgctcttttccctctattcttctgttttatgatctgtcagctttgctatggcactgtaactgatatccaatgtctgaagaagctgaaggcatcagttgatcccgacaataagttagaatggacattcaataancatacagagggatccatatgcggggttcatgggtgtggagtgctggcatcctaatgagaacagggtcctttcgcttcatcttggtagctttgggcttaggggcgaattcctgatggacctgagaattgtagtagcatgacttcgctggatctcttcagcaacaggctctctggccctatcccggctgaatttta

SEQ ID NO: 96177 - protein, 69 aa, Zea mays
  misc_feature: Ceres CLONE 1586673
  misc_feature (52)..(52): Xaa is any aa, unknown, or other
MAVRCSCTALFPLFFCFMICQLCYGTVTDIQCLKKLKASVDPDNKLEWTFNXHTEGSICGVHGCGVLAS

SEQ ID NO: 96178 - DNA, 796 bp, Zea mays
  misc_feature: Ceres CLONE 1586676
  misc_feature: Encodes the peptide sequence at SEQ ID NO. 96179
ggagctccccgcggtggcggccgctctagaactagtggatcccccgggctgcaggaattcgtctcacccctagaaaaaatccgttgttcaattcgttcagctagccggccagagatcgagcatcatctccatcatcgatcgatccatctcatctctttctcttcttctattctatgtcgtcgtcgtcccagattaggtcgaagctgctagcagtctatccagtctctagctagctagatcaagcccgcagactatataatataatacaagctagctacgtgcttattgctttattagtctagaagaataatctagatatatacgatcgaacatatatctcgatctccgatccaccgatacacacccggccctatccatgcttgaggtgtcgacgctgcgcggccctactagcagcggcagcaaggcggagcagcactgcggcggcggcggcggcttcgtcggcgaccaccatgtggtgttcccgacgtccggcgactgcttcgccatggtggacgaacaccctctggactacatcgacttcagctgcgacgtgcccttcttcgacgctgacggggacatcctccccgacctggaggtagacaccacggagctcctcgccgagttctcgtccacccctcctccggacgacctgctggcagtggcagtattcggcgccgacgaccagcgggcggcggcagtagcacaagagaaaccgtcgtcgtcgttggagcaaacatgtggtgaaccaaaaaggggtagcagtagccgtcgccagaaaaaagctgcaaacaccacc

SEQ ID NO: 96179 - protein, 140 aa, Zea mays
  misc_feature: Ceres CLONE 1586676
MLEVSTLRGPTSSGSKAEQHCGGGGGFVGDHHVVFPTSGDCFAMVDEHPLDYIDFSCDVPFFDADGDILPDLEVDTTELLAEFSSTPPPDDLLAVAVFGADDQRAAAVAQEKPSSSLEQTCGEPKRGSSSRRQKKAANTT

SEQ ID NO: 96180 - DNA, 1145 bp, Zea mays
  misc_feature: Ceres CLONE 1586677
  misc_feature: Encodes the peptide sequence at SEQ ID NO. 96181
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (20)..(20): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
cgcgacacacannnnngngntacaccctatttatatccaccccccaataaaataaaaatatnnnnatcacaaaataaaaaaactgaactccccacggtggcggccgctctagaactagtggatcccccgggctgcaggaattcgtctcacccctagaaaaaacgctccgctcgttcccccaaatagttcctcggcttcgctcccttcccctccctgctccggctccggttcgcacacagtaagaaaagatggcgctgccatccatgagtcttgcggcaaagggtgtgcttcccttctcagcacgtacctcgagtggtgtcacacaaaggccggtgtcagtgaccgcttccttggagcacaaaaccagcgatgccagaaggaagttcctaaaacttgcacttgggaaccttggagttggactgcccaccttgttgggcgctaagaaagctctcgctgatgagcaaggcgtctcgtcctcgaggatgtcttattcaaggttccttgagtatctttgacaaggatagaggtgaagaaggttggattttgtttgagaatgggcacaatttgcctatttgttggagggccatttcctccctggagccttgggtaaccccccgggccaaaagaatccccgtggtgacaagctttccctgggttcctaaaggcacaggggaggctttcctttccagaaaaattttgaaagggggaagaaaaaaaaacaatccgcaatatttttgtgcgtgtggcttctgccgaggccaaatccccaggggaaaaaagaaacctcctgtggggaattccctccttttcctggggttccacaaccccctttattttggggaaaaatttttggtgggcaattgtccacccggccttaaattccacatatatcgggcggaggggggaccggaatctatttaagccttcttccgaagaaagggggccaccacggggggtgggcgcctcccgggggggagaactcccaaattgggtgtcccgggaccttttttccccccttggggttatttgggggggaaacatttaggcggccccaaatttttctcgaatggggaaacacccaaccgcctggggggtgtaacaatattgtacatcaatttgtgccaaggggagtacttcttcaaccg

SEQ ID NO: 96181 - protein, 88 aa, Zea mays
  misc_feature: Ceres CLONE 1586677
MALPSMSLAAKGVLPFSARTSSGVTQRPVSVTASLEHKTSDARRKFLKLALGNLGVGLPTLLGAKKALADEQGVSSSRMSYSRFLEYL

SEQ ID NO: 96182 - DNA, 832 bp, Zea mays
  misc_feature: Ceres CLONE 1586678
  misc_feature: Translation starting site: 400
  misc_feature: SWISSPROT Homolog: EC 3.6.3.14 H(+)-transporting two-sector ATPase
  misc_feature (713)..(713): n is a, c, t, g, unknown, or other
  misc_feature (756)..(756): n is a, c, t, g, unknown, or other
ctccccgcggtggcggccgctctagaactagtggatcccccgggctgcaggaattcgtctcacccctagaaaaacaccatgcccaaatccacaaattatttccattcgataggcttactgtgctgtattcatgacctgactgttttatctaactttggtttgattagctgctcctgccaagaagggtgatgccaagaccaggccttgaaggctgtcaaggttgtgaagtctgggtcaggaaagaagaagaccaagaagattcgcacgtccgtgacatttcaccgccccaagaccctgaagaaggctagggaccccaagtacccaagaatcagcactaccggaaggaacaaccttgatcagtaccaaattctcaagtatcccctcaccacagaatcagcgatgaagaagattgaagataacaacactctggtcttcattgtcgacctcaaggcagataagaagatcaaggctgctgtcaagaagatgtatgacattcaggccaagaaggtcaacaccctgatcaggcctgatggaaagaagaaggcttacgtgaagcttctcatgcatgggcgtcgcctatgagacgaccaagagtggcgtcggcgtcgcctccatgggcgtcatgcgcctcaagcttgtcatgaagtctatcgtcctcatcgtcatggccagagtcctcggcatctatgacctcatcatcgccgccatcatcntctgtcgggatcaaccccaaggccaaagcccaagcctacttcnttaacggctacgcacacctctcctttcgactcgcatgcaggcttgctgtcctcgctgtcggcatggccatcagcat

SEQ ID NO: 96183 - DNA, 1100 bp, Zea mays
  misc_feature: Ceres CLONE 1586679
  misc_feature: Encodes the peptide sequence at SEQ ID NO. 96184
  misc_feature (1)..(1): n is a, c, t, g, unknown, or other
  misc_feature (35)..(35): n is a, c, t, g, unknown, or other
  misc_feature (73)..(73): n is a, c, t, g, unknown, or other
ntttttttttttttttttttttcttttactacctnatttttatttattagttatgggaggagagtcagtcgcnaaaaaagtggagctccccgcggtggcggccgctctagaatagtggatcccccgggctgcaggaattcgtctcacccctagaaaaattggtcgcttcatgccgctcacgaactcccctcggagcccggccgtccaattatgatccacttggttaactaggaataggataattaatcgcagatgaagcagcagttcatgaaggcaggaagcagctaaatgacccatataaatggtcgcgcgcgctagcataagcatagcatagtagcgatagccaccaccgatcgaagcatgatggcggcatcgggcgcgtacgcggcgcaactcccggcggtgccggagtggctaaacaagggcgacaacgcgtggcagctgacggcggcgacgctggtgggcatccagtcgatgccggggctggtggtgctgtacggcagcatcgtgaagaagaagtgcgcggtgaactcggcgttcatggcgctgtacgcctacgcgtcatcgctgctggttgtgggtgctgggcggggtttcccattggcgttgcgggaagcggcctgctcccgcttttggggggcaagggccgggggtggggggcctcttccccaggggcttaccctggtccccggggggcgggatttccctttttttcggactaaaacacgcggggaacgggagggcccccagcgtctcccccgaaacaaagggaaagaaccccctcgttgtttacaccccgggggaaggggagtaaacgaccctctttgtgaggtcgcccttgtaccaccccaacttgatgtgaagaagaaaatttattttgtggcgcgcacctcctctccaaaaccaaggttggtgggggggggttttaggtctacatgatcgcgcgcgagcttgatacttatcttcatccgtagaatagacgtgcccgcgcccatcctcgtgcaaatcttttctgtatgtgtgattgtggtctctcttctcacgatcgtatctgttggattaggtgaagaaggcggtaattatcggcgacctaaaataca

SEQ ID NO: 96184 - protein, 191 aa, Zea mays
  misc_feature: Ceres CLONE 1586679
MAASGAYAAQLPAVPEWLNKGDNAWQLTAATLVGIQSMPGLVVLYGSIVKKKCAVNSAFMALYAYASSLLVVGAGRGFPLALREAACSRFWGARAGGGGPLPQGLTLVPGGRDFPFFRTKTRGEREGPQRLPRNKGKEPPRCLHPGGRGVNDPLCEVALVPPQLDVKKKIYFVARTSSPKPRLVGGGFRST

SEQ ID NO: 96185 - DNA, 809 bp, Zea mays
  misc_feature: Ceres CLONE 1586680
  misc_feature: Encodes the peptide sequence at SEQ ID NO. 96186
  misc_feature (768)..(768): n is a, c, t, g, unknown, or other
tccccgcggtggcggccgctctagaactagtggatcccccgggctgcaggaattcgtctcacccctagaaaaagtatacaacacatctttcgcccgccatacttgggtacttgccatcttcttccgcgactccaaacacagtgttacgcggcccacctgcacctgcaatgcaacgatcggtccctctcgagcagtagacgcccggttccttgtactttggcacccccatcacgtcgtctggtcaatctaaagcttggacttgcagcctcctcatcggtcgatcgatcggagtgacgtgctggggattgtaggtgcaagcgcgcgcgacattgcagctaccgagaagaaagcagaggggcgatcgagcagttgacgggcgtgcagcaatggcgggacttcacttcttgctcgtgccgctggtggcgcaaggccacatcatcccgatggtggacctggcccgcctcctcgccggcaggggagcgcgagtcaccgtggttaccacgcccgtcaacgccgcgcgcaaccgggccgttgtagaaagcgcccggcgggcggggctcgacgtcgaggtcgcggagatcgcgttccccggcccggggcacgggctgccggagggtctggagaacatggacctgctcacgaggagggagcacttcttgcccttcttccaggcggcgtggaagatggacgcgccgctgggaggagtacgtgcggtcgctgccccggcgccgggactgcctcatagcagactcgtgcaacccgtggacnggcggaagtgtgcgcccgccacggcatccccgcgcctggtg

SEQ ID NO: 96186 - protein, 141 aa, Zea mays
  misc_feature: Ceres CLONE 1586680
  misc_feature: SWISSPROT Homolog: EC 2.4.1.238 Anthocyanin 3'-O-beta-glucosyltransferase
  misc_feature (128)..(128): Xaa is any aa, unknown, or other
MAGLHFLLVPLVAQGHIIPMVDLARLLAGRGARVTVVTTPVNAARNRAVVESARRAGLDVEVAEIAFPGPGHGLPEGLENMDLLTRREHFLPFFQAAWKMDAPLGGVRAVAAPAPGLPHSRLVQPVDXRKCAPATASPRLV

SEQ ID NO: 96187 - DNA, 782 bp, Zea mays
  misc_feature: Ceres CLONE 1586682
  misc_feature: Encodes the peptide sequence at SEQ ID NO. 96188
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (544)..(544): n is a, c, t, g, unknown, or other
ctcccgcggtggcggccgctctgaactagtggatcccccgggctgcaggaattcgtctcacccctagaaaaactctcgaaaccctagtcccctgctccttctcagccgccgccaatcccttcccgtgctccgcaaccgctgagtgagaagaagagatggccgggcaaagggcgatgcccggctatcgcatcgatctcggcacgacgtactctttgcgtccggcgtgttggcaacccccaacccccccnnnttcaagatctttgccaaaaacccggggaaacccccccccccccttaaaggtgcctttaacgatttcgaggggcctttttgagaaaggggggcaaaaaaaaagggggcccttgaaaccccccttaaaaacccgtttttttttataggagaaagggttttttttttgggggggggggggggtccacaagaaggggggtttttttttcccaaaaggggaggttatctccgggggggggggggggccccccctcctcgggggggggttttttttttttgcgggccgcccccgggaggnaaaacaccccccccccttttttgttttttttttcccccccccccccgggggggggggggggggaagaaaaaaaaaaatttttttcctgtccaaaaaaaaaaaaaaaacccccccccccccgcggggggggtttggtaaacaaaaaaaaagaggggggggagatattttgttttttaaaaatttcttttcttggtggggggggggcgataaacaaaaaaaaatataaggtgttgggggt

SEQ ID NO: 96188 - protein, 79 aa, Zea mays
  misc_feature: Ceres CLONE 1586682
  misc_feature (32)..(32): Xaa is any aa, unknown, or other
MAGQRAMPGYRIDLGTTYSLRPACWQPPTPPXSRSLPKTRGNPPPPLKVPLTISRGLFEKGGQKKRGPLKPPLKTRFFL

SEQ ID NO: 96189 - DNA, 834 bp, Zea mays
  misc_feature: Ceres CLONE 1586683
agctccccgcggtggcggccgctctagaactagtggatcccccgggctgcaggaattcgtctcacccctagaaaaagctccgtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcaattttttttttactgtcaaggataagcaagtgacctctgtgtgcataccacaccaccatacgtagcatacacaggcacagatggcagagcataaagggaacgttctcttgcacaagtatgagatggggaaatggctttgcccaggcacctttggccaagttttaccatgctcgtaacacggcgacttcggaaaagtgtcccgatcaaggtgattgataaggagaaaggttatta

SEQ ID NO: 96190 - DNA, 830 bp, Zea mays
  misc_feature: Ceres CLONE 1586685
  misc_feature: Encodes the peptide sequence at SEQ ID NO. 96191
  misc_feature (499)..(499): n is a, c, t, g, unknown, or other
  misc_feature (500)..(500): n is a, c, t, g, unknown, or other
  misc_feature (510)..(510): n is a, c, t, g, unknown, or other
  misc_feature (652)..(652): n is a, c, t, g, unknown, or other
  misc_feature (656)..(656): n is a, c, t, g, unknown, or other
ggagctccccgcggtggcggccgctctagaactagtggatcccccgggctgcaggaattcgtctcacccctagaaaaaattgtacttccactactaaaaaatgtgattgatcactcgtttatcggcaaagatgtttctttgggagtgaataccgagaggctgagatcaccactgacggccgctgcagccacacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaagggaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttccnntgccatctangcgccgtgctcgccgacgcccgcctcggccggttccgggtcatcaccctcggctcctgcgttagccttctcgggatgtgcctgctgtggctgacggcgatccttcccgtgtacaagaaccccccggaatgcgcgccggggcngccngtaagggtgccccggtgcttcccggggaaactgccccctcctctttacaggcgttccgggttcatgtcccctcggggtgggcgggaatccgggccttgaaaccttgggttttgggggccacaccccttggaacaaagggaaaaacaaggcccaataaacgtgtaggaccctgcg

SEQ ID NO: 96191 - protein, 158 aa, Zea mays
  misc_feature: Ceres CLONE 1586685
  misc_feature (74)..(74): Xaa is any aa, unknown, or other
  misc_feature (78)..(78): Xaa is any aa, unknown, or other
  misc_feature (125)..(125): Xaa is any aa, unknown, or other
MEMSAMEEALPKAMERRKGGLRTIPFIILNEIFEKVATFGLSANMILYLTERYLMTNAFATVVLYFWHAFSNFXCHLXAVLADARLGRFRVITLGSCVSLLGMCLLWLTAILPVYKNPPECAPGXPVRVPRCFPGKLPPPLYRRSGFMSPRGGRESGP

SEQ ID NO: 96192 - DNA, 837 bp, Zea mays
  misc_feature: Ceres CLONE 1586686
  misc_feature: Encodes the peptide sequence at SEQ ID NO. 96193
ctggagctccccgcggtggcggccgctctagaactagtggatcccccgggctgcaggaattcgtctcacccccccctagaaaacacgaaccaaaatcactatttcttatatattctattccctctcctctctgcaccgcccgccgcgccgagcacgcctctccctccctcgatccagatccaccccatacctccgcggcgccaccccttcccgctccttctagccggcgtcggcgcgggccggagatctgttttctccggtaggaaaaatcctattgcgatctaaatatgggttcgaaatcggtagacgaggtgctcgacgccgccgccgccggagtccattactccgcactccgtctggacggccaggcttccgcaacgacgtctggcctggagaacggccaccaggagccctttgttattggtgttgctgggggtgcatcgtcaggcaagagtaccgtgtgcaagatgatcattgatcagctccgtgaccagcgtgtcgtggttgttacgcaggagtccttttattatggattgacggatgaagaattagtacatgtccataattataactttgatcatccagacgcatttcatacagagctacttctctcttgtatgcaaaacttgaaatgtggcaaagctgttgacatccctaactacaacttcaagacatacaaaagtgtcccaaatgccaaggaaggttaatccttcggatgttattattttgggaggaaattctagtttttccatgaattcaccccctcaggggatttggaagaaccatgaaagaattttcggttggataccagacccctgaaccgtacgggttaaaaaa

SEQ ID NO: 96193 - protein, 139 aa, Zea mays
  misc_feature: Ceres CLONE 1586686
  misc_feature: SWISSPROT Homolog: EC 2.7.1.48 Uridine kinase
MGSKSVDEVLDAAAAGVHYSALRLDGQASATTSGLENGHQEPFVIGVAGGASSGKSTVCKMIIDQLRDQRVVVVTQESFYYGLTDEELVHVHNYNFDHPDAFHTELLLSCMQNLKCGKAVDIPNYNFKTYKSVPNAKEG

SEQ ID NO: 96194 - DNA, 892 bp, Zea mays
  misc_feature: Ceres CLONE 1586688
  misc_feature: Encodes the peptide sequence at SEQ ID NO. 96195
  misc_feature (347)..(347): n is a, c, t, g, unknown, or other
  misc_feature (353)..(353): n is a, c, t, g, unknown, or other
aagctggagctcaccgcggtggcggccgctctagaactagtggatcccccgggctgcaggaattcgtctcacccctagaaaaaaactccaagtcttctctctctttctctctattctttccatccccgcttctcggaagctcatcagccatggacgacgccgcgggagaggaagaagcttcgatgttcgagaccagccatgtccttggcgccctgctggcctcctcgccgctgctggcgtccgcctgggaccgctgtacgaccgccacagccgcggcgcccgggttcgtgcacggagaggacgggcggcaggtgtacgtgggggtctccgggtttgcaggcgcgctntctgcngcaggccccgccggtgcccggtggtggcgccaacgttcttcccgccggggggggctccgcggggaacccggcggggccgaatgtttccgcccgctgtttccggggccaaaacccaaatttttcccttttttggggaacccggtttccctttgcagggcccttgggcccctcaaaatgttttttttgaaaactttgggggggaaccccctgttttttccccaaaggcttttttaaaaaaaaaaaaacgggggggaaagggggattttttttttttcgcgggggccccccccccccggggggggggccctttttgccccccccctggggggggggcccacaacccccccggggggatttcttttctttaaaaagccccccacgggggggccccctcgggggccccctttgcgttgggggggggcccccctttgggggaagcccccccccttctttttaaaaaagaggggggttttttcctcggggggtaatctcctttctaaaaaaccccggggggggggggagtattttccccccccccc

SEQ ID NO: 96195 - protein, 145 aa, Zea mays
  misc_feature: Ceres CLONE 1586688
MDDAAGEEEASMFETSHVLGALLASSPLLASAWDRCTTATAAAPGFVHGEDGRQVYVGVSGFAGALSAAGPAGARWWRQRSSRRGGLRGEPGGAECFRPLFPGPKPKFFPFLGNPVSLCRALGPLKMFFLKTLGGNPLFFPQRLF

SEQ ID NO: 96196 - DNA, 838 bp, Zea mays
  misc_feature: Ceres CLONE 1586691
  misc_feature: Encodes the peptide sequence at SEQ ID NO. 96197
  misc_feature (686)..(686): n is a, c, t, g, unknown, or other
  misc_feature (696)..(696): n is a, c, t, g, unknown, or other
  misc_feature (729)..(729): n is a, c, t, g, unknown, or other
  misc_feature (812)..(812): n is a, c, t, g, unknown, or other
ctggagctccccgcggtggcggccgctctagaactagtggatcccccgggctgcaggaattcgtctcacccctagaaaaagtttccaacacagcgaggcccacgttgtagggttttttgcttgcttcgcccggcggtaaagctgagcgcggcgagagccggagaccgaagaagcgccgcccgccgcgcgcccggtcatggagatcggacagtaccccgcgagcggctgctccaaggagcaccagaagatctaccaggagtggttcgcgctcgcggacgcagatggggatggccgcatcacgggccccgatgcgatcaagttttttggcatgtccaagctctcccgccctgacctcaagcaggtctgggctatcgcggacaccagaaggcaggggtatctgggtttctctgaattcgtcacggcgatgcagctagtctctctggcacaagcaggcaacgagattactcaagatagccttaagcgagatgatttgagcagtttgaatccacctgtgatggaaggtttggatgccctacttgcgaaatggatggatatcctcaggaacaatctcctttaacaaacaaatggtttagctcaaagtcatcaaagaagatacctctgacagccgtcacttctgttatcgatggcttgaaaaaactttacatcgaaaagttgaagcctttggnaagtacatancagttcaatgatttcgtttcccctttgctgacnagtagtgattttgatgcaaagccaatgggtatgctcttagggtcatattctactgggtaaacaacttttatcagcatctgctnagaacaagttatcaggtgcccatatc

SEQ ID NO: 96197 - protein, 126 aa, Zea mays
  misc_feature: Ceres CLONE 1586691
  misc_feature: SWISSPROT Homolog: EC 2.7.11.1 Non-specific serine/threonine protein kinase
MEIGQYPASGCSKEHQKIYQEWFALADADGDGRITGPDAIKFFGMSKLSRPDLKQVWAIADTRRQGYLGFSEFVTAMQLVSLAQAGNEITQDSLKRDDLSSLNPPVMEGLDALLAKWMDILRNNLL

SEQ ID NO: 96198 - DNA, 806 bp, Zea mays
  misc_feature: Ceres CLONE 1586692
  misc_feature: Encodes the peptide sequence at SEQ ID NO. 96199
ctccccgcggtggcggccgctctagaactagtggatcccccgggctgcaggaattcgtctcaccctagaaaaaactctacctgaccagctcggcagctccccagccgcgacagagtccacgacgacgatctttcttcccagttccccccgtctgcctccggatccgagctcccctgcccgctcggtcgactccctcgtcgccgagtccagctccgactccgagaaaaaaatcaaatcgaccgagtccgcccgtgaagccgccgacagaaggagaaagcacacagcgggcgaggcaggcagcatgaagtccatgggcagccgcgacaagctcgcggcggcgtcgagccaccgccgcgtcctcttggtggtcttcgccttctgcttcgccttcgccaccttcctcaccttcctctacaccacctcccacttcacgaccgcgcccggctccggctccggctccggctccatcgcggcctctaccaccacaccaccaccacgaccctcggctctgcgggcggcggcggccaaggcaagcagggcccgagtccgtgtccaagcgctgccggtcccgggtgtcgaggcgctggtccactttcgcgtcatctcgaacgcgacgcaccgcatgtcgggacacggactccgggggcatgttcgtccgtgctccgcggcgggggcgccctgcaaacttgcttggtgtttcgggctgggcgcggaagtcccccccttggggctgggggcttaaacccgggggggggggaacgggtttctgggagggaaaacgaggttcttacctccaggaccctggg

SEQ ID NO: 96199 - protein, 146 aa, Zea mays
  misc_feature: Ceres CLONE 1586692
MKSMGSRDKLAAASSHRRVLLVVFAFCFAFATFLTFLYTTSHFTTAPGSGSGSGSIAASTTTPPPRPSALRAAAAKASRARVRVQALPVPGVEALVHFRVISNATHRMSGHGLRGHVRPCSAAGAPCKLAWCFGLGAEVPPLGLGA

SEQ ID NO: 96200 - DNA, 885 bp, Zea mays
  misc_feature: Ceres CLONE 1586696
  misc_feature: Encodes the peptide sequence at SEQ ID NO. 96201
ggagctccccgcggtggcggccgctctagaactagtggatcccccgggctgcaggaattcgtctcacccctagaaaaaagatgggccacgacctagatagtcatgctgctatcttctctgatacaagagctgagtggatcattgctgctcagggatgcttccgacaaaatttaacggttgtaacaatatatgcatctcttggtgaggatgcattggtgcattcactaaatgagacacaggtttcaactctgatatgtgattcgaagcaacttaagaagatacctgcaatcagctctaaattgcagagtcttaggcgtattatctatattgaggatgaacctgtcgaggctgagacactgaaccaaatgaagcatttgacaacattgtctttcactgaagtagaggagcttggcaagacatctcatgttgatgcaaggttaccttcaggctctgatactgcagttatcatgtatacaagcggaagtactggtctttcccagggtgtaatgatcacacatggcaacatggtggccacaactgcagcagtcatgacaatagtcccaaaccttggcatgaatgatgtttatctggctttatctccattggctcatgtcttttgactagcaggggagactgtcatgttagctcctggcaatgccattgggaaatggtttcagccttgacctatgactgaaacatcgaacaaaaattaagaaggggacccaaagggagatgttttctgtaccggaaatcccaccccttaatgatttccagttcccgggaaatttttgggaacctattcccaaaaatggccgtttttttaaaaaaactttgggtgaaaaaagggttgggccctttaacaaaaaaaagctggtttttaaatca

SEQ ID NO: 96201 - protein, 179 aa, Zea mays
  misc_feature: Ceres CLONE 1586696
  misc_feature: SWISSPROT Homolog: EC 6.2.1.3 Long-chain-fatty-acid--CoA ligase
MGHDLDSHAAIFSDTRAEWIIAAQGCFRQNLTVVTIYASLGEDALVHSLNETQVSTLICDSKQLKKIPAISSKLQSLRRIIYIEDEPVEAETLNQMKHLTTLSFTEVEELGKTSHVDARLPSGSDTAVIMYTSGSTGLSQGVMITHGNMVATTAAVMTIVPNLGMNDVYLALSPLAHVF

SEQ ID NO: 96202 - DNA, 1037 bp, Zea mays
  misc_feature: Ceres CLONE 1586699
  misc_feature (15)..(15): n is a, c, t, g, unknown, or other
ggtttgggtttggangggaaagggggagggttggggtgtcggtgcagtgcggaaggatgatatattaaaccatacgctaatccgtaattaattccaccggggtggcggccgctctagactagtggatcccccgggctgcaggaattcgtctcacccctagaaaaaacctctgaaccccgctctaataaatcttcctcccatctctctcgctcccaaccctcaagtccccaccaacccaaccctggtggcaccggccgcacacacgaaagcaagctagctagtcactattagagctatttggttgggagcggtttagctgagcaagatcgaactggcattgtcacacacatctcagcactcagctccttgggttcccctccatgagcagcagctgagcagccacacattgccgtcttccttgctgcacttgtagttacagctagatccattgatttttttggcaacaacaagagcaggagctactgagcaagaagtgcgtacgtgcttggtgagtgttacttatactagcttgcgatggagctggtgactatggtgacgctgacgctgctggcgtactcggcggcgatgctggcgcggccttctgagtggcgcgcgacgccagcggcgttcggtgcctaccctggctggaactacgtggtgcctaaaaagggcgcacgggaacgacccgggaaagcctggccggcaggagaccctggtgcccgggcggagaaatcaatcccaggccggaaaacaaaggcctgccttggggggccttgggaaggaaagtaaccaaggtttcccttggcctggaaagaggtggaattccgtgaaaacttcggggggccattcggggcggaggagaaagaccgtaaacgggtcccccgcgcggcacaacattggaaaccctaaagggggccggggggaaaaggtccccgaggcccggggaacccgccccctccccgccgaaagggggccatttgggaagggaagaattggggaaccgaagaaaccccttgtccaacggccccggtccccta

SEQ ID NO: 96203 - DNA, 912 bp, Zea mays
  misc_feature: Ceres CLONE 1586706
  misc_feature: Encodes the peptide sequence at SEQ ID NO. 96204
ccccgcggtggcggccgctctagaactagtggatcccccgggctgcaggaattcgtctcacccctagaaaaatagaaaaaaaaacccttccttttgctctcccgttgcgcgcttctcctcctcctcctcacacccctctctttctgtcggcggcgactgggcggccgtcgctgccgtcctacgccagctgcccaggtcttcctcgcgcccttcgccggcggcaaccaccgccagggtaagccagccatcagccatggctttgaaggcgagctccagcgacaaccggaccaggagcacggtatccctgtgcatagtgattggcatgtgctgcttcttctacatcccccgggcgtggcaaaagagcgggttcgggaagggggacagcatcgcgctggagggtccccaagcgcaccgactggcccggtcgtgccgaaaccttactttcaacccccaccattcctaaaagccaggggcaaccttctagcaacccggggtttctccggtccaaaaaagtttcaagcccgggcccctgaattttcataccgggaatataccccccccctggccaaaaaccagaaaacaggggggaataaaaatttctccctagggggagaaccttggaattttccggagggcgccggattttgcccccggccccaaaaagggaaaaaccctgcccccgggtttgggttcccccccccccaaaaagggctattggtgggccccccccttcccgcggggcccaaaaaaaaccgggggacatatgttcccccttttccgaaaaatggcccctataaaaaaacctttgaaaaggtcccaaaaaaacccctccccaaaaagtgggggcccaataatggaggggggaaagtgtttccggaattccctggggggggggagggacgcccaattccc

SEQ ID NO: 96204 - protein, 69 aa, Zea mays
  misc_feature: Ceres CLONE 1586706
MALKASSSDNRTRSTVSLCIVIGMCCFFYIPRAWQKSGFGKGDSIALEGPQAHRLARSCRNLTFNPHHS

SEQ ID NO: 96205 - DNA, 867 bp, Zea mays
  misc_feature: Ceres CLONE 1586707
  misc_feature: Encodes the peptide sequence at SEQ ID NO. 96206
ctccccgcggtggcggccgctctagaactagtggatcccccgggctgcaggaattcgtctcacccctagaaaaagttttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacgacgcagtggtggtgggggccggcggcgcggggctccgggcggcgatcggcctctccgagcacggcttcaacaccgcgtgcatcaccaagctcttccccacgcgctcgcacaccgtcgcggctcagggaggcataaatgctgcacttggaaacatgagtgaagatgactggaggtggcatatgtatgacactgttaagggaagcgattggctgggtgaccaggattctattcagtatatgtgcagagagggcaccaaagctgttatagagcttgagaactatggactaccattttcaagaactgaggagggaagatataccaacgttgccttttgaggggcagagcttagatttttgcaaaagttgaccagccctaccgttgtgcctgcgctgctgacagaacaggacatgctatgctgcacacacctatatggtcaagccaatgaagcacaccctccatttttttgtgggaatactttgcctttggaccttcctcatgggacaatgaaaagaaaaatgttcaggggaatcttggccctttaaacctggagggatgggaacccctttccccggttttccgcgggcttcaaa

SEQ ID NO: 96206 - protein, 146 aa, Zea mays
  misc_feature: Ceres CLONE 1586707
  misc_feature: SWISSPROT Homolog: EC 1.3.5.1 Succinate dehydrogenase (ubiquinone)
MWRSCVSRGLSRAKASASRLLSTASSSYTVVDHTYDAVVVGAGGAGLRAAIGLSEHGFNTACITKLFPTRSHTVAAQGGINAALGNMSEDDWRWHMYDTVKGSDWLGDQDSIQYMCREGTKAVIELENYGLPFSRTEEGRYTNVAF

SEQ ID NO: 96207 - DNA, 1269 bp, Zea mays
  misc_feature: Ceres CLONE 1586708
  misc_feature (15)..(15): n is a, c, t, g, unknown, or other
  misc_feature (17)..(17): n is a, c, t, g, unknown, or other
  misc_feature (966)..(966): n is a, c, t, g, unknown, or other
  misc_feature (1269)..(1269): n is a, c, t, g, unknown, or other
ttttgggttgtggtntntttgagggagtgcccacccccaccaggatcaaccatcctctcacctaagaagaaaaaaaagggagctccccgcggtggcggccgctctagaatagtggatcccccgggctgcaggaattcgtctcacccctagaaaaaatgtacttccactactaaaaaatgtgattgatcactcgtttatcggcaaagatgtttctttgggagtgaataccgagaggctgagatcaccactgacggccgctgcagccacacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaaggggaggcctcaaaaccattccgtttcatctttcttaaacgaaatattcgaaaaggggggcacgttcgggctgccccccaacatgatcctgtaccttacccgagccggaatcttattagacaaacgcctttggcaaccgtacatccctctatattacgggggggccttttctccaaagttttcctggcccaattattaaaggccaccgtggcttagcacaaactacccagtcctttagaaaccggattaccaggggcccatccacccctgccgggctttcccgagggtttgaaagcccctcttctcgccggaaaaaagtgcccccttacctggtgggtacaatgaaacctgaagatataatatcctcttctcccgggggggtgcatacccaaaagaaaaccaacatcccctcctcggaaagagaatgtgtggcgcgatctcccatgaggaggatgtgatatgctattgtaacatagagggtggcgacgctacttgcgatgtatattcatatcgctcgttaggataccataaatattcgtcacgtaacatgtctttgttntggttaaagcgcgacggcgaaattgccgcgccggtgtcgcgaaggtaccccgcactatgggggtgccacgtaaagaaaggcggattaaagctcgcggttactttatcatgtatacaagccatattatggatgtagtatcctgcgggcgactcaataacaactagataggttggtaacaatgaacgaagagggatgacaaaaaatgacgcatgcggtgaatacataatattactatgtgtgcccaccctttctaggaagaacacatccgcgtgctaaaaccgggggggggcacgcataccgggn

SEQ ID NO: 96208 - DNA, 865 bp, Zea mays
  misc_feature: Ceres CLONE 1586711
  misc_feature: Encodes the peptide sequence at SEQ ID NO. 96209
ggagctcaccgcggtggcggccgctctagaactagtggatcccccgggctgcaggaattcgtctcaccccctagaaaaaactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcggtgagcggtaggaggcgcccgtacaactgaggggacgggcaatggcggccgtggcaggcccactctgcacgtggctcgtcgccgcgtgcttgtctgcggcttgcgacgcagaagagtacaagcagaagcattgctgccccggcggaagcggcgctgggggcggcgtcatgctcggcctgcgccgccgcctcggcgcgcggcgtcgcggcttggcgccgctctggaatggctatggctgttgcccttacaagcttgaaagaagtgtcattgaaaaagaagaaacccgatatcaaaccaaagggagggggggttgtcaactggcatgggggtgtagtggacacccattgggggccatgaatccacgaacgttcttttttaacaccaaattcttctcttgaaatggtggtttaaggcgggaaataaagggtgagaatatagaagaggggttttggaacatgggtttccaaaacttttccccccccacggaagaaa

SEQ ID NO: 96209 - protein, 118 aa, Zea mays
  misc_feature: Ceres CLONE 1586711
MAAVAGPLCTWLVAACLSAACDAEEYKQKHCCPGGSGAGGGVMLGLRRRLGARRRGLAPLWNGYGCCPYKLERSVIEKEETRYQTKGRGGCQLAWGCSGHPLGAMNPRTFFFNTKFFS

SEQ ID NO: 96210 - DNA, 1220 bp, Zea mays
  misc_feature: Ceres CLONE 1586713
  misc_feature: Encodes the peptide sequence at SEQ ID NO. 96211
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (40)..(40): n is a, c, t, g, unknown, or other
  misc_feature (887)..(887): n is a, c, t, g, unknown, or other
ggaggggnnnattcttttttgtgggtttcctccctccttntacgctgaagtattttattccaatcacgtaataagcaaaatgaatcgccgctggtggcggccgctcttaactagtggatcccccgggggtgttgaattcgtcctcctcctagaaaatgttggtgatgtccgatatgatccggatttaggtacggaactacatgtccgggtcggggctcgatccgcgcaccgacagctcctccgtgcacgccgtgatcaagcctatgatgggtatggccaagatctactagtttcagagcgcatgcacacagcggcagtagcaggcgtggaagatacaaaagaaaacgaaccgcctatcgatccgcggcggacagcccgtgtatgaagcaataatgaaccagtaagaacggcgtggccttgaaccatacggaggccgtgtggtgcggcaagtgaactcctcccaccatccggcttttgagattgcggcaatatacatacccttgtgtaagtttagcccggggcccctatcttgtgataccttcttcccccttcctttttttctcaaacttcttgggatcttcagaggctagttaaagcaggagaccctatcaccgaatgaagaaacttttgggttaggttggaactgccgctatacccatggcccgaccttttagctaagtttaaaaaattggcctctgcccggggataatcaaatcgtttttccaggagtcataaaaaggcgacatctcctttccttattgcccattctagaaatagccaatcgcgttaggggtctatatcccgcaaggttctaatctccacagggtaataacgtgagaacaggtgtagcctgtgtgtggataacagaatgcgcgagcacatacagngcgacatctcctttgggtctttcctgagaagatccgctatgtatacaaaaagttgctgtatctttatatcaccacatcatcggaaagtggacatctctctatatgcgctatgatatccatacctcacgacacacgtatttttcccacacgatctcttagtaatatgccaacacgcggaaacatatctctccaccgtcagtatatacggccaaacataatatttttgactccacgaagcgtgtgtcttgtatgcgaccctctcccacggatgttcacaccctcactatgcgtaccgtaatgcaacaccataatgagatgagagaattgtaaccc

SEQ ID NO: 96211 - protein, 29 aa, Zea mays
  misc_feature: Ceres CLONE 1586713
MSGSGLDPRTDSSSVHAVIKPMMGMAKIY

SEQ ID NO: 96212 - DNA, 895 bp, Zea mays
  misc_feature: Ceres CLONE 1586714
  misc_feature: Encodes the peptide sequence at SEQ ID NO. 96213
tccccgcggtggcggccgctctagaactagtggatcccccgggctgcaggaattcgtctcacccctagaaaaaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaagggatgggtcagctatcaagaagctccagactggagtcaataagcttgccgaacttgttggaggttacactccggacgaaggggaaaggaatgtccgttttgggagaacaaagtacggcttcttccccagatttgtttaacaatgggcgtttccagtttgccaaaaaaagggttaaacctgggagggaacccgggggaaaaaaaattttggaacctaaaaattgggtcagggggaaacctttgcccccttaaaaaaccacacgaattttttgttggggggaaagggggaaaacaccccccccttgttggggccccccctccccccaggggggttttattttttttgaggggggttttataaagggtcctaaaaaacccgggggggggcaaaacacccgggtataaaaaaaaatccccccggggggtttttggaaaaaaaaacacccctatacactcccttttgtggaaaagacaaccccgcggggtttttcttttaggaggggggtgaaaaaaaaaagagggcgcctccccaaaaatttttccctcccctatatgggggggcg

SEQ ID NO: 96213 - protein, 55 aa, Zea mays
  misc_feature: Ceres CLONE 1586714
MASTFGATSTVGLMAAPTGKNVRLQRRANFRVKAAKELYFNKGWVSYQEAPDWSQ

SEQ ID NO: 96214 - DNA, 831 bp, Zea mays
  misc_feature: Ceres CLONE 1586715
  misc_feature: Translation starting site: 184
  misc_feature: Pfam Name: CDC48_2 Pfam Description: Cell division protein 48 (CDC48), domain 2
  misc_feature (732)..(732): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (819)..(819): n is a, c, t, g, unknown, or other
  misc_feature (820)..(820): n is a, c, t, g, unknown, or other
tggagctccccgcggtggcggccgctctagaactagtggatcccccgggctgcaggaattcgtctcacccctagaaaactaaaaaatccgcatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaaagtcaccgaaccgccttgtcgtcgacgaggccaccaacgacgataactccgtcgtcgctctgcaccctgacaccatggagaggctgcagctcttccgcggcgacaccgtgctcctcaagggtaagaagaggaaagacactatttgcattgtccttgcggacgaaacctgtgaggagccaaaggttcggatgaacaaggttgtccgccagaacctaagggtgaggcttggtgatgtggtttctgtccaccagtgccaggatgtgaaatatgggaagcgtgtccacattcttccaattgatgatacagttgaaggcattacagggaacctgtttgatgccttcttgaaacatatttcctagaagcatacaggccgttgaggaaaggagaccttttccttgtcagaagaggaatgagaagtgtggaattcaaagtgatagagactgatcctgctgaaatatgtatcngtgcgccagatactgaaatattttgtgatggggagccctataagagggaggatgagagcgtctgatgagtgtatagaannnnnnggnngggggaggaag

SEQ ID NO: 96215 - DNA, 849 bp, Zea mays
  misc_feature: Ceres CLONE 1586722
  misc_feature: Encodes the peptide sequence at SEQ ID NO. 96216
ccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaaggggttcggcgagtgcacccacgacgtgacgtcgctgacgggcgccgacttcctgcgcgcgcccggcgtgcggacgcccgtggacgtgcgccttctctacggggattcccgagcggggggccccggaagacgatccccgaacccccgcggggttcccccggaaaattctccccccccccaggggcaactggggacctggttgggggaaaaaatttccccggttttttttttctcccggacgggataaaagtttcccccgacgaggagccccctcggtttaaaggcccaaacccccccggcacgcccgtgtcgaggaataactcggggggggggttccacagatcacggtgcggcactcccccccaagagctgcgtggcggagatttgtttttcttctgtttaataaaaatggggtgtgggctcgctcacagagaaaaggccccaaggaggagggtgcaggggcgaggaacaaccgcgaccacctttgtgtg

SEQ ID NO: 96216 - protein, 153 aa, Zea mays
  misc_feature: Ceres CLONE 1586722
  misc_feature (18)..(152): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFGECTHDVTSLTGADFLRAPGVRTPVDVRLLYGDSRAGGPGRRSPNPRGVPPENSPPPQGQLGTWLGEKISPVFFFSRTG

SEQ ID NO: 96217 - DNA, 1219 bp, Zea mays
  misc_feature: Ceres CLONE 1586724
  misc_feature: Encodes the peptide sequence at SEQ ID NO. 96218
  misc_feature (66)..(66): n is a, c, t, g, unknown, or other
  misc_feature (67)..(67): n is a, c, t, g, unknown, or other
ccctcttcattcaaaaaaaatgtcgttttcgcgccacccctcctctttatttgaaaacaacagttnntataaaattggaactccccgcggtggcggccgctctagaactagtggatcccccgggctgcaggaattcgtctcacccctagaaaaaaaaaatctgggcggtgaaaccctcaaaccctaatcctttggcccctcaccatggcggacgctgacgacgcgccgccaacgccgcctcctgaggtagtagcccccgaggagcatcccgcggtcgccgaatccgccgttgccgcgcatcaggagggggcagcgacggcccaagtcgataacaagcggaagctcgaggaggctggcgccgactcggaggcgaacggcaccggcgaggacgccaagcgcccgcgcgtggatggtgagcccgacgctgccacaggtatttgagcatcagaaccatgggtccccccgtgaatgtttccctgaatgtggaggaaaccccccgctgccgaggaggaaaaaggtagctcccccaccgatgggggcaatccaccggatgggtggaaaatgaacacggcccccccccctggctacggaaatttcgccaaggcggggtttttttaagaacaataacccttttggaaacacgacagtcttgaaaagctcccccccaatcccgggcaaaagtggaattgtccaatccaaccttttgttggacccccaaccgaaagaatcctctccgtgggaaagagggaatcttcaagatggaaaacctccaaacacaactcacagaggggtaacgcgggggcgggttccctcttatttttcttaggccagaaaaaaaatctctgtgcgtgtggtaacaacaccaaaaattttggggtggaaccctttcgttttaaacaaaatgggaatactcaatgcgggcgggggtgtatgagagagaatactccccacagagatgtcctctacacagagagatagcgccccgaaatatagcgcggcggaccttccacaaaatgctccccccttataattatttccatatcttcgggagttaagaaaaacacaaagcagacggaaaacaccctcttgcaataaacacgatgtgttaataaacataagagaaaagactttggtttttattatagaagaaagcgtggtaaagtatcacctaagaggagattaaaagcgattttgggtgggtgtttccgttctggcgcgc

SEQ ID NO: 96218 - protein, 78 aa, Zea mays
  misc_feature: Ceres CLONE 1586724
MADADDAPPTPPPEVVAPEEHPAVAESAVAAHQEGAATAQVDNKRKLEEAGADSEANGTGEDAKRPRVDGEPDAATGI
